US012508308B2

(12) United States Patent
Jasny et al.

(10) Patent No.: US 12,508,308 B2
(45) Date of Patent: Dec. 30, 2025

(54) INFLUENZA mRNA VACCINES

(71) Applicant: CureVac SE, Tübingen (DE)

(72) Inventors: Edith Jasny, Stuttgart (DE); Susanne Rauch, Tübingen (DE); Kim Ellen Schwendt, Dettenhausen (DE); Benjamin Petsch, Tübingen (DE); Karen Slobod, Somerville, MA (US)

(73) Assignee: CureVac SE, Tübingen (DE)

( * ) Notice: Subject to any disclaimer, the term of this patent is extended or adjusted under 35 U.S.C. 154(b) by 329 days.

(21) Appl. No.: 16/098,834

(22) PCT Filed: May 4, 2017

(86) PCT No.: PCT/EP2017/060663
§ 371 (c)(1),
(2) Date: Nov. 2, 2018

(87) PCT Pub. No.: WO2017/191258
PCT Pub. Date: Nov. 9, 2017

(65) Prior Publication Data

US 2021/0162037 A1 Jun. 3, 2021

(30) Foreign Application Priority Data

May 4, 2016 (WO) ................. PCT/EP2016/060112
Oct. 26, 2016 (WO) ................. PCT/EP2016/075862

(51) Int. Cl.
*A61K 39/145* (2006.01)
*A61K 39/00* (2006.01)

(52) U.S. Cl.
CPC ........ *A61K 39/145* (2013.01); *A61K 2039/53* (2013.01); *A61K 2039/54* (2013.01); *A61K 2039/55555* (2013.01); *A61K 2039/70* (2013.01); *C12N 2760/16034* (2013.01)

(58) Field of Classification Search
None
See application file for complete search history.

(56) References Cited

U.S. PATENT DOCUMENTS 9,872,900 B2 * 1/2018 Ciaramella .......... A61K 39/155
2005/0032730 A1 2/2005 von der Mülbe et al.
2005/0059624 A1 3/2005 Hoerr et al.
2005/0250723 A1 11/2005 Hoerr et al.
2006/0188490 A1 8/2006 Hoerr et al.
2008/0025944 A1 1/2008 Hoerr et al.
2008/0175863 A1 * 7/2008 Jin .......................... C12N 7/00 424/209.1
2008/0267873 A1 10/2008 Hoerr et al.
2009/0324584 A1 12/2009 Hoerr et al.
2010/0048883 A1 2/2010 Ketterer et al.
2010/0189729 A1 7/2010 Hoerr et al.
2010/0203076 A1 8/2010 Fotin-Mleczek et al.
2010/0291156 A1 11/2010 Barner et al.
2010/0305196 A1 12/2010 Probst et al.
2011/0053829 A1 3/2011 Baumhof et al.
2011/0189230 A1 * 8/2011 Podda ................. A61K 39/145 424/206.1
2011/0250225 A1 10/2011 Fotin-Mleczek et al.
2012/0021043 A1 1/2012 Kramps et al.
2012/0258046 A1 10/2012 Mutzke
2013/0129754 A1 5/2013 Thess et al.
2013/0142818 A1 6/2013 Baumhof et al.
2013/0259879 A1 10/2013 Baumhof et al.
2013/0280283 A1 10/2013 Lorenz et al.
2013/0295043 A1 11/2013 Kallen et al.
2013/0336998 A1 12/2013 Kallen et al.
2015/0037326 A1 2/2015 Butler-Ransohoff et al.
2015/0050302 A1 2/2015 Thess
2015/0057340 A1 2/2015 Thess et al.
2015/0093413 A1 4/2015 Thess et al.
2015/0118183 A1 4/2015 Baumhof
2015/0118264 A1 4/2015 Baumhof et al.
2015/0165006 A1 6/2015 Thess et al.
2015/0184195 A1 7/2015 Thess et al.
2015/0218554 A1 8/2015 Thess
2015/0306249 A1 10/2015 Baumhof et al.
2015/0320847 A1 11/2015 Thess et al.
2016/0130345 A1 5/2016 Fotin-Mleczek et al.

(Continued)

FOREIGN PATENT DOCUMENTS

WO WO 2002/098443 12/2002
WO WO06078294 * 7/2006

(Continued)

OTHER PUBLICATIONS

Kudla et al., High Guanine and Cytosine Content Increases mRNA Levels in Mammalian Cells, 2006, PLoS Biology, vol. 4, No. 6.*
GenBank Accession KF998101, Synthetic construct clone VRC3393 HAdelSA probe gene, complete cds, 2014.*
GenBank Accession KF998100, Synthetic construct clone VRC3389 HAdelSA probe gene, complete cds, 2014.*
Database Uniprot, Accession No. A0A068IZQ2, Oct. 1, 2014.

(Continued)

*Primary Examiner* — Benjamin P Blumel
(74) *Attorney, Agent, or Firm* — pH IP Law

(57) ABSTRACT

The present invention relates to mRNA sequences usable as mRNA-based vaccines against infections with influenza viruses. Additionally, the present invention relates to a composition comprising the mRNA sequences and the use of the mRNA sequences or the composition for the preparation of a pharmaceutical composition, especially a vaccine, e.g. for use in the prophylaxis or treatment of influenza virus infections. The present invention further describes a method of treatment or prophylaxis of infections with influenza virus using the mRNA sequences.

31 Claims, 874 Drawing Sheets

Specification includes a Sequence Listing.

(56) References Cited

U.S. PATENT DOCUMENTS

| | | | |
|---|---|---|---|
| 2016/0166668 | A1 | 6/2016 | Kallen et al. |
| 2016/0166678 | A1 | 6/2016 | Kallen et al. |
| 2016/0166710 | A1 | 6/2016 | Baumhof |
| 2016/0166711 | A1 | 6/2016 | Schnee et al. |
| 2016/0168207 | A1 | 6/2016 | Kramps et al. |
| 2016/0168227 | A1 | 6/2016 | Kallen et al. |
| 2016/0235864 | A1 | 8/2016 | Schlake et al. |
| 2016/0304883 | A1 | 10/2016 | Grund et al. |
| 2016/0304938 | A1 | 10/2016 | Wochner |
| 2016/0326575 | A1 | 11/2016 | von der Mülbe |
| 2016/0331844 | A1 | 11/2016 | Fotin-Mleczek et al. |
| 2017/0014496 | A1 | 1/2017 | Fotin-Mleczek et al. |
| 2017/0029847 | A1 | 2/2017 | Thess |
| 2017/0114378 | A1 | 4/2017 | Wochner et al. |
| 2017/0252430 | A1 | 9/2017 | Fotin-Mleczek et al. |
| 2017/0326225 | A1 | 11/2017 | Rauch et al. |
| 2018/0044687 | A1 | 2/2018 | Thess et al. |
| 2018/0125952 | A1 | 5/2018 | Fotin-Mleczek et al. |
| 2018/0126003 | A1 | 5/2018 | Hoerr |
| 2018/0142275 | A1 | 5/2018 | Roos et al. |
| 2018/0147146 | A1 | 5/2018 | Eber et al. |
| 2018/0148727 | A1 | 5/2018 | Grund et al. |
| 2018/0201967 | A1 | 7/2018 | Eber et al. |
| 2018/0208957 | A1 | 7/2018 | Roos et al. |
| 2018/0214537 | A1 | 8/2018 | Mutzke et al. |
| 2018/0237786 | A1 | 8/2018 | Schlake et al. |
| 2018/0237817 | A1 | 8/2018 | Roos et al. |
| 2018/0243219 | A1 | 8/2018 | Ketterer et al. |
| 2018/0296663 | A1 | 10/2018 | Hipp et al. |
| 2018/0298372 | A1 | 10/2018 | Funkner et al. |
| 2018/0312545 | A1 | 11/2018 | Baumhof et al. |
| 2018/0371392 | A1 | 12/2018 | Mayer et al. |
| 2019/0010485 | A1 | 1/2019 | Yazdan Panah et al. |
| 2019/0017100 | A1 | 1/2019 | Wochner et al. |
| 2019/0024096 | A1 | 1/2019 | Schmid et al. |

FOREIGN PATENT DOCUMENTS

| | | |
|---|---|---|
| WO | WO 2010/037408 | 4/2010 |
| WO | WO 2012/019630 | 2/2012 |
| WO | WO 2015/024665 | 2/2015 |
| WO | WO 2015/024669 | 2/2015 |
| WO | WO 2016/184576 | 11/2016 |
| WO | WO 2017/021546 | 2/2017 |
| WO | WO 2017/025447 | 2/2017 |
| WO | WO 2017/064146 | 4/2017 |
| WO | WO 2017/081110 | 5/2017 |
| WO | WO 2017/109134 | 6/2017 |
| WO | WO 2017/137095 | 8/2017 |
| WO | WO 2017/140345 | 8/2017 |
| WO | WO 2017/140905 | 8/2017 |
| WO | WO 2017/149139 | 9/2017 |
| WO | WO 2017/162297 | 9/2017 |
| WO | WO 2017/182634 | 10/2017 |
| WO | WO 2017/186928 | 11/2017 |
| WO | WO 2017/191264 | 11/2017 |
| WO | WO 2017/191274 | 11/2017 |
| WO | WO 2017/203008 | 11/2017 |
| WO | WO 2017/212006 | 12/2017 |
| WO | WO 2017/212007 | 12/2017 |
| WO | WO 2017/212009 | 12/2017 |
| WO | WO 2019/008001 | 1/2019 |

OTHER PUBLICATIONS

Database Uniprot, Accession No. A0A097PG98, Jan. 7, 2015.

Database Uniprot, Accession No. A0A0N9RU18, Jan. 20, 2016.

Database Uniprot, Accession No. Q67043, Nov. 1, 1996.

International Search Report and Written Opinion issued in corresponding PCT Application No. PCT/EP2017/060663, mailed on Nov. 15, 2017.

Petch et al., "Protective efficacy of in vitro synthesized, specific mRNA vaccines against influenza A virus infection", *Nat. Biotechnol.,* 30(12):1210-1216, 2012.

Wong and Webby, "An mRNA vaccine for influenza", *Nat. Biotechnol.,* 30(12):1202-1204, 2012.

Lutz et al., "Unmodified mRNA in LNPs constitutes a competitive technology for prophylactic vaccines," *npj Vaccines,* 2:29, 2017.

Reichmuth et al., "mRNA vaccine delivery using lipid nanoparticles," *Therapeutic Delivery,* 7(5):319-334, 2016.

* cited by examiner

| | column 1 | column 2 | column 3 | column 4 | | column 1 | column 2 | column 3 | column 4 |
|---|---|---|---|---|---|---|---|---|---|
| Row | NCBI, Genbank or EpiFlu Accession No. | A | B | C | Row | NCBI, Genbank or EpiFlu Accession No. | A | B | C |
| 1 | AAA16879 | 1 | 30505 | 61009, 91513, 122017, 152521, 183025 | 7017 | AEL89491 | 7017 | 37521 | 68025, 98529, 129033, 159537, 190041 |
| 2 | AAA16880 | 2 | 30506 | 61010, 91514, 122018, 152522, 183026 | 7018 | AEL89501 | 7018 | 37522 | 68026, 98530, 129034, 159538, 190042 |
| 3 | AAA64362 | 3 | 30507 | 61011, 91515, 122019, 152523, 183027 | 7019 | AEL89511 | 7019 | 37523 | 68027, 98531, 129035, 159539, 190043 |
| 4 | AAA64363 | 4 | 30508 | 61012, 91516, 122020, 152524, 183028 | 7020 | AEL89521 | 7020 | 37524 | 68028, 98532, 129036, 159540, 190044 |
| 5 | AAA64365 | 5 | 30509 | 61013, 91517, 122021, 152525, 183029 | 7021 | AEL89531 | 7021 | 37525 | 68029, 98533, 129037, 159541, 190045 |
| 6 | AAA64366 | 6 | 30510 | 61014, 91518, 122022, 152526, 183030 | 7022 | AEL89541 | 7022 | 37526 | 68030, 98534, 129038, 159542, 190046 |
| 7 | AAA85781 | 7 | 30511 | 61015, 91519, 122023, 152527, 183031 | 7023 | AEL89551 | 7023 | 37527 | 68031, 98535, 129039, 159543, 190047 |
| 8 | AAC14418 | 8 | 30512 | 61016, 91520, 122024, 152528, 183032 | 7024 | AEL89561 | 7024 | 37528 | 68032, 98536, 129040, 159544, 190048 |
| 9 | AAC40508 | 9 | 30513 | 61017, 91521, 122025, 152529, 183033 | 7025 | AEL89571 | 7025 | 37529 | 68033, 98537, 129041, 159545, 190049 |
| 10 | AAF87274 | 10 | 30514 | 61018, 91522, 122026, 152530, 183034 | 7026 | AEL89581 | 7026 | 37530 | 68034, 98538, 129042, 159546, 190050 |
| 11 | AAF87275 | 11 | 30515 | 61019, 91523, 122027, 152531, 183035 | 7027 | AEL89591 | 7027 | 37531 | 68035, 98539, 129043, 159547, 190051 |

FIG. 1

| | | | | | | | | | |
|---|---|---|---|---|---|---|---|---|---|
| 12 | AAF87277 | 12 | 30516 | 61020, 91524, 122028, 152532, 183036 | 7028 | AEL89601 | 7028 | 37532 | 68036, 98540, 129044, 159548, 190052 |
| 13 | AAF87278 | 13 | 30517 | 61021, 91525, 122029, 152533, 183037 | 7029 | AEL89611 | 7029 | 37533 | 68037, 98541, 129045, 159549, 190053 |
| 14 | AAF87279 | 14 | 30518 | 61022, 91526, 122030, 152534, 183038 | 7030 | AEL89621 | 7030 | 37534 | 68038, 98542, 129046, 159550, 190054 |
| 15 | AAF87281 | 15 | 30519 | 61023, 91527, 122031, 152535, 183039 | 7031 | AEL89631 | 7031 | 37535 | 68039, 98543, 129047, 159551, 190055 |
| 16 | AAF87282 | 16 | 30520 | 61024, 91528, 122032, 152536, 183040 | 7032 | AEL89641 | 7032 | 37536 | 68040, 98544, 129048, 159552, 190056 |
| 17 | AAF87283 | 17 | 30521 | 61025, 91529, 122033, 152537, 183041 | 7033 | AEL89651 | 7033 | 37537 | 68041, 98545, 129049, 159553, 190057 |
| 18 | AAF87284 | 18 | 30522 | 61026, 91530, 122034, 152538, 183042 | 7034 | AEL89661 | 7034 | 37538 | 68042, 98546, 129050, 159554, 190058 |
| 19 | AAG01749 | 19 | 30523 | 61027, 91531, 122035, 152539, 183043 | 7035 | AEL89671 | 7035 | 37539 | 68043, 98547, 129051, 159555, 190059 |
| 20 | AAG01767 | 20 | 30524 | 61028, 91532, 122036, 152540, 183044 | 7036 | AEL89691 | 7036 | 37540 | 68044, 98548, 129052, 159556, 190060 |
| 21 | AAG01776 | 21 | 30525 | 61029, 91533, 122037, 152541, 183045 | 7037 | AEL89701 | 7037 | 37541 | 68045, 98549, 129053, 159557, 190061 |
| 22 | AAG01785 | 22 | 30526 | 61030, 91534, 122038, 152542, 183046 | 7038 | AEL89711 | 7038 | 37542 | 68046, 98550, 129054, 159558, 190062 |
| 23 | AAK52911 | 23 | 30527 | 61031, 91535, 122039, 152543, 183047 | 7039 | AEL89721 | 7039 | 37543 | 68047, 98551, 129055, 159559, 190063 |
| 24 | AAK52912 | 24 | 30528 | 61032, 91536, 122040, 152544, 183048 | 7040 | AEL89741 | 7040 | 37544 | 68048, 98552, 129056, 159560, 190064 |
| 25 | AAK71687 | 25 | 30529 | 61033, 91537, 122041, 152545, 183049 | 7041 | AEL89751 | 7041 | 37545 | 68049, 98553, 129057, 159561, 190065 |
| 26 | AAS65618 | 26 | 30530 | 61034, 91538, 122042, 152546, 183050 | 7042 | AEL89761 | 7042 | 37546 | 68050, 98554, 129058, 159562, 190066 |
| 27 | AAT38819 | 27 | 30531 | 61035, 91539, 122043, 152547, 183051 | 7043 | AEL89771 | 7043 | 37547 | 68051, 98555, 129059, 159563, 190067 |
| 28 | AAV32636 | 28 | 30532 | 61036, 91540, 122044, 152548, 183052 | 7044 | AEL89781 | 7044 | 37548 | 68052, 98556, 129060, 159564, 190068 |
| 29 | AAV34704 | 29 | 30533 | 61037, 91541, 122045, 152549, 183053 | 7045 | AEL89791 | 7045 | 37549 | 68053, 98557, 129061, 159565, 190069 |

FIG. 1 continued

| | | | | | | | | | |
|---|---|---|---|---|---|---|---|---|---|
| 30 | AAV65826 | 30 | 30534 | 61038, 91542, 122046, 152550, 183054 | 7046 | AEL89801 | 7046 | 37550 | 68054, 98558, 129062, 159566, 190070 |
| 31 | AAX11505 | 31 | 30535 | 61039, 91543, 122047, 152551, 183055 | 7047 | AEL89812 | 7047 | 37551 | 68055, 98559, 129063, 159567, 190071 |
| 32 | AAX11525 | 32 | 30536 | 61040, 91544, 122048, 152552, 183056 | 7048 | AEL89832 | 7048 | 37552 | 68056, 98560, 129064, 159568, 190072 |
| 33 | AAX11535 | 33 | 30537 | 61041, 91545, 122049, 152553, 183057 | 7049 | AEL89842 | 7049 | 37553 | 68057, 98561, 129065, 159569, 190073 |
| 34 | AAX11545 | 34 | 30538 | 61042, 91546, 122050, 152554, 183058 | 7050 | AEL89852 | 7050 | 37554 | 68058, 98562, 129066, 159570, 190074 |
| 35 | AAX11555 | 35 | 30539 | 61043, 91547, 122051, 152555, 183059 | 7051 | AEL93568 | 7051 | 37555 | 68059, 98563, 129067, 159571, 190075 |
| 36 | AAX11565 | 36 | 30540 | 61044, 91548, 122052, 152556, 183060 | 7052 | AEL93578 | 7052 | 37556 | 68060, 98564, 129068, 159572, 190076 |
| 37 | AAX11585 | 37 | 30541 | 61045, 91549, 122053, 152557, 183061 | 7053 | AEL93598 | 7053 | 37557 | 68061, 98565, 129069, 159573, 190077 |
| 38 | AAX11605 | 38 | 30542 | 61046, 91550, 122054, 152558, 183062 | 7054 | AEL93618 | 7054 | 37558 | 68062, 98566, 129070, 159574, 190078 |
| 39 | AAX11615 | 39 | 30543 | 61047, 91551, 122055, 152559, 183063 | 7055 | AEL93628 | 7055 | 37559 | 68063, 98567, 129071, 159575, 190079 |
| 40 | AAX11625 | 40 | 30544 | 61048, 91552, 122056, 152560, 183064 | 7056 | AEL93638 | 7056 | 37560 | 68064, 98568, 129072, 159576, 190080 |
| 41 | AAX12731 | 41 | 30545 | 61049, 91553, 122057, 152561, 183065 | 7057 | AEL94870 | 7057 | 37561 | 68065, 98569, 129073, 159577, 190081 |
| 42 | AAX12741 | 42 | 30546 | 61050, 91554, 122058, 152562, 183066 | 7058 | AEL95426 | 7058 | 37562 | 68066, 98570, 129074, 159578, 190082 |
| 43 | AAX12751 | 43 | 30547 | 61051, 91555, 122059, 152563, 183067 | 7059 | AEL97631 | 7059 | 37563 | 68067, 98571, 129075, 159579, 190083 |
| 44 | AAX12761 | 44 | 30548 | 61052, 91556, 122060, 152564, 183068 | 7060 | AEL99664 | 7060 | 37564 | 68068, 98572, 129076, 159580, 190084 |
| 45 | AAX12791 | 45 | 30549 | 61053, 91557, 122061, 152565, 183069 | 7061 | AEL99674 | 7061 | 37565 | 68069, 98573, 129077, 159581, 190085 |
| 46 | AAX12801 | 46 | 30550 | 61054, 91558, 122062, 152566, 183070 | 7062 | AEM53455 | 7062 | 37566 | 68070, 98574, 129078, 159582, 190086 |
| 47 | AAX12811 | 47 | 30551 | 61055, 91559, 122063, 152567, 183071 | 7063 | AEM53468 | 7063 | 37567 | 68071, 98575, 129079, 159583, 190087 |

FIG. 1 continued

| | | | | | | | | | |
|---|---|---|---|---|---|---|---|---|---|
| 48 | AAX34061 | 48 | 30552 | 61056, 91560, 122064, 152568, 183072 | 7064 | AEM60037 | 7064 | 37568 | 68072, 98576, 129080, 159584, 190088 |
| 49 | AAX35821 | 49 | 30553 | 61057, 91561, 122065, 152569, 183073 | 7065 | AEM60058 | 7065 | 37569 | 68073, 98577, 129081, 159585, 190089 |
| 50 | AAX35831 | 50 | 30554 | 61058, 91562, 122066, 152570, 183074 | 7066 | AEM60069 | 7066 | 37570 | 68074, 98578, 129082, 159586, 190090 |
| 51 | AAX35851 | 51 | 30555 | 61059, 91563, 122067, 152571, 183075 | 7067 | AEM92308 | 7067 | 37571 | 68075, 98579, 129083, 159587, 190091 |
| 52 | AAX35861 | 52 | 30556 | 61060, 91564, 122068, 152572, 183076 | 7068 | AEM92318 | 7068 | 37572 | 68076, 98580, 129084, 159588, 190092 |
| 53 | AAX35871 | 53 | 30557 | 61061, 91565, 122069, 152573, 183077 | 7069 | AEM92328 | 7069 | 37573 | 68077, 98581, 129085, 159589, 190093 |
| 54 | AAX38237 | 54 | 30558 | 61062, 91566, 122070, 152574, 183078 | 7070 | AEM92348 | 7070 | 37574 | 68078, 98582, 129086, 159590, 190094 |
| 55 | AAX47515 | 55 | 30559 | 61063, 91567, 122071, 152575, 183079 | 7071 | AEM92358 | 7071 | 37575 | 68079, 98583, 129087, 159591, 190095 |
| 56 | AAX47525 | 56 | 30560 | 61064, 91568, 122072, 152576, 183080 | 7072 | AEM92368 | 7072 | 37576 | 68080, 98584, 129088, 159592, 190096 |
| 57 | AAX47535 | 57 | 30561 | 61065, 91569, 122073, 152577, 183081 | 7073 | AEM92378 | 7073 | 37577 | 68081, 98585, 129089, 159593, 190097 |
| 58 | AAX56380 | 58 | 30562 | 61066, 91570, 122074, 152578, 183082 | 7074 | AEM92407 | 7074 | 37578 | 68082, 98586, 129090, 159594, 190098 |
| 59 | AAX56390 | 59 | 30563 | 61067, 91571, 122075, 152579, 183083 | 7075 | AEM92417 | 7075 | 37579 | 68083, 98587, 129091, 159595, 190099 |
| 60 | AAX56400 | 60 | 30564 | 61068, 91572, 122076, 152580, 183084 | 7076 | AEM92428 | 7076 | 37580 | 68084, 98588, 129092, 159596, 190100 |
| 61 | AAX56410 | 61 | 30565 | 61069, 91573, 122077, 152581, 183085 | 7077 | AEM92438 | 7077 | 37581 | 68085, 98589, 129093, 159597, 190101 |
| 62 | AAX56420 | 62 | 30566 | 61070, 91574, 122078, 152582, 183086 | 7078 | AEM92448 | 7078 | 37582 | 68086, 98590, 129094, 159598, 190102 |
| 63 | AAX56430 | 63 | 30567 | 61071, 91575, 122079, 152583, 183087 | 7079 | AEM92458 | 7079 | 37583 | 68087, 98591, 129095, 159599, 190103 |
| 64 | AAX56440 | 64 | 30568 | 61072, 91576, 122080, 152584, 183088 | 7080 | AEM92468 | 7080 | 37584 | 68088, 98592, 129096, 159600, 190104 |
| 65 | AAX56450 | 65 | 30569 | 61073, 91577, 122081, 152585, 183089 | 7081 | AEM92478 | 7081 | 37585 | 68089, 98593, 129097, 159601, 190105 |

FIG. 1 continued

| | | | | | | | | | |
|---|---|---|---|---|---|---|---|---|---|
| 66 | AAX56460 | 66 | 30570 | 61074, 91578, 122082, 152586, 183090 | 7082 | AEM92498 | 7082 | 37586 | 68090, 98594, 129098, 159602, 190106 |
| 67 | AAX56470 | 67 | 30571 | 61075, 91579, 122083, 152587, 183091 | 7083 | AEM92518 | 7083 | 37587 | 68091, 98595, 129099, 159603, 190107 |
| 68 | AAX56480 | 68 | 30572 | 61076, 91580, 122084, 152588, 183092 | 7084 | AEM92528 | 7084 | 37588 | 68092, 98596, 129100, 159604, 190108 |
| 69 | AAX56510 | 69 | 30573 | 61077, 91581, 122085, 152589, 183093 | 7085 | AEM92548 | 7085 | 37589 | 68093, 98597, 129101, 159605, 190109 |
| 70 | AAX56520 | 70 | 30574 | 61078, 91582, 122086, 152590, 183094 | 7086 | AEM92558 | 7086 | 37590 | 68094, 98598, 129102, 159606, 190110 |
| 71 | AAX56530 | 71 | 30575 | 61079, 91583, 122087, 152591, 183095 | 7087 | AEM92568 | 7087 | 37591 | 68095, 98599, 129103, 159607, 190111 |
| 72 | AAX56550 | 72 | 30576 | 61080, 91584, 122088, 152592, 183096 | 7088 | AEM92578 | 7088 | 37592 | 68096, 98600, 129104, 159608, 190112 |
| 73 | AAX56560 | 73 | 30577 | 61081, 91585, 122089, 152593, 183097 | 7089 | AEM92608 | 7089 | 37593 | 68097, 98601, 129105, 159609, 190113 |
| 74 | AAX56570 | 74 | 30578 | 61082, 91586, 122090, 152594, 183098 | 7090 | AEM92618 | 7090 | 37594 | 68098, 98602, 129106, 159610, 190114 |
| 75 | AAX56590 | 75 | 30579 | 61083, 91587, 122091, 152595, 183099 | 7091 | AEM92638 | 7091 | 37595 | 68099, 98603, 129107, 159611, 190115 |
| 76 | AAX56600 | 76 | 30580 | 61084, 91588, 122092, 152596, 183100 | 7092 | AEM92648 | 7092 | 37596 | 68100, 98604, 129108, 159612, 190116 |
| 77 | AAX57644 | 77 | 30581 | 61085, 91589, 122093, 152597, 183101 | 7093 | AEM98407 | 7093 | 37597 | 68101, 98605, 129109, 159613, 190117 |
| 78 | AAX57654 | 78 | 30582 | 61086, 91590, 122094, 152598, 183102 | 7094 | AEM98418 | 7094 | 37598 | 68102, 98606, 129110, 159614, 190118 |
| 79 | AAX57664 | 79 | 30583 | 61087, 91591, 122095, 152599, 183103 | 7095 | AEM98429 | 7095 | 37599 | 68103, 98607, 129111, 159615, 190119 |
| 80 | AAX57684 | 80 | 30584 | 61088, 91592, 122096, 152600, 183104 | 7096 | AEN55398 | 7096 | 37600 | 68104, 98608, 129112, 159616, 190120 |
| 81 | AAX57694 | 81 | 30585 | 61089, 91593, 122097, 152601, 183105 | 7097 | AEN55408 | 7097 | 37601 | 68105, 98609, 129113, 159617, 190121 |
| 82 | AAX57704 | 82 | 30586 | 61090, 91594, 122098, 152602, 183106 | 7098 | AEN55418 | 7098 | 37602 | 68106, 98610, 129114, 159618, 190122 |
| 83 | AAX57714 | 83 | 30587 | 61091, 91595, 122099, 152603, 183107 | 7099 | AEN55463 | 7099 | 37603 | 68107, 98611, 129115, 159619, 190123 |

FIG. 1 continued

| | | | | | | | | | |
|---|---|---|---|---|---|---|---|---|---|
| 84 | AAX57733 | 84 | 30588 | 61092, 91596, 122100, 152604, 183108 | 7100 | AEN55473 | 7100 | 37604 | 68108, 98612, 129116, 159620, 190124 |
| 85 | AAX57734 | 85 | 30589 | 61093, 91597, 122101, 152605, 183109 | 7101 | AEN55483 | 7101 | 37605 | 68109, 98613, 129117, 159621, 190125 |
| 86 | AAX57744 | 86 | 30590 | 61094, 91598, 122102, 152606, 183110 | 7102 | AEN55493 | 7102 | 37606 | 68110, 98614, 129118, 159622, 190126 |
| 87 | AAX57764 | 87 | 30591 | 61095, 91599, 122103, 152607, 183111 | 7103 | AEN55503 | 7103 | 37607 | 68111, 98615, 129119, 159623, 190127 |
| 88 | AAX57774 | 88 | 30592 | 61096, 91600, 122104, 152608, 183112 | 7104 | AEN55513 | 7104 | 37608 | 68112, 98616, 129120, 159624, 190128 |
| 89 | AAX57784 | 89 | 30593 | 61097, 91601, 122105, 152609, 183113 | 7105 | AEN55523 | 7105 | 37609 | 68113, 98617, 129121, 159625, 190129 |
| 90 | AAX57794 | 90 | 30594 | 61098, 91602, 122106, 152610, 183114 | 7106 | AEN68904 | 7106 | 37610 | 68114, 98618, 129122, 159626, 190130 |
| 91 | AAX57814 | 91 | 30595 | 61099, 91603, 122107, 152611, 183115 | 7107 | AEN68905 | 7107 | 37611 | 68115, 98619, 129123, 159627, 190131 |
| 92 | AAX57824 | 92 | 30596 | 61100, 91604, 122108, 152612, 183116 | 7108 | AEN68906 | 7108 | 37612 | 68116, 98620, 129124, 159628, 190132 |
| 93 | AAX57834 | 93 | 30597 | 61101, 91605, 122109, 152613, 183117 | 7109 | AEN68907 | 7109 | 37613 | 68117, 98621, 129125, 159629, 190133 |
| 94 | AAX57844 | 94 | 30598 | 61102, 91606, 122110, 152614, 183118 | 7110 | AEN68908 | 7110 | 37614 | 68118, 98622, 129126, 159630, 190134 |
| 95 | AAX57864 | 95 | 30599 | 61103, 91607, 122111, 152615, 183119 | 7111 | AEN68909 | 7111 | 37615 | 68119, 98623, 129127, 159631, 190135 |
| 96 | AAX57874 | 96 | 30600 | 61104, 91608, 122112, 152616, 183120 | 7112 | AEN68910 | 7112 | 37616 | 68120, 98624, 129128, 159632, 190136 |
| 97 | AAX57884 | 97 | 30601 | 61105, 91609, 122113, 152617, 183121 | 7113 | AEN68911 | 7113 | 37617 | 68121, 98625, 129129, 159633, 190137 |
| 98 | AAX57894 | 98 | 30602 | 61106, 91610, 122114, 152618, 183122 | 7114 | AEN68912 | 7114 | 37618 | 68122, 98626, 129130, 159634, 190138 |
| 99 | AAX57924 | 99 | 30603 | 61107, 91611, 122115, 152619, 183123 | 7115 | AEN68913 | 7115 | 37619 | 68123, 98627, 129131, 159635, 190139 |
| 100 | AAX57934 | 100 | 30604 | 61108, 91612, 122116, 152620, 183124 | 7116 | AEN68914 | 7116 | 37620 | 68124, 98628, 129132, 159636, 190140 |
| 101 | AAX57944 | 101 | 30605 | 61109, 91613, 122117, 152621, 183125 | 7117 | AEN68915 | 7117 | 37621 | 68125, 98629, 129133, 159637, 190141 |

FIG. 1 continued

| | | | | | | | | | |
|---|---|---|---|---|---|---|---|---|---|
| 102 | AAX76623 | 102 | 30606 | 61110, 91614, 122118, 152622, 183126 | 7118 | AEN68916 | 7118 | 37622 | 68126, 98630, 129134, 159638, 190142 |
| 103 | AAX76643 | 103 | 30607 | 61111, 91615, 122119, 152623, 183127 | 7119 | AEN68917 | 7119 | 37623 | 68127, 98631, 129135, 159639, 190143 |
| 104 | AAX76653 | 104 | 30608 | 61112, 91616, 122120, 152624, 183128 | 7120 | AEN68918 | 7120 | 37624 | 68128, 98632, 129136, 159640, 190144 |
| 105 | AAX76663 | 105 | 30609 | 61113, 91617, 122121, 152625, 183129 | 7121 | AEN68919 | 7121 | 37625 | 68129, 98633, 129137, 159641, 190145 |
| 106 | AAX76673 | 106 | 30610 | 61114, 91618, 122122, 152626, 183130 | 7122 | AEN68920 | 7122 | 37626 | 68130, 98634, 129138, 159642, 190146 |
| 107 | AAX76683 | 107 | 30611 | 61115, 91619, 122123, 152627, 183131 | 7123 | AEN68921 | 7123 | 37627 | 68131, 98635, 129139, 159643, 190147 |
| 108 | AAX76713 | 108 | 30612 | 61116, 91620, 122124, 152628, 183132 | 7124 | AEN68922 | 7124 | 37628 | 68132, 98636, 129140, 159644, 190148 |
| 109 | AAX76723 | 109 | 30613 | 61117, 91621, 122125, 152629, 183133 | 7125 | AEN68923 | 7125 | 37629 | 68133, 98637, 129141, 159645, 190149 |
| 110 | AAX76733 | 110 | 30614 | 61118, 91622, 122126, 152630, 183134 | 7126 | AEN68924 | 7126 | 37630 | 68134, 98638, 129142, 159646, 190150 |
| 111 | AAX76743 | 111 | 30615 | 61119, 91623, 122127, 152631, 183135 | 7127 | AEN68925 | 7127 | 37631 | 68135, 98639, 129143, 159647, 190151 |
| 112 | AAX76763 | 112 | 30616 | 61120, 91624, 122128, 152632, 183136 | 7128 | AEN68926 | 7128 | 37632 | 68136, 98640, 129144, 159648, 190152 |
| 113 | AAY18086 | 113 | 30617 | 61121, 91625, 122129, 152633, 183137 | 7129 | AEN68927 | 7129 | 37633 | 68137, 98641, 129145, 159649, 190153 |
| 114 | AAY18096 | 114 | 30618 | 61122, 91626, 122130, 152634, 183138 | 7130 | AEN68928 | 7130 | 37634 | 68138, 98642, 129146, 159650, 190154 |
| 115 | AAY18106 | 115 | 30619 | 61123, 91627, 122131, 152635, 183139 | 7131 | AEN68929 | 7131 | 37635 | 68139, 98643, 129147, 159651, 190155 |
| 116 | AAY18116 | 116 | 30620 | 61124, 91628, 122132, 152636, 183140 | 7132 | AEN68930 | 7132 | 37636 | 68140, 98644, 129148, 159652, 190156 |
| 117 | AAY18126 | 117 | 30621 | 61125, 91629, 122133, 152637, 183141 | 7133 | AEN68931 | 7133 | 37637 | 68141, 98645, 129149, 159653, 190157 |
| 118 | AAY18136 | 118 | 30622 | 61126, 91630, 122134, 152638, 183142 | 7134 | AEN68932 | 7134 | 37638 | 68142, 98646, 129150, 159654, 190158 |
| 119 | AAY18156 | 119 | 30623 | 61127, 91631, 122135, 152639, 183143 | 7135 | AEN69426 | 7135 | 37639 | 68143, 98647, 129151, 159655, 190159 |

FIG. 1 continued

| | | | | | | | | | |
|---|---|---|---|---|---|---|---|---|---|
| 120 | AAY18176 | 120 | 30624 | 61128, 91632, 122136, 152640, 183144 | 7136 | AEN69475 | 7136 | 37640 | 68144, 98648, 129152, 159656, 190160 |
| 121 | AAY18186 | 121 | 30625 | 61129, 91633, 122137, 152641, 183145 | 7137 | AEN69481 | 7137 | 37641 | 68145, 98649, 129153, 159657, 190161 |
| 122 | AAY18564 | 122 | 30626 | 61130, 91634, 122138, 152642, 183146 | 7138 | AEO01032 | 7138 | 37642 | 68146, 98650, 129154, 159658, 190162 |
| 123 | AAY18585 | 123 | 30627 | 61131, 91635, 122139, 152643, 183147 | 7139 | AEO01033 | 7139 | 37643 | 68147, 98651, 129155, 159659, 190163 |
| 124 | AAY18611 | 124 | 30628 | 61132, 91636, 122140, 152644, 183148 | 7140 | AEO01034 | 7140 | 37644 | 68148, 98652, 129156, 159660, 190164 |
| 125 | AAY27843 | 125 | 30629 | 61133, 91637, 122141, 152645, 183149 | 7141 | AEO01035 | 7141 | 37645 | 68149, 98653, 129157, 159661, 190165 |
| 126 | AAY27853 | 126 | 30630 | 61134, 91638, 122142, 152646, 183150 | 7142 | AEO01036 | 7142 | 37646 | 68150, 98654, 129158, 159662, 190166 |
| 127 | AAY27863 | 127 | 30631 | 61135, 91639, 122143, 152647, 183151 | 7143 | AEO01037 | 7143 | 37647 | 68151, 98655, 129159, 159663, 190167 |
| 128 | AAY27959 | 128 | 30632 | 61136, 91640, 122144, 152648, 183152 | 7144 | AEO01038 | 7144 | 37648 | 68152, 98656, 129160, 159664, 190168 |
| 129 | AAY27994 | 129 | 30633 | 61137, 91641, 122145, 152649, 183153 | 7145 | AEO01039 | 7145 | 37649 | 68153, 98657, 129161, 159665, 190169 |
| 130 | AAY28004 | 130 | 30634 | 61138, 91642, 122146, 152650, 183154 | 7146 | AEO01040 | 7146 | 37650 | 68154, 98658, 129162, 159666, 190170 |
| 131 | AAY28265 | 131 | 30635 | 61139, 91643, 122147, 152651, 183155 | 7147 | AEO01041 | 7147 | 37651 | 68155, 98659, 129163, 159667, 190171 |
| 132 | AAY28275 | 132 | 30636 | 61140, 91644, 122148, 152652, 183156 | 7148 | AEO01042 | 7148 | 37652 | 68156, 98660, 129164, 159668, 190172 |
| 133 | AAY28285 | 133 | 30637 | 61141, 91645, 122149, 152653, 183157 | 7149 | AEO01043 | 7149 | 37653 | 68157, 98661, 129165, 159669, 190173 |
| 134 | AAY28295 | 134 | 30638 | 61142, 91646, 122150, 152654, 183158 | 7150 | AEO01044 | 7150 | 37654 | 68158, 98662, 129166, 159670, 190174 |
| 135 | AAY28305 | 135 | 30639 | 61143, 91647, 122151, 152655, 183159 | 7151 | AEO01045 | 7151 | 37655 | 68159, 98663, 129167, 159671, 190175 |
| 136 | AAY28325 | 136 | 30640 | 61144, 91648, 122152, 152656, 183160 | 7152 | AEO01046 | 7152 | 37656 | 68160, 98664, 129168, 159672, 190176 |
| 137 | AAY28335 | 137 | 30641 | 61145, 91649, 122153, 152657, 183161 | 7153 | AEO01047 | 7153 | 37657 | 68161, 98665, 129169, 159673, 190177 |

FIG. 1 continued

| | | | | | | | | | |
|---|---|---|---|---|---|---|---|---|---|
| 138 | AAY28345 | 138 | 30642 | 61146, 91650, 122154, 152658, 183162 | 7154 | AE001048 | 7154 | 37658 | 68162, 98666, 129170, 159674, 190178 |
| 139 | AAY28355 | 139 | 30643 | 61147, 91651, 122155, 152659, 183163 | 7155 | AE001049 | 7155 | 37659 | 68163, 98667, 129171, 159675, 190179 |
| 140 | AAY28363 | 140 | 30644 | 61148, 91652, 122156, 152660, 183164 | 7156 | AE001050 | 7156 | 37660 | 68164, 98668, 129172, 159676, 190180 |
| 141 | AAY28375 | 141 | 30645 | 61149, 91653, 122157, 152661, 183165 | 7157 | AE001051 | 7157 | 37661 | 68165, 98669, 129173, 159677, 190181 |
| 142 | AAY28385 | 142 | 30646 | 61150, 91654, 122158, 152662, 183166 | 7158 | AE001052 | 7158 | 37662 | 68166, 98670, 129174, 159678, 190182 |
| 143 | AAY28395 | 143 | 30647 | 61151, 91655, 122159, 152663, 183167 | 7159 | AE001053 | 7159 | 37663 | 68167, 98671, 129175, 159679, 190183 |
| 144 | AAY28405 | 144 | 30648 | 61152, 91656, 122160, 152664, 183168 | 7160 | AE001054 | 7160 | 37664 | 68168, 98672, 129176, 159680, 190184 |
| 145 | AAY28486 | 145 | 30649 | 61153, 91657, 122161, 152665, 183169 | 7161 | AE001055 | 7161 | 37665 | 68169, 98673, 129177, 159681, 190185 |
| 146 | AAY28521 | 146 | 30650 | 61154, 91658, 122162, 152666, 183170 | 7162 | AE001056 | 7162 | 37666 | 68170, 98674, 129178, 159682, 190186 |
| 147 | AAY28531 | 147 | 30651 | 61155, 91659, 122163, 152667, 183171 | 7163 | AE001057 | 7163 | 37667 | 68171, 98675, 129179, 159683, 190187 |
| 148 | AAY28541 | 148 | 30652 | 61156, 91660, 122164, 152668, 183172 | 7164 | AE001058 | 7164 | 37668 | 68172, 98676, 129180, 159684, 190188 |
| 149 | AAY28551 | 149 | 30653 | 61157, 91661, 122165, 152669, 183173 | 7165 | AE001059 | 7165 | 37669 | 68173, 98677, 129181, 159685, 190189 |
| 150 | AAY28561 | 150 | 30654 | 61158, 91662, 122166, 152670, 183174 | 7166 | AE001060 | 7166 | 37670 | 68174, 98678, 129182, 159686, 190190 |
| 151 | AAY28581 | 151 | 30655 | 61159, 91663, 122167, 152671, 183175 | 7167 | AE001061 | 7167 | 37671 | 68175, 98679, 129183, 159687, 190191 |
| 152 | AAY28591 | 152 | 30656 | 61160, 91664, 122168, 152672, 183176 | 7168 | AE001062 | 7168 | 37672 | 68176, 98680, 129184, 159688, 190192 |
| 153 | AAY28608 | 153 | 30657 | 61161, 91665, 122169, 152673, 183177 | 7169 | AE001063 | 7169 | 37673 | 68177, 98681, 129185, 159689, 190193 |
| 154 | AAY28618 | 154 | 30658 | 61162, 91666, 122170, 152674, 183178 | 7170 | AE001064 | 7170 | 37674 | 68178, 98682, 129186, 159690, 190194 |
| 155 | AAY28638 | 155 | 30659 | 61163, 91667, 122171, 152675, 183179 | 7171 | AE001065 | 7171 | 37675 | 68179, 98683, 129187, 159691, 190195 |

FIG. 1 continued

| | | | | | | | | | |
|---|---|---|---|---|---|---|---|---|---|
| 156 | AAY28648 | 156 | 30660 | 61164, 91668, 122172, 152676, 183180 | 7172 | AE001066 | 7172 | 37676 | 68180, 98684, 129188, 159692, 190196 |
| 157 | AAY44610 | 157 | 30661 | 61165, 91669, 122173, 152677, 183181 | 7173 | AE001067 | 7173 | 37677 | 68181, 98685, 129189, 159693, 190197 |
| 158 | AAY44620 | 158 | 30662 | 61166, 91670, 122174, 152678, 183182 | 7174 | AE001068 | 7174 | 37678 | 68182, 98686, 129190, 159694, 190198 |
| 159 | AAY44621 | 159 | 30663 | 61167, 91671, 122175, 152679, 183183 | 7175 | AE001069 | 7175 | 37679 | 68183, 98687, 129191, 159695, 190199 |
| 160 | AAY44631 | 160 | 30664 | 61168, 91672, 122176, 152680, 183184 | 7176 | AE001070 | 7176 | 37680 | 68184, 98688, 129192, 159696, 190200 |
| 161 | AAY44641 | 161 | 30665 | 61169, 91673, 122177, 152681, 183185 | 7177 | AE001071 | 7177 | 37681 | 68185, 98689, 129193, 159697, 190201 |
| 162 | AAY44651 | 162 | 30666 | 61170, 91674, 122178, 152682, 183186 | 7178 | AE001073 | 7178 | 37682 | 68186, 98690, 129194, 159698, 190202 |
| 163 | AAY44755 | 163 | 30667 | 61171, 91675, 122179, 152683, 183187 | 7179 | AE001074 | 7179 | 37683 | 68187, 98691, 129195, 159699, 190203 |
| 164 | AAY44775 | 164 | 30668 | 61172, 91676, 122180, 152684, 183188 | 7180 | AE001075 | 7180 | 37684 | 68188, 98692, 129196, 159700, 190204 |
| 165 | AAY44785 | 165 | 30669 | 61173, 91677, 122181, 152685, 183189 | 7181 | AE001076 | 7181 | 37685 | 68189, 98693, 129197, 159701, 190205 |
| 166 | AAY44795 | 166 | 30670 | 61174, 91678, 122182, 152686, 183190 | 7182 | AE001077 | 7182 | 37686 | 68190, 98694, 129198, 159702, 190206 |
| 167 | AAY44796 | 167 | 30671 | 61175, 91679, 122183, 152687, 183191 | 7183 | AE001078 | 7183 | 37687 | 68191, 98695, 129199, 159703, 190207 |
| 168 | AAY44896 | 168 | 30672 | 61176, 91680, 122184, 152688, 183192 | 7184 | AE001079 | 7184 | 37688 | 68192, 98696, 129200, 159704, 190208 |
| 169 | AAY44906 | 169 | 30673 | 61177, 91681, 122185, 152689, 183193 | 7185 | AE001080 | 7185 | 37689 | 68193, 98697, 129201, 159705, 190209 |
| 170 | AAY46371 | 170 | 30674 | 61178, 91682, 122186, 152690, 183194 | 7186 | AE001081 | 7186 | 37690 | 68194, 98698, 129202, 159706, 190210 |
| 171 | AAY46381 | 171 | 30675 | 61179, 91683, 122187, 152691, 183195 | 7187 | AE001082 | 7187 | 37691 | 68195, 98699, 129203, 159707, 190211 |
| 172 | AAY46391 | 172 | 30676 | 61180, 91684, 122188, 152692, 183196 | 7188 | AE001083 | 7188 | 37692 | 68196, 98700, 129204, 159708, 190212 |
| 173 | AAY46426 | 173 | 30677 | 61181, 91685, 122189, 152693, 183197 | 7189 | AE001084 | 7189 | 37693 | 68197, 98701, 129205, 159709, 190213 |

FIG. 1 continued

| | | | | | | | | | |
|---|---|---|---|---|---|---|---|---|---|
| 174 | AAY47013 | 174 | 30678 | 61182, 91686, 122190, 152694, 183198 | 7190 | AE001085 | 7190 | 37694 | 68198, 98702, 129206, 159710, 190214 |
| 175 | AAY47023 | 175 | 30679 | 61183, 91687, 122191, 152695, 183199 | 7191 | AE001086 | 7191 | 37695 | 68199, 98703, 129207, 159711, 190215 |
| 176 | AAY47052 | 176 | 30680 | 61184, 91688, 122192, 152696, 183200 | 7192 | AE001087 | 7192 | 37696 | 68200, 98704, 129208, 159712, 190216 |
| 177 | AAY47075 | 177 | 30681 | 61185, 91689, 122193, 152697, 183201 | 7193 | AE001088 | 7193 | 37697 | 68201, 98705, 129209, 159713, 190217 |
| 178 | AAY47085 | 178 | 30682 | 61186, 91690, 122194, 152698, 183202 | 7194 | AE001089 | 7194 | 37698 | 68202, 98706, 129210, 159714, 190218 |
| 179 | AAY58320 | 179 | 30683 | 61187, 91691, 122195, 152699, 183203 | 7195 | AE001090 | 7195 | 37699 | 68203, 98707, 129211, 159715, 190219 |
| 180 | AAY59035 | 180 | 30684 | 61188, 91692, 122196, 152700, 183204 | 7196 | AE001091 | 7196 | 37700 | 68204, 98708, 129212, 159716, 190220 |
| 181 | AAY64202 | 181 | 30685 | 61189, 91693, 122197, 152701, 183205 | 7197 | AE001092 | 7197 | 37701 | 68205, 98709, 129213, 159717, 190221 |
| 182 | AAY64212 | 182 | 30686 | 61190, 91694, 122198, 152702, 183206 | 7198 | AE001093 | 7198 | 37702 | 68206, 98710, 129214, 159718, 190222 |
| 183 | AAY64222 | 183 | 30687 | 61191, 91695, 122199, 152703, 183207 | 7199 | AE001094 | 7199 | 37703 | 68207, 98711, 129215, 159719, 190223 |
| 184 | AAY64262 | 184 | 30688 | 61192, 91696, 122200, 152704, 183208 | 7200 | AE001095 | 7200 | 37704 | 68208, 98712, 129216, 159720, 190224 |
| 185 | AAY64272 | 185 | 30689 | 61193, 91697, 122201, 152705, 183209 | 7201 | AE001096 | 7201 | 37705 | 68209, 98713, 129217, 159721, 190225 |
| 186 | AAY64282 | 186 | 30690 | 61194, 91698, 122202, 152706, 183210 | 7202 | AE001097 | 7202 | 37706 | 68210, 98714, 129218, 159722, 190226 |
| 187 | AAY64292 | 187 | 30691 | 61195, 91699, 122203, 152707, 183211 | 7203 | AE001098 | 7203 | 37707 | 68211, 98715, 129219, 159723, 190227 |
| 188 | AAY64302 | 188 | 30692 | 61196, 91700, 122204, 152708, 183212 | 7204 | AE001099 | 7204 | 37708 | 68212, 98716, 129220, 159724, 190228 |
| 189 | AAY64312 | 189 | 30693 | 61197, 91701, 122205, 152709, 183213 | 7205 | AE001100 | 7205 | 37709 | 68213, 98717, 129221, 159725, 190229 |
| 190 | AAY64322 | 190 | 30694 | 61198, 91702, 122206, 152710, 183214 | 7206 | AE001101 | 7206 | 37710 | 68214, 98718, 129222, 159726, 190230 |
| 191 | AAY64332 | 191 | 30695 | 61199, 91703, 122207, 152711, 183215 | 7207 | AE001102 | 7207 | 37711 | 68215, 98719, 129223, 159727, 190231 |

FIG. 1 continued

| | | | | | | | | | |
|---|---|---|---|---|---|---|---|---|---|
| 192 | AAY64342 | 192 | 30696 | 61200, 91704, 122208, 152712, 183216 | 7208 | AE001103 | 7208 | 37712 | 68216, 98720, 129224, 159728, 190232 |
| 193 | AAY64352 | 193 | 30697 | 61201, 91705, 122209, 152713, 183217 | 7209 | AE001104 | 7209 | 37713 | 68217, 98721, 129225, 159729, 190233 |
| 194 | AAY64362 | 194 | 30698 | 61202, 91706, 122210, 152714, 183218 | 7210 | AE001105 | 7210 | 37714 | 68218, 98722, 129226, 159730, 190234 |
| 195 | AAY64382 | 195 | 30699 | 61203, 91707, 122211, 152715, 183219 | 7211 | AE001106 | 7211 | 37715 | 68219, 98723, 129227, 159731, 190235 |
| 196 | AAY64392 | 196 | 30700 | 61204, 91708, 122212, 152716, 183220 | 7212 | AE001107 | 7212 | 37716 | 68220, 98724, 129228, 159732, 190236 |
| 197 | AAY64402 | 197 | 30701 | 61205, 91709, 122213, 152717, 183221 | 7213 | AE001108 | 7213 | 37717 | 68221, 98725, 129229, 159733, 190237 |
| 198 | AAY98037 | 198 | 30702 | 61206, 91710, 122214, 152718, 183222 | 7214 | AE001109 | 7214 | 37718 | 68222, 98726, 129230, 159734, 190238 |
| 199 | AAY98047 | 199 | 30703 | 61207, 91711, 122215, 152719, 183223 | 7215 | AE001110 | 7215 | 37719 | 68223, 98727, 129231, 159735, 190239 |
| 200 | AAY98057 | 200 | 30704 | 61208, 91712, 122216, 152720, 183224 | 7216 | AE001111 | 7216 | 37720 | 68224, 98728, 129232, 159736, 190240 |
| 201 | AAY98067 | 201 | 30705 | 61209, 91713, 122217, 152721, 183225 | 7217 | AE001112 | 7217 | 37721 | 68225, 98729, 129233, 159737, 190241 |
| 202 | AAY98077 | 202 | 30706 | 61210, 91714, 122218, 152722, 183226 | 7218 | AE001113 | 7218 | 37722 | 68226, 98730, 129234, 159738, 190242 |
| 203 | AAY98087 | 203 | 30707 | 61211, 91715, 122219, 152723, 183227 | 7219 | AE001114 | 7219 | 37723 | 68227, 98731, 129235, 159739, 190243 |
| 204 | AAY98097 | 204 | 30708 | 61212, 91716, 122220, 152724, 183228 | 7220 | AE001115 | 7220 | 37724 | 68228, 98732, 129236, 159740, 190244 |
| 205 | AAY98107 | 205 | 30709 | 61213, 91717, 122221, 152725, 183229 | 7221 | AE001116 | 7221 | 37725 | 68229, 98733, 129237, 159741, 190245 |
| 206 | AAY98117 | 206 | 30710 | 61214, 91718, 122222, 152726, 183230 | 7222 | AE001117 | 7222 | 37726 | 68230, 98734, 129238, 159742, 190246 |
| 207 | AAY98147 | 207 | 30711 | 61215, 91719, 122223, 152727, 183231 | 7223 | AE001118 | 7223 | 37727 | 68231, 98735, 129239, 159743, 190247 |
| 208 | AAY98157 | 208 | 30712 | 61216, 91720, 122224, 152728, 183232 | 7224 | AE001119 | 7224 | 37728 | 68232, 98736, 129240, 159744, 190248 |
| 209 | AAY98167 | 209 | 30713 | 61217, 91721, 122225, 152729, 183233 | 7225 | AE001120 | 7225 | 37729 | 68233, 98737, 129241, 159745, 190249 |

FIG. 1 continued

| | | | | | | | | | |
|---|---|---|---|---|---|---|---|---|---|
| 210 | AAY98177 | 210 | 30714 | 61218, 91722, 122226, 152730, 183234 | 7226 | AE001121 | 7226 | 37730 | 68234, 98738, 129242, 159746, 190250 |
| 211 | AAY98195 | 211 | 30715 | 61219, 91723, 122227, 152731, 183235 | 7227 | AE001122 | 7227 | 37731 | 68235, 98739, 129243, 159747, 190251 |
| 212 | AAY98207 | 212 | 30716 | 61220, 91724, 122228, 152732, 183236 | 7228 | AE001123 | 7228 | 37732 | 68236, 98740, 129244, 159748, 190252 |
| 213 | AAY98217 | 213 | 30717 | 61221, 91725, 122229, 152733, 183237 | 7229 | AE001124 | 7229 | 37733 | 68237, 98741, 129245, 159749, 190253 |
| 214 | AAY98227 | 214 | 30718 | 61222, 91726, 122230, 152734, 183238 | 7230 | AE001125 | 7230 | 37734 | 68238, 98742, 129246, 159750, 190254 |
| 215 | AAY98237 | 215 | 30719 | 61223, 91727, 122231, 152735, 183239 | 7231 | AE001126 | 7231 | 37735 | 68239, 98743, 129247, 159751, 190255 |
| 216 | AAY98247 | 216 | 30720 | 61224, 91728, 122232, 152736, 183240 | 7232 | AE001127 | 7232 | 37736 | 68240, 98744, 129248, 159752, 190256 |
| 217 | AAY98319 | 217 | 30721 | 61225, 91729, 122233, 152737, 183241 | 7233 | AE001128 | 7233 | 37737 | 68241, 98745, 129249, 159753, 190257 |
| 218 | AAY98329 | 218 | 30722 | 61226, 91730, 122234, 152738, 183242 | 7234 | AE001129 | 7234 | 37738 | 68242, 98746, 129250, 159754, 190258 |
| 219 | AAY98339 | 219 | 30723 | 61227, 91731, 122235, 152739, 183243 | 7235 | AE001130 | 7235 | 37739 | 68243, 98747, 129251, 159755, 190259 |
| 220 | AAY98353 | 220 | 30724 | 61228, 91732, 122236, 152740, 183244 | 7236 | AE001131 | 7236 | 37740 | 68244, 98748, 129252, 159756, 190260 |
| 221 | AAY98366 | 221 | 30725 | 61229, 91733, 122237, 152741, 183245 | 7237 | AE001132 | 7237 | 37741 | 68245, 98749, 129253, 159757, 190261 |
| 222 | AAY98376 | 222 | 30726 | 61230, 91734, 122238, 152742, 183246 | 7238 | AE001133 | 7238 | 37742 | 68246, 98750, 129254, 159758, 190262 |
| 223 | AAY98386 | 223 | 30727 | 61231, 91735, 122239, 152743, 183247 | 7239 | AE001134 | 7239 | 37743 | 68247, 98751, 129255, 159759, 190263 |
| 224 | AAY98396 | 224 | 30728 | 61232, 91736, 122240, 152744, 183248 | 7240 | AE001135 | 7240 | 37744 | 68248, 98752, 129256, 159760, 190264 |
| 225 | AAY98406 | 225 | 30729 | 61233, 91737, 122241, 152745, 183249 | 7241 | AE001136 | 7241 | 37745 | 68249, 98753, 129257, 159761, 190265 |
| 226 | AAZ32946 | 226 | 30730 | 61234, 91738, 122242, 152746, 183250 | 7242 | AE001137 | 7242 | 37746 | 68250, 98754, 129258, 159762, 190266 |
| 227 | AAZ32949 | 227 | 30731 | 61235, 91739, 122243, 152747, 183251 | 7243 | AE001138 | 7243 | 37747 | 68251, 98755, 129259, 159763, 190267 |

FIG. 1 continued

| | | | | | | | | | |
|---|---|---|---|---|---|---|---|---|---|
| 228 | AAZ32950 | 228 | 30732 | 61236, 91740, 122244, 152748, 183252 | 7244 | AEO01139 | 7244 | 37748 | 68252, 98756, 129260, 159764, 190268 |
| 229 | AAZ32951 | 229 | 30733 | 61237, 91741, 122245, 152749, 183253 | 7245 | AEO01140 | 7245 | 37749 | 68253, 98757, 129261, 159765, 190269 |
| 230 | AAZ32952 | 230 | 30734 | 61238, 91742, 122246, 152750, 183254 | 7246 | AEO01141 | 7246 | 37750 | 68254, 98758, 129262, 159766, 190270 |
| 231 | AAZ32953 | 231 | 30735 | 61239, 91743, 122247, 152751, 183255 | 7247 | AEO01142 | 7247 | 37751 | 68255, 98759, 129263, 159767, 190271 |
| 232 | AAZ38462 | 232 | 30736 | 61240, 91744, 122248, 152752, 183256 | 7248 | AEO01144 | 7248 | 37752 | 68256, 98760, 129264, 159768, 190272 |
| 233 | AAZ38473 | 233 | 30737 | 61241, 91745, 122249, 152753, 183257 | 7249 | AEO01145 | 7249 | 37753 | 68257, 98761, 129265, 159769, 190273 |
| 234 | AAZ38484 | 234 | 30738 | 61242, 91746, 122250, 152754, 183258 | 7250 | AEO01146 | 7250 | 37754 | 68258, 98762, 129266, 159770, 190274 |
| 235 | AAZ38495 | 235 | 30739 | 61243, 91747, 122251, 152755, 183259 | 7251 | AEO01147 | 7251 | 37755 | 68259, 98763, 129267, 159771, 190275 |
| 236 | AAZ38517 | 236 | 30740 | 61244, 91748, 122252, 152756, 183260 | 7252 | AEO01148 | 7252 | 37756 | 68260, 98764, 129268, 159772, 190276 |
| 237 | AAZ38539 | 237 | 30741 | 61245, 91749, 122253, 152757, 183261 | 7253 | AEO01149 | 7253 | 37757 | 68261, 98765, 129269, 159773, 190277 |
| 238 | AAZ38561 | 238 | 30742 | 61246, 91750, 122254, 152758, 183262 | 7254 | AEO01150 | 7254 | 37758 | 68262, 98766, 129270, 159774, 190278 |
| 239 | AAZ38583 | 239 | 30743 | 61247, 91751, 122255, 152759, 183263 | 7255 | AEO01151 | 7255 | 37759 | 68263, 98767, 129271, 159775, 190279 |
| 240 | AAZ38594 | 240 | 30744 | 61248, 91752, 122256, 152760, 183264 | 7256 | AEO01152 | 7256 | 37760 | 68264, 98768, 129272, 159776, 190280 |
| 241 | AAZ38605 | 241 | 30745 | 61249, 91753, 122257, 152761, 183265 | 7257 | AEO01153 | 7257 | 37761 | 68265, 98769, 129273, 159777, 190281 |
| 242 | AAZ38627 | 242 | 30746 | 61250, 91754, 122258, 152762, 183266 | 7258 | AEO01154 | 7258 | 37762 | 68266, 98770, 129274, 159778, 190282 |
| 243 | AAZ38638 | 243 | 30747 | 61251, 91755, 122259, 152763, 183267 | 7259 | AEO01155 | 7259 | 37763 | 68267, 98771, 129275, 159779, 190283 |
| 244 | AAZ38650 | 244 | 30748 | 61252, 91756, 122260, 152764, 183268 | 7260 | AEO01156 | 7260 | 37764 | 68268, 98772, 129276, 159780, 190284 |
| 245 | AAZ43370 | 245 | 30749 | 61253, 91757, 122261, 152765, 183269 | 7261 | AEO01157 | 7261 | 37765 | 68269, 98773, 129277, 159781, 190285 |

FIG. 1 continued

| | | | | | | | | | |
|---|---|---|---|---|---|---|---|---|---|
| 246 | AAZ43394 | 246 | 30750 | 61254, 91758, 122262, 152766, 183270 | 7262 | AE001158 | 7262 | 37766 | 68270, 98774, 129278, 159782, 190286 |
| 247 | AAZ43405 | 247 | 30751 | 61255, 91759, 122263, 152767, 183271 | 7263 | AE001159 | 7263 | 37767 | 68271, 98775, 129279, 159783, 190287 |
| 248 | AAZ74352 | 248 | 30752 | 61256, 91760, 122264, 152768, 183272 | 7264 | AE001160 | 7264 | 37768 | 68272, 98776, 129280, 159784, 190288 |
| 249 | AAZ74363 | 249 | 30753 | 61257, 91761, 122265, 152769, 183273 | 7265 | AE001161 | 7265 | 37769 | 68273, 98777, 129281, 159785, 190289 |
| 250 | AAZ74374 | 250 | 30754 | 61258, 91762, 122266, 152770, 183274 | 7266 | AE001162 | 7266 | 37770 | 68274, 98778, 129282, 159786, 190290 |
| 251 | AAZ74397 | 251 | 30755 | 61259, 91763, 122267, 152771, 183275 | 7267 | AE001163 | 7267 | 37771 | 68275, 98779, 129283, 159787, 190291 |
| 252 | AAZ74408 | 252 | 30756 | 61260, 91764, 122268, 152772, 183276 | 7268 | AE001164 | 7268 | 37772 | 68276, 98780, 129284, 159788, 190292 |
| 253 | AAZ74430 | 253 | 30757 | 61261, 91765, 122269, 152773, 183277 | 7269 | AE001165 | 7269 | 37773 | 68277, 98781, 129285, 159789, 190293 |
| 254 | AAZ74441 | 254 | 30758 | 61262, 91766, 122270, 152774, 183278 | 7270 | AE001166 | 7270 | 37774 | 68278, 98782, 129286, 159790, 190294 |
| 255 | AAZ74452 | 255 | 30759 | 61263, 91767, 122271, 152775, 183279 | 7271 | AE001167 | 7271 | 37775 | 68279, 98783, 129287, 159791, 190295 |
| 256 | AAZ74463 | 256 | 30760 | 61264, 91768, 122272, 152776, 183280 | 7272 | AE001168 | 7272 | 37776 | 68280, 98784, 129288, 159792, 190296 |
| 257 | AAZ74474 | 257 | 30761 | 61265, 91769, 122273, 152777, 183281 | 7273 | AE001169 | 7273 | 37777 | 68281, 98785, 129289, 159793, 190297 |
| 258 | AAZ74485 | 258 | 30762 | 61266, 91770, 122274, 152778, 183282 | 7274 | AE001170 | 7274 | 37778 | 68282, 98786, 129290, 159794, 190298 |
| 259 | AAZ74496 | 259 | 30763 | 61267, 91771, 122275, 152779, 183283 | 7275 | AE001171 | 7275 | 37779 | 68283, 98787, 129291, 159795, 190299 |
| 260 | AAZ74507 | 260 | 30764 | 61268, 91772, 122276, 152780, 183284 | 7276 | AE001172 | 7276 | 37780 | 68284, 98788, 129292, 159796, 190300 |
| 261 | AAZ74518 | 261 | 30765 | 61269, 91773, 122277, 152781, 183285 | 7277 | AE001173 | 7277 | 37781 | 68285, 98789, 129293, 159797, 190301 |
| 262 | AAZ74529 | 262 | 30766 | 61270, 91774, 122278, 152782, 183286 | 7278 | AE001174 | 7278 | 37782 | 68286, 98790, 129294, 159798, 190302 |
| 263 | AAZ74551 | 263 | 30767 | 61271, 91775, 122279, 152783, 183287 | 7279 | AE001176 | 7279 | 37783 | 68287, 98791, 129295, 159799, 190303 |

FIG. 1 continued

| | | | | | | | | | |
|---|---|---|---|---|---|---|---|---|---|
| 264 | AAZ74562 | 264 | 30768 | 61272, 91776, 122280, 152784, 183288 | 7280 | AED01177 | 7280 | 37784 | 68288, 98792, 129296, 159800, 190304 |
| 265 | AAZ74573 | 265 | 30769 | 61273, 91777, 122281, 152785, 183289 | 7281 | AED01179 | 7281 | 37785 | 68289, 98793, 129297, 159801, 190305 |
| 266 | AAZ74584 | 266 | 30770 | 61274, 91778, 122282, 152786, 183290 | 7282 | AED01180 | 7282 | 37786 | 68290, 98794, 129298, 159802, 190306 |
| 267 | AAZ74595 | 267 | 30771 | 61275, 91779, 122283, 152787, 183291 | 7283 | AED01181 | 7283 | 37787 | 68291, 98795, 129299, 159803, 190307 |
| 268 | AAZ74617 | 268 | 30772 | 61276, 91780, 122284, 152788, 183292 | 7284 | AED01182 | 7284 | 37788 | 68292, 98796, 129300, 159804, 190308 |
| 269 | AAZ79505 | 269 | 30773 | 61277, 91781, 122285, 152789, 183293 | 7285 | AED01183 | 7285 | 37789 | 68293, 98797, 129301, 159805, 190309 |
| 270 | AAZ79516 | 270 | 30774 | 61278, 91782, 122286, 152790, 183294 | 7286 | AED01184 | 7286 | 37790 | 68294, 98798, 129302, 159806, 190310 |
| 271 | AAZ79527 | 271 | 30775 | 61279, 91783, 122287, 152791, 183295 | 7287 | AED01185 | 7287 | 37791 | 68295, 98799, 129303, 159807, 190311 |
| 272 | AAZ79549 | 272 | 30776 | 61280, 91784, 122288, 152792, 183296 | 7288 | AED01186 | 7288 | 37792 | 68296, 98800, 129304, 159808, 190312 |
| 273 | AAZ79560 | 273 | 30777 | 61281, 91785, 122289, 152793, 183297 | 7289 | AED01187 | 7289 | 37793 | 68297, 98801, 129305, 159809, 190313 |
| 274 | AAZ79571 | 274 | 30778 | 61282, 91786, 122290, 152794, 183298 | 7290 | AED01188 | 7290 | 37794 | 68298, 98802, 129306, 159810, 190314 |
| 275 | AAZ79582 | 275 | 30779 | 61283, 91787, 122291, 152795, 183299 | 7291 | AED01189 | 7291 | 37795 | 68299, 98803, 129307, 159811, 190315 |
| 276 | AAZ79604 | 276 | 30780 | 61284, 91788, 122292, 152796, 183300 | 7292 | AED01191 | 7292 | 37796 | 68300, 98804, 129308, 159812, 190316 |
| 277 | AAZ79615 | 277 | 30781 | 61285, 91789, 122293, 152797, 183301 | 7293 | AED01192 | 7293 | 37797 | 68301, 98805, 129309, 159813, 190317 |
| 278 | AAZ79627 | 278 | 30782 | 61286, 91790, 122294, 152798, 183302 | 7294 | AED01193 | 7294 | 37798 | 68302, 98806, 129310, 159814, 190318 |
| 279 | AAZ79941 | 279 | 30783 | 61287, 91791, 122295, 152799, 183303 | 7295 | AED01194 | 7295 | 37799 | 68303, 98807, 129311, 159815, 190319 |
| 280 | AAZ79944 | 280 | 30784 | 61288, 91792, 122296, 152800, 183304 | 7296 | AED01195 | 7296 | 37800 | 68304, 98808, 129312, 159816, 190320 |
| 281 | AAZ79963 | 281 | 30785 | 61289, 91793, 122297, 152801, 183305 | 7297 | AED01196 | 7297 | 37801 | 68305, 98809, 129313, 159817, 190321 |

FIG. 1 continued

| | | | | | | | | | |
|---|---|---|---|---|---|---|---|---|---|
| 282 | AAZ79974 | 282 | 30786 | 61290, 91794, 122298, 152802, 183306 | 7298 | AE001197 | 7298 | 37802 | 68306, 98810, 129314, 159818, 190322 |
| 283 | AAZ79996 | 283 | 30787 | 61291, 91795, 122299, 152803, 183307 | 7299 | AE001198 | 7299 | 37803 | 68307, 98811, 129315, 159819, 190323 |
| 284 | AAZ80007 | 284 | 30788 | 61292, 91796, 122300, 152804, 183308 | 7300 | AE001200 | 7300 | 37804 | 68308, 98812, 129316, 159820, 190324 |
| 285 | AAZ80017 | 285 | 30789 | 61293, 91797, 122301, 152805, 183309 | 7301 | AE001201 | 7301 | 37805 | 68309, 98813, 129317, 159821, 190325 |
| 286 | AAZ80030 | 286 | 30790 | 61294, 91798, 122302, 152806, 183310 | 7302 | AE001202 | 7302 | 37806 | 68310, 98814, 129318, 159822, 190326 |
| 287 | AAZ83242 | 287 | 30791 | 61295, 91799, 122303, 152807, 183311 | 7303 | AE001203 | 7303 | 37807 | 68311, 98815, 129319, 159823, 190327 |
| 288 | AAZ83266 | 288 | 30792 | 61296, 91800, 122304, 152808, 183312 | 7304 | AE001204 | 7304 | 37808 | 68312, 98816, 129320, 159824, 190328 |
| 289 | AAZ83277 | 289 | 30793 | 61297, 91801, 122305, 152809, 183313 | 7305 | AE001205 | 7305 | 37809 | 68313, 98817, 129321, 159825, 190329 |
| 290 | AAZ83288 | 290 | 30794 | 61298, 91802, 122306, 152810, 183314 | 7306 | AE001206 | 7306 | 37810 | 68314, 98818, 129322, 159826, 190330 |
| 291 | AAZ83312 | 291 | 30795 | 61299, 91803, 122307, 152811, 183315 | 7307 | AE001207 | 7307 | 37811 | 68315, 98819, 129323, 159827, 190331 |
| 292 | AAZ83323 | 292 | 30796 | 61300, 91804, 122308, 152812, 183316 | 7308 | AE001208 | 7308 | 37812 | 68316, 98820, 129324, 159828, 190332 |
| 293 | AAZ83371 | 293 | 30797 | 61301, 91805, 122309, 152813, 183317 | 7309 | AE001209 | 7309 | 37813 | 68317, 98821, 129325, 159829, 190333 |
| 294 | AAZ83688 | 294 | 30798 | 61302, 91806, 122310, 152814, 183318 | 7310 | AE001210 | 7310 | 37814 | 68318, 98822, 129326, 159830, 190334 |
| 295 | ABA06510 | 295 | 30799 | 61303, 91807, 122311, 152815, 183319 | 7311 | AE001211 | 7311 | 37815 | 68319, 98823, 129327, 159831, 190335 |
| 296 | ABA08464 | 296 | 30800 | 61304, 91808, 122312, 152816, 183320 | 7312 | AE001212 | 7312 | 37816 | 68320, 98824, 129328, 159832, 190336 |
| 297 | ABA08486 | 297 | 30801 | 61305, 91809, 122313, 152817, 183321 | 7313 | AE001213 | 7313 | 37817 | 68321, 98825, 129329, 159833, 190337 |
| 298 | ABA08508 | 298 | 30802 | 61306, 91810, 122314, 152818, 183322 | 7314 | AE001214 | 7314 | 37818 | 68322, 98826, 129330, 159834, 190338 |
| 299 | ABA12707 | 299 | 30803 | 61307, 91811, 122315, 152819, 183323 | 7315 | AE001215 | 7315 | 37819 | 68323, 98827, 129331, 159835, 190339 |

FIG. 1 continued

| | | | | | | | | | |
|---|---|---|---|---|---|---|---|---|---|
| 300 | ABA12715 | 300 | 30804 | 61308, 91812, 122316, 152820, 183324 | 7316 | AE001216 | 7316 | 37820 | 68324, 98828, 129332, 159836, 190340 |
| 301 | ABA12729 | 301 | 30805 | 61309, 91813, 122317, 152821, 183325 | 7317 | AE001217 | 7317 | 37821 | 68325, 98829, 129333, 159837, 190341 |
| 302 | ABA12740 | 302 | 30806 | 61310, 91814, 122318, 152822, 183326 | 7318 | AE001218 | 7318 | 37822 | 68326, 98830, 129334, 159838, 190342 |
| 303 | ABA12751 | 303 | 30807 | 61311, 91815, 122319, 152823, 183327 | 7319 | AE001219 | 7319 | 37823 | 68327, 98831, 129335, 159839, 190343 |
| 304 | ABA12762 | 304 | 30808 | 61312, 91816, 122320, 152824, 183328 | 7320 | AE001220 | 7320 | 37824 | 68328, 98832, 129336, 159840, 190344 |
| 305 | ABA12773 | 305 | 30809 | 61313, 91817, 122321, 152825, 183329 | 7321 | AE001221 | 7321 | 37825 | 68329, 98833, 129337, 159841, 190345 |
| 306 | ABA12780 | 306 | 30810 | 61314, 91818, 122322, 152826, 183330 | 7322 | AE001222 | 7322 | 37826 | 68330, 98834, 129338, 159842, 190346 |
| 307 | ABA16214 | 307 | 30811 | 61315, 91819, 122323, 152827, 183331 | 7323 | AE001223 | 7323 | 37827 | 68331, 98835, 129339, 159843, 190347 |
| 308 | ABA18026 | 308 | 30812 | 61316, 91820, 122324, 152828, 183332 | 7324 | AE001224 | 7324 | 37828 | 68332, 98836, 129340, 159844, 190348 |
| 309 | ABA18037 | 309 | 30813 | 61317, 91821, 122325, 152829, 183333 | 7325 | AE001225 | 7325 | 37829 | 68333, 98837, 129341, 159845, 190349 |
| 310 | ABA18048 | 310 | 30814 | 61318, 91822, 122326, 152830, 183334 | 7326 | AE001226 | 7326 | 37830 | 68334, 98838, 129342, 159846, 190350 |
| 311 | ABA18123 | 311 | 30815 | 61319, 91823, 122327, 152831, 183335 | 7327 | AE001227 | 7327 | 37831 | 68335, 98839, 129343, 159847, 190351 |
| 312 | ABA18134 | 312 | 30816 | 61320, 91824, 122328, 152832, 183336 | 7328 | AE001228 | 7328 | 37832 | 68336, 98840, 129344, 159848, 190352 |
| 313 | ABA18145 | 313 | 30817 | 61321, 91825, 122329, 152833, 183337 | 7329 | AE001229 | 7329 | 37833 | 68337, 98841, 129345, 159849, 190353 |
| 314 | ABA18156 | 314 | 30818 | 61322, 91826, 122330, 152834, 183338 | 7330 | AE001230 | 7330 | 37834 | 68338, 98842, 129346, 159850, 190354 |
| 315 | ABA26700 | 315 | 30819 | 61323, 91827, 122331, 152835, 183339 | 7331 | AE001231 | 7331 | 37835 | 68339, 98843, 129347, 159851, 190355 |
| 316 | ABA26711 | 316 | 30820 | 61324, 91828, 122332, 152836, 183340 | 7332 | AE001232 | 7332 | 37836 | 68340, 98844, 129348, 159852, 190356 |
| 317 | ABA26722 | 317 | 30821 | 61325, 91829, 122333, 152837, 183341 | 7333 | AE001233 | 7333 | 37837 | 68341, 98845, 129349, 159853, 190357 |

FIG. 1 continued

| | | | | | | | | | |
|---|---|---|---|---|---|---|---|---|---|
| 318 | ABA26733 | 318 | 30822 | 61326, 91830, 122334, 152838, 183342 | 7334 | AE001234 | 7334 | 37838 | 68342, 98846, 129350, 159854, 190358 |
| 319 | ABA26755 | 319 | 30823 | 61327, 91831, 122335, 152839, 183343 | 7335 | AE001235 | 7335 | 37839 | 68343, 98847, 129351, 159855, 190359 |
| 320 | ABA26766 | 320 | 30824 | 61328, 91832, 122336, 152840, 183344 | 7336 | AE001236 | 7336 | 37840 | 68344, 98848, 129352, 159856, 190360 |
| 321 | ABA26788 | 321 | 30825 | 61329, 91833, 122337, 152841, 183345 | 7337 | AE001237 | 7337 | 37841 | 68345, 98849, 129353, 159857, 190361 |
| 322 | ABA26799 | 322 | 30826 | 61330, 91834, 122338, 152842, 183346 | 7338 | AE001238 | 7338 | 37842 | 68346, 98850, 129354, 159858, 190362 |
| 323 | ABA42247 | 323 | 30827 | 61331, 91835, 122339, 152843, 183347 | 7339 | AE001240 | 7339 | 37843 | 68347, 98851, 129355, 159859, 190363 |
| 324 | ABA42258 | 324 | 30828 | 61332, 91836, 122340, 152844, 183348 | 7340 | AE001241 | 7340 | 37844 | 68348, 98852, 129356, 159860, 190364 |
| 325 | ABA42269 | 325 | 30829 | 61333, 91837, 122341, 152845, 183349 | 7341 | AE001242 | 7341 | 37845 | 68349, 98853, 129357, 159861, 190365 |
| 326 | ABA42280 | 326 | 30830 | 61334, 91838, 122342, 152846, 183350 | 7342 | AE001244 | 7342 | 37846 | 68350, 98854, 129358, 159862, 190366 |
| 327 | ABA42291 | 327 | 30831 | 61335, 91839, 122343, 152847, 183351 | 7343 | AE001245 | 7343 | 37847 | 68351, 98855, 129359, 159863, 190367 |
| 328 | ABA42302 | 328 | 30832 | 61336, 91840, 122344, 152848, 183352 | 7344 | AE001247 | 7344 | 37848 | 68352, 98856, 129360, 159864, 190368 |
| 329 | ABA42313 | 329 | 30833 | 61337, 91841, 122345, 152849, 183353 | 7345 | AE001248 | 7345 | 37849 | 68353, 98857, 129361, 159865, 190369 |
| 330 | ABA42346 | 330 | 30834 | 61338, 91842, 122346, 152850, 183354 | 7346 | AE001249 | 7346 | 37850 | 68354, 98858, 129362, 159866, 190370 |
| 331 | ABA42357 | 331 | 30835 | 61339, 91843, 122347, 152851, 183355 | 7347 | AE001250 | 7347 | 37851 | 68355, 98859, 129363, 159867, 190371 |
| 332 | ABA42379 | 332 | 30836 | 61340, 91844, 122348, 152852, 183356 | 7348 | AE001251 | 7348 | 37852 | 68356, 98860, 129364, 159868, 190372 |
| 333 | ABA42390 | 333 | 30837 | 61341, 91845, 122349, 152853, 183357 | 7349 | AE001252 | 7349 | 37853 | 68357, 98861, 129365, 159869, 190373 |
| 334 | ABA42401 | 334 | 30838 | 61342, 91846, 122350, 152854, 183358 | 7350 | AE001253 | 7350 | 37854 | 68358, 98862, 129366, 159870, 190374 |
| 335 | ABA42412 | 335 | 30839 | 61343, 91847, 122351, 152855, 183359 | 7351 | AE001254 | 7351 | 37855 | 68359, 98863, 129367, 159871, 190375 |

FIG. 1 continued

| | | | | | | | | | |
|---|---|---|---|---|---|---|---|---|---|
| 336 | ABA42443 | 336 | 30840 | 61344, 91848, 122352, 152856, 183360 | 7352 | AE001256 | 7352 | 37856 | 68360, 98864, 129368, 159872, 190376 |
| 337 | ABA42454 | 337 | 30841 | 61345, 91849, 122353, 152857, 183361 | 7353 | AE001257 | 7353 | 37857 | 68361, 98865, 129369, 159873, 190377 |
| 338 | ABA42465 | 338 | 30842 | 61346, 91850, 122354, 152858, 183362 | 7354 | AE001258 | 7354 | 37858 | 68362, 98866, 129370, 159874, 190378 |
| 339 | ABA42476 | 339 | 30843 | 61347, 91851, 122355, 152859, 183363 | 7355 | AE001259 | 7355 | 37859 | 68363, 98867, 129371, 159875, 190379 |
| 340 | ABA42498 | 340 | 30844 | 61348, 91852, 122356, 152860, 183364 | 7356 | AE001260 | 7356 | 37860 | 68364, 98868, 129372, 159876, 190380 |
| 341 | ABA42509 | 341 | 30845 | 61349, 91853, 122357, 152861, 183365 | 7357 | AE001261 | 7357 | 37861 | 68365, 98869, 129373, 159877, 190381 |
| 342 | ABA42520 | 342 | 30846 | 61350, 91854, 122358, 152862, 183366 | 7358 | AE001262 | 7358 | 37862 | 68366, 98870, 129374, 159878, 190382 |
| 343 | ABA42531 | 343 | 30847 | 61351, 91855, 122359, 152863, 183367 | 7359 | AE001263 | 7359 | 37863 | 68367, 98871, 129375, 159879, 190383 |
| 344 | ABA42542 | 344 | 30848 | 61352, 91856, 122360, 152864, 183368 | 7360 | AE001264 | 7360 | 37864 | 68368, 98872, 129376, 159880, 190384 |
| 345 | ABA42553 | 345 | 30849 | 61353, 91857, 122361, 152865, 183369 | 7361 | AE001265 | 7361 | 37865 | 68369, 98873, 129377, 159881, 190385 |
| 346 | ABA42564 | 346 | 30850 | 61354, 91858, 122362, 152866, 183370 | 7362 | AE001266 | 7362 | 37866 | 68370, 98874, 129378, 159882, 190386 |
| 347 | ABA42928 | 347 | 30851 | 61355, 91859, 122363, 152867, 183371 | 7363 | AE001267 | 7363 | 37867 | 68371, 98875, 129379, 159883, 190387 |
| 348 | ABA42939 | 348 | 30852 | 61356, 91860, 122364, 152868, 183372 | 7364 | AE001268 | 7364 | 37868 | 68372, 98876, 129380, 159884, 190388 |
| 349 | ABA42978 | 349 | 30853 | 61357, 91861, 122365, 152869, 183373 | 7365 | AE001269 | 7365 | 37869 | 68373, 98877, 129381, 159885, 190389 |
| 350 | ABA43167 | 350 | 30854 | 61358, 91862, 122366, 152870, 183374 | 7366 | AE001270 | 7366 | 37870 | 68374, 98878, 129382, 159886, 190390 |
| 351 | ABA43178 | 351 | 30855 | 61359, 91863, 122367, 152871, 183375 | 7367 | AE001271 | 7367 | 37871 | 68375, 98879, 129383, 159887, 190391 |
| 352 | ABA43189 | 352 | 30856 | 61360, 91864, 122368, 152872, 183376 | 7368 | AE001272 | 7368 | 37872 | 68376, 98880, 129384, 159888, 190392 |
| 353 | ABA43200 | 353 | 30857 | 61361, 91865, 122369, 152873, 183377 | 7369 | AE001273 | 7369 | 37873 | 68377, 98881, 129385, 159889, 190393 |

FIG. 1 continued

| | | | | | | | | | |
|---|---|---|---|---|---|---|---|---|---|
| 354 | ABA43336 | 354 | 30858 | 61362, 91866, 122370, 152874, 183378 | 7370 | AE001274 | 7370 | 37874 | 68378, 98882, 129386, 159890, 190394 |
| 355 | ABA54915 | 355 | 30859 | 61363, 91867, 122371, 152875, 183379 | 7371 | AE001275 | 7371 | 37875 | 68379, 98883, 129387, 159891, 190395 |
| 356 | ABA87080 | 356 | 30860 | 61364, 91868, 122372, 152876, 183380 | 7372 | AE001276 | 7372 | 37876 | 68380, 98884, 129388, 159892, 190396 |
| 357 | ABA87091 | 357 | 30861 | 61365, 91869, 122373, 152877, 183381 | 7373 | AE001277 | 7373 | 37877 | 68381, 98885, 129389, 159893, 190397 |
| 358 | ABA87231 | 358 | 30862 | 61366, 91870, 122374, 152878, 183382 | 7374 | AE001278 | 7374 | 37878 | 68382, 98886, 129390, 159894, 190398 |
| 359 | ABA87242 | 359 | 30863 | 61367, 91871, 122375, 152879, 183383 | 7375 | AE001279 | 7375 | 37879 | 68383, 98887, 129391, 159895, 190399 |
| 360 | ABA87253 | 360 | 30864 | 61368, 91872, 122376, 152880, 183384 | 7376 | AE001282 | 7376 | 37880 | 68384, 98888, 129392, 159896, 190400 |
| 361 | ABB02781 | 361 | 30865 | 61369, 91873, 122377, 152881, 183385 | 7377 | AE001283 | 7377 | 37881 | 68385, 98889, 129393, 159897, 190401 |
| 362 | ABB02792 | 362 | 30866 | 61370, 91874, 122378, 152882, 183386 | 7378 | AE001284 | 7378 | 37882 | 68386, 98890, 129394, 159898, 190402 |
| 363 | ABB02803 | 363 | 30867 | 61371, 91875, 122379, 152883, 183387 | 7379 | AE001285 | 7379 | 37883 | 68387, 98891, 129395, 159899, 190403 |
| 364 | ABB02814 | 364 | 30868 | 61372, 91876, 122380, 152884, 183388 | 7380 | AE001286 | 7380 | 37884 | 68388, 98892, 129396, 159900, 190404 |
| 365 | ABB02825 | 365 | 30869 | 61373, 91877, 122381, 152885, 183389 | 7381 | AE001287 | 7381 | 37885 | 68389, 98893, 129397, 159901, 190405 |
| 366 | ABB02836 | 366 | 30870 | 61374, 91878, 122382, 152886, 183390 | 7382 | AE001288 | 7382 | 37886 | 68390, 98894, 129398, 159902, 190406 |
| 367 | ABB02847 | 367 | 30871 | 61375, 91879, 122383, 152887, 183391 | 7383 | AE001289 | 7383 | 37887 | 68391, 98895, 129399, 159903, 190407 |
| 368 | ABB02858 | 368 | 30872 | 61376, 91880, 122384, 152888, 183392 | 7384 | AE001290 | 7384 | 37888 | 68392, 98896, 129400, 159904, 190408 |
| 369 | ABB02869 | 369 | 30873 | 61377, 91881, 122385, 152889, 183393 | 7385 | AE001291 | 7385 | 37889 | 68393, 98897, 129401, 159905, 190409 |
| 370 | ABB02880 | 370 | 30874 | 61378, 91882, 122386, 152890, 183394 | 7386 | AE001292 | 7386 | 37890 | 68394, 98898, 129402, 159906, 190410 |
| 371 | ABB02891 | 371 | 30875 | 61379, 91883, 122387, 152891, 183395 | 7387 | AE001294 | 7387 | 37891 | 68395, 98899, 129403, 159907, 190411 |

FIG. 1 continued

| | | | | | | | | | |
|---|---|---|---|---|---|---|---|---|---|
| 372 | ABB02902 | 372 | 30876 | 61380, 91884, 122388, 152892, 183396 | 7388 | AE001295 | 7388 | 37892 | 68396, 98900, 129404, 159908, 190412 |
| 373 | ABB02913 | 373 | 30877 | 61381, 91885, 122389, 152893, 183397 | 7389 | AE001296 | 7389 | 37893 | 68397, 98901, 129405, 159909, 190413 |
| 374 | ABB02924 | 374 | 30878 | 61382, 91886, 122390, 152894, 183398 | 7390 | AE001297 | 7390 | 37894 | 68398, 98902, 129406, 159910, 190414 |
| 375 | ABB02936 | 375 | 30879 | 61383, 91887, 122391, 152895, 183399 | 7391 | AE001298 | 7391 | 37895 | 68399, 98903, 129407, 159911, 190415 |
| 376 | ABB02947 | 376 | 30880 | 61384, 91888, 122392, 152896, 183400 | 7392 | AE001299 | 7392 | 37896 | 68400, 98904, 129408, 159912, 190416 |
| 377 | ABB02958 | 377 | 30881 | 61385, 91889, 122393, 152897, 183401 | 7393 | AE001300 | 7393 | 37897 | 68401, 98905, 129409, 159913, 190417 |
| 378 | ABB02969 | 378 | 30882 | 61386, 91890, 122394, 152898, 183402 | 7394 | AE001301 | 7394 | 37898 | 68402, 98906, 129410, 159914, 190418 |
| 379 | ABB02980 | 379 | 30883 | 61387, 91891, 122395, 152899, 183403 | 7395 | AE001302 | 7395 | 37899 | 68403, 98907, 129411, 159915, 190419 |
| 380 | ABB02991 | 380 | 30884 | 61388, 91892, 122396, 152900, 183404 | 7396 | AE001303 | 7396 | 37900 | 68404, 98908, 129412, 159916, 190420 |
| 381 | ABB03002 | 381 | 30885 | 61389, 91893, 122397, 152901, 183405 | 7397 | AE001304 | 7397 | 37901 | 68405, 98909, 129413, 159917, 190421 |
| 382 | ABB03013 | 382 | 30886 | 61390, 91894, 122398, 152902, 183406 | 7398 | AE001305 | 7398 | 37902 | 68406, 98910, 129414, 159918, 190422 |
| 383 | ABB03024 | 383 | 30887 | 61391, 91895, 122399, 152903, 183407 | 7399 | AE001306 | 7399 | 37903 | 68407, 98911, 129415, 159919, 190423 |
| 384 | ABB03035 | 384 | 30888 | 61392, 91896, 122400, 152904, 183408 | 7400 | AE001307 | 7400 | 37904 | 68408, 98912, 129416, 159920, 190424 |
| 385 | ABB03046 | 385 | 30889 | 61393, 91897, 122401, 152905, 183409 | 7401 | AE001308 | 7401 | 37905 | 68409, 98913, 129417, 159921, 190425 |
| 386 | ABB03057 | 386 | 30890 | 61394, 91898, 122402, 152906, 183410 | 7402 | AE001309 | 7402 | 37906 | 68410, 98914, 129418, 159922, 190426 |
| 387 | ABB03068 | 387 | 30891 | 61395, 91899, 122403, 152907, 183411 | 7403 | AE001310 | 7403 | 37907 | 68411, 98915, 129419, 159923, 190427 |
| 388 | ABB03079 | 388 | 30892 | 61396, 91900, 122404, 152908, 183412 | 7404 | AE001311 | 7404 | 37908 | 68412, 98916, 129420, 159924, 190428 |
| 389 | ABB03090 | 389 | 30893 | 61397, 91901, 122405, 152909, 183413 | 7405 | AE001312 | 7405 | 37909 | 68413, 98917, 129421, 159925, 190429 |

FIG. 1 continued

| | | | | | | | | | |
|---|---|---|---|---|---|---|---|---|---|
| 390 | ABB03101 | 390 | 30894 | 61398, 91902, 122406, 152910, 183414 | 7406 | AE001313 | 7406 | 37910 | 68414, 98918, 129422, 159926, 190430 |
| 391 | ABB03112 | 391 | 30895 | 61399, 91903, 122407, 152911, 183415 | 7407 | AE001314 | 7407 | 37911 | 68415, 98919, 129423, 159927, 190431 |
| 392 | ABB03123 | 392 | 30896 | 61400, 91904, 122408, 152912, 183416 | 7408 | AE001315 | 7408 | 37912 | 68416, 98920, 129424, 159928, 190432 |
| 393 | ABB03134 | 393 | 30897 | 61401, 91905, 122409, 152913, 183417 | 7409 | AE001316 | 7409 | 37913 | 68417, 98921, 129425, 159929, 190433 |
| 394 | ABB03145 | 394 | 30898 | 61402, 91906, 122410, 152914, 183418 | 7410 | AE001317 | 7410 | 37914 | 68418, 98922, 129426, 159930, 190434 |
| 395 | ABB04283 | 395 | 30899 | 61403, 91907, 122411, 152915, 183419 | 7411 | AE001318 | 7411 | 37915 | 68419, 98923, 129427, 159931, 190435 |
| 396 | ABB04294 | 396 | 30900 | 61404, 91908, 122412, 152916, 183420 | 7412 | AE001319 | 7412 | 37916 | 68420, 98924, 129428, 159932, 190436 |
| 397 | ABB04305 | 397 | 30901 | 61405, 91909, 122413, 152917, 183421 | 7413 | AE001321 | 7413 | 37917 | 68421, 98925, 129429, 159933, 190437 |
| 398 | ABB04316 | 398 | 30902 | 61406, 91910, 122414, 152918, 183422 | 7414 | AE001322 | 7414 | 37918 | 68422, 98926, 129430, 159934, 190438 |
| 399 | ABB04327 | 399 | 30903 | 61407, 91911, 122415, 152919, 183423 | 7415 | AE001323 | 7415 | 37919 | 68423, 98927, 129431, 159935, 190439 |
| 400 | ABB04338 | 400 | 30904 | 61408, 91912, 122416, 152920, 183424 | 7416 | AE001324 | 7416 | 37920 | 68424, 98928, 129432, 159936, 190440 |
| 401 | ABB04349 | 401 | 30905 | 61409, 91913, 122417, 152921, 183425 | 7417 | AE001325 | 7417 | 37921 | 68425, 98929, 129433, 159937, 190441 |
| 402 | ABB04360 | 402 | 30906 | 61410, 91914, 122418, 152922, 183426 | 7418 | AE001326 | 7418 | 37922 | 68426, 98930, 129434, 159938, 190442 |
| 403 | ABB04371 | 403 | 30907 | 61411, 91915, 122419, 152923, 183427 | 7419 | AE001327 | 7419 | 37923 | 68427, 98931, 129435, 159939, 190443 |
| 404 | ABB04906 | 404 | 30908 | 61412, 91916, 122420, 152924, 183428 | 7420 | AE001328 | 7420 | 37924 | 68428, 98932, 129436, 159940, 190444 |
| 405 | ABB04917 | 405 | 30909 | 61413, 91917, 122421, 152925, 183429 | 7421 | AE001330 | 7421 | 37925 | 68429, 98933, 129437, 159941, 190445 |
| 406 | ABB04928 | 406 | 30910 | 61414, 91918, 122422, 152926, 183430 | 7422 | AE001331 | 7422 | 37926 | 68430, 98934, 129438, 159942, 190446 |
| 407 | ABB04939 | 407 | 30911 | 61415, 91919, 122423, 152927, 183431 | 7423 | AE001332 | 7423 | 37927 | 68431, 98935, 129439, 159943, 190447 |

FIG. 1 continued

| | | | | | | | | | |
|---|---|---|---|---|---|---|---|---|---|
| 408 | ABB04950 | 408 | 30912 | 61416, 91920, 122424, 152928, 183432 | 7424 | AE001333 | 7424 | 37928 | 68432, 98936, 129440, 159944, 190448 |
| 409 | ABB04983 | 409 | 30913 | 61417, 91921, 122425, 152929, 183433 | 7425 | AE001334 | 7425 | 37929 | 68433, 98937, 129441, 159945, 190449 |
| 410 | ABB04994 | 410 | 30914 | 61418, 91922, 122426, 152930, 183434 | 7426 | AE001335 | 7426 | 37930 | 68434, 98938, 129442, 159946, 190450 |
| 411 | ABB05005 | 411 | 30915 | 61419, 91923, 122427, 152931, 183435 | 7427 | AE001336 | 7427 | 37931 | 68435, 98939, 129443, 159947, 190451 |
| 412 | ABB05183 | 412 | 30916 | 61420, 91924, 122428, 152932, 183436 | 7428 | AE001337 | 7428 | 37932 | 68436, 98940, 129444, 159948, 190452 |
| 413 | ABB05194 | 413 | 30917 | 61421, 91925, 122429, 152933, 183437 | 7429 | AE001338 | 7429 | 37933 | 68437, 98941, 129445, 159949, 190453 |
| 414 | ABB05205 | 414 | 30918 | 61422, 91926, 122430, 152934, 183438 | 7430 | AE001339 | 7430 | 37934 | 68438, 98942, 129446, 159950, 190454 |
| 415 | ABB05216 | 415 | 30919 | 61423, 91927, 122431, 152935, 183439 | 7431 | AE001340 | 7431 | 37935 | 68439, 98943, 129447, 159951, 190455 |
| 416 | ABB46392 | 416 | 30920 | 61424, 91928, 122432, 152936, 183440 | 7432 | AE001341 | 7432 | 37936 | 68440, 98944, 129448, 159952, 190456 |
| 417 | ABB46414 | 417 | 30921 | 61425, 91929, 122433, 152937, 183441 | 7433 | AE001342 | 7433 | 37937 | 68441, 98945, 129449, 159953, 190457 |
| 418 | ABB46425 | 418 | 30922 | 61426, 91930, 122434, 152938, 183442 | 7434 | AE001343 | 7434 | 37938 | 68442, 98946, 129450, 159954, 190458 |
| 419 | ABB46436 | 419 | 30923 | 61427, 91931, 122435, 152939, 183443 | 7435 | AE001344 | 7435 | 37939 | 68443, 98947, 129451, 159955, 190459 |
| 420 | ABB46447 | 420 | 30924 | 61428, 91932, 122436, 152940, 183444 | 7436 | AE001345 | 7436 | 37940 | 68444, 98948, 129452, 159956, 190460 |
| 421 | ABB46458 | 421 | 30925 | 61429, 91933, 122437, 152941, 183445 | 7437 | AE001346 | 7437 | 37941 | 68445, 98949, 129453, 159957, 190461 |
| 422 | ABB51961 | 422 | 30926 | 61430, 91934, 122438, 152942, 183446 | 7438 | AE001347 | 7438 | 37942 | 68446, 98950, 129454, 159958, 190462 |
| 423 | ABB51962 | 423 | 30927 | 61431, 91935, 122439, 152943, 183447 | 7439 | AE001348 | 7439 | 37943 | 68447, 98951, 129455, 159959, 190463 |
| 424 | ABB51963 | 424 | 30928 | 61432, 91936, 122440, 152944, 183448 | 7440 | AE001349 | 7440 | 37944 | 68448, 98952, 129456, 159960, 190464 |
| 425 | ABB51964 | 425 | 30929 | 61433, 91937, 122441, 152945, 183449 | 7441 | AE001350 | 7441 | 37945 | 68449, 98953, 129457, 159961, 190465 |

FIG. 1 continued

| | | | | | | | | | |
|---|---|---|---|---|---|---|---|---|---|
| 426 | ABB53603 | 426 | 30930 | 61434, 91938, 122442, 152946, 183450 | 7442 | AE001351 | 7442 | 37946 | 68450, 98954, 129458, 159962, 190466 |
| 427 | ABB53614 | 427 | 30931 | 61435, 91939, 122443, 152947, 183451 | 7443 | AE001352 | 7443 | 37947 | 68451, 98955, 129459, 159963, 190467 |
| 428 | ABB53625 | 428 | 30932 | 61436, 91940, 122444, 152948, 183452 | 7444 | AE001353 | 7444 | 37948 | 68452, 98956, 129460, 159964, 190468 |
| 429 | ABB53652 | 429 | 30933 | 61437, 91941, 122445, 152949, 183453 | 7445 | AE001354 | 7445 | 37949 | 68453, 98957, 129461, 159965, 190469 |
| 430 | ABB53663 | 430 | 30934 | 61438, 91942, 122446, 152950, 183454 | 7446 | AE001355 | 7446 | 37950 | 68454, 98958, 129462, 159966, 190470 |
| 431 | ABB53685 | 431 | 30935 | 61439, 91943, 122447, 152951, 183455 | 7447 | AE001356 | 7447 | 37951 | 68455, 98959, 129463, 159967, 190471 |
| 432 | ABB53696 | 432 | 30936 | 61440, 91944, 122448, 152952, 183456 | 7448 | AE001358 | 7448 | 37952 | 68456, 98960, 129464, 159968, 190472 |
| 433 | ABB53707 | 433 | 30937 | 61441, 91945, 122449, 152953, 183457 | 7449 | AE001359 | 7449 | 37953 | 68457, 98961, 129465, 159969, 190473 |
| 434 | ABB53718 | 434 | 30938 | 61442, 91946, 122450, 152954, 183458 | 7450 | AE001360 | 7450 | 37954 | 68458, 98962, 129466, 159970, 190474 |
| 435 | ABB53740 | 435 | 30939 | 61443, 91947, 122451, 152955, 183459 | 7451 | AE001361 | 7451 | 37955 | 68459, 98963, 129467, 159971, 190475 |
| 436 | ABB53751 | 436 | 30940 | 61444, 91948, 122452, 152956, 183460 | 7452 | AE001362 | 7452 | 37956 | 68460, 98964, 129468, 159972, 190476 |
| 437 | ABB60007 | 437 | 30941 | 61445, 91949, 122453, 152957, 183461 | 7453 | AE001363 | 7453 | 37957 | 68461, 98965, 129469, 159973, 190477 |
| 438 | ABB77853 | 438 | 30942 | 61446, 91950, 122454, 152958, 183462 | 7454 | AE001365 | 7454 | 37958 | 68462, 98966, 129470, 159974, 190478 |
| 439 | ABB79731 | 439 | 30943 | 61447, 91951, 122455, 152959, 183463 | 7455 | AE001366 | 7455 | 37959 | 68463, 98967, 129471, 159975, 190479 |
| 440 | ABB79788 | 440 | 30944 | 61448, 91952, 122456, 152960, 183464 | 7456 | AE001367 | 7456 | 37960 | 68464, 98968, 129472, 159976, 190480 |
| 441 | ABB79799 | 441 | 30945 | 61449, 91953, 122457, 152961, 183465 | 7457 | AE001368 | 7457 | 37961 | 68465, 98969, 129473, 159977, 190481 |
| 442 | ABB79810 | 442 | 30946 | 61450, 91954, 122458, 152962, 183466 | 7458 | AE001369 | 7458 | 37962 | 68466, 98970, 129474, 159978, 190482 |
| 443 | ABB79957 | 443 | 30947 | 61451, 91955, 122459, 152963, 183467 | 7459 | AE001370 | 7459 | 37963 | 68467, 98971, 129475, 159979, 190483 |

FIG. 1 continued

| | | | | | | | | | |
|---|---|---|---|---|---|---|---|---|---|
| 444 | ABB79968 | 444 | 30948 | 61452, 91956, 122460, 152964, 183468 | 7460 | AE001371 | 7460 | 37964 | 68468, 98972, 129476, 159980, 190484 |
| 445 | ABB79979 | 445 | 30949 | 61453, 91957, 122461, 152965, 183469 | 7461 | AE001372 | 7461 | 37965 | 68469, 98973, 129477, 159981, 190485 |
| 446 | ABB79990 | 446 | 30950 | 61454, 91958, 122462, 152966, 183470 | 7462 | AE001373 | 7462 | 37966 | 68470, 98974, 129478, 159982, 190486 |
| 447 | ABB80001 | 447 | 30951 | 61455, 91959, 122463, 152967, 183471 | 7463 | AE001374 | 7463 | 37967 | 68471, 98975, 129479, 159983, 190487 |
| 448 | ABB80012 | 448 | 30952 | 61456, 91960, 122464, 152968, 183472 | 7464 | AE001375 | 7464 | 37968 | 68472, 98976, 129480, 159984, 190488 |
| 449 | ABB80023 | 449 | 30953 | 61457, 91961, 122465, 152969, 183473 | 7465 | AE001376 | 7465 | 37969 | 68473, 98977, 129481, 159985, 190489 |
| 450 | ABB80034 | 450 | 30954 | 61458, 91962, 122466, 152970, 183474 | 7466 | AE001377 | 7466 | 37970 | 68474, 98978, 129482, 159986, 190490 |
| 451 | ABB80045 | 451 | 30955 | 61459, 91963, 122467, 152971, 183475 | 7467 | AE001378 | 7467 | 37971 | 68475, 98979, 129483, 159987, 190491 |
| 452 | ABB80081 | 452 | 30956 | 61460, 91964, 122468, 152972, 183476 | 7468 | AE001379 | 7468 | 37972 | 68476, 98980, 129484, 159988, 190492 |
| 453 | ABB80092 | 453 | 30957 | 61461, 91965, 122469, 152973, 183477 | 7469 | AE001380 | 7469 | 37973 | 68477, 98981, 129485, 159989, 190493 |
| 454 | ABB80137 | 454 | 30958 | 61462, 91966, 122470, 152974, 183478 | 7470 | AE001381 | 7470 | 37974 | 68478, 98982, 129486, 159990, 190494 |
| 455 | ABB80159 | 455 | 30959 | 61463, 91967, 122471, 152975, 183479 | 7471 | AE001382 | 7471 | 37975 | 68479, 98983, 129487, 159991, 190495 |
| 456 | ABB80185 | 456 | 30960 | 61464, 91968, 122472, 152976, 183480 | 7472 | AE001383 | 7472 | 37976 | 68480, 98984, 129488, 159992, 190496 |
| 457 | ABB80207 | 457 | 30961 | 61465, 91969, 122473, 152977, 183481 | 7473 | AE001384 | 7473 | 37977 | 68481, 98985, 129489, 159993, 190497 |
| 458 | ABB80229 | 458 | 30962 | 61466, 91970, 122474, 152978, 183482 | 7474 | AE001385 | 7474 | 37978 | 68482, 98986, 129490, 159994, 190498 |
| 459 | ABB80240 | 459 | 30963 | 61467, 91971, 122475, 152979, 183483 | 7475 | AE001386 | 7475 | 37979 | 68483, 98987, 129491, 159995, 190499 |
| 460 | ABB80251 | 460 | 30964 | 61468, 91972, 122476, 152980, 183484 | 7476 | AE001387 | 7476 | 37980 | 68484, 98988, 129492, 159996, 190500 |
| 461 | ABB80492 | 461 | 30965 | 61469, 91973, 122477, 152981, 183485 | 7477 | AE001388 | 7477 | 37981 | 68485, 98989, 129493, 159997, 190501 |

FIG. 1 continued

| | | | | | | | | | |
|---|---|---|---|---|---|---|---|---|---|
| 462 | ABB80503 | 462 | 30966 | 61470, 91974, 122478, 152982, 183486 | 7478 | AE001389 | 7478 | 37982 | 68486, 98990, 129494, 159998, 190502 |
| 463 | ABB80514 | 463 | 30967 | 61471, 91975, 122479, 152983, 183487 | 7479 | AE001390 | 7479 | 37983 | 68487, 98991, 129495, 159999, 190503 |
| 464 | ABB80529 | 464 | 30968 | 61472, 91976, 122480, 152984, 183488 | 7480 | AE001391 | 7480 | 37984 | 68488, 98992, 129496, 160000, 190504 |
| 465 | ABB80641 | 465 | 30969 | 61473, 91977, 122481, 152985, 183489 | 7481 | AE001392 | 7481 | 37985 | 68489, 98993, 129497, 160001, 190505 |
| 466 | ABB80661 | 466 | 30970 | 61474, 91978, 122482, 152986, 183490 | 7482 | AE001393 | 7482 | 37986 | 68490, 98994, 129498, 160002, 190506 |
| 467 | ABB80672 | 467 | 30971 | 61475, 91979, 122483, 152987, 183491 | 7483 | AE001394 | 7483 | 37987 | 68491, 98995, 129499, 160003, 190507 |
| 468 | ABB80682 | 468 | 30972 | 61476, 91980, 122484, 152988, 183492 | 7484 | AE001395 | 7484 | 37988 | 68492, 98996, 129500, 160004, 190508 |
| 469 | ABB80693 | 469 | 30973 | 61477, 91981, 122485, 152989, 183493 | 7485 | AE001396 | 7485 | 37989 | 68493, 98997, 129501, 160005, 190509 |
| 470 | ABB80704 | 470 | 30974 | 61478, 91982, 122486, 152990, 183494 | 7486 | AE001397 | 7486 | 37990 | 68494, 98998, 129502, 160006, 190510 |
| 471 | ABB80715 | 471 | 30975 | 61479, 91983, 122487, 152991, 183495 | 7487 | AE001398 | 7487 | 37991 | 68495, 98999, 129503, 160007, 190511 |
| 472 | ABB80724 | 472 | 30976 | 61480, 91984, 122488, 152992, 183496 | 7488 | AE001399 | 7488 | 37992 | 68496, 99000, 129504, 160008, 190512 |
| 473 | ABB80737 | 473 | 30977 | 61481, 91985, 122489, 152993, 183497 | 7489 | AE001402 | 7489 | 37993 | 68497, 99001, 129505, 160009, 190513 |
| 474 | ABB80748 | 474 | 30978 | 61482, 91986, 122490, 152994, 183498 | 7490 | AE001403 | 7490 | 37994 | 68498, 99002, 129506, 160010, 190514 |
| 475 | ABB82183 | 475 | 30979 | 61483, 91987, 122491, 152995, 183499 | 7491 | AE001404 | 7491 | 37995 | 68499, 99003, 129507, 160011, 190515 |
| 476 | ABB82194 | 476 | 30980 | 61484, 91988, 122492, 152996, 183500 | 7492 | AE001405 | 7492 | 37996 | 68500, 99004, 129508, 160012, 190516 |
| 477 | ABB82205 | 477 | 30981 | 61485, 91989, 122493, 152997, 183501 | 7493 | AE001407 | 7493 | 37997 | 68501, 99005, 129509, 160013, 190517 |
| 478 | ABB82216 | 478 | 30982 | 61486, 91990, 122494, 152998, 183502 | 7494 | AE001408 | 7494 | 37998 | 68502, 99006, 129510, 160014, 190518 |
| 479 | ABB82227 | 479 | 30983 | 61487, 91991, 122495, 152999, 183503 | 7495 | AE001409 | 7495 | 37999 | 68503, 99007, 129511, 160015, 190519 |

FIG. 1 continued

| | | | | | | | | | |
|---|---|---|---|---|---|---|---|---|---|
| 480 | ABB83026 | 480 | 30984 | 61488, 91992, 122496, 153000, 183504 | 7496 | AE001410 | 7496 | 38000 | 68504, 99008, 129512, 160016, 190520 |
| 481 | ABB83127 | 481 | 30985 | 61489, 91993, 122497, 153001, 183505 | 7497 | AE001411 | 7497 | 38001 | 68505, 99009, 129513, 160017, 190521 |
| 482 | ABB83138 | 482 | 30986 | 61490, 91994, 122498, 153002, 183506 | 7498 | AE001412 | 7498 | 38002 | 68506, 99010, 129514, 160018, 190522 |
| 483 | ABB86877 | 483 | 30987 | 61491, 91995, 122499, 153003, 183507 | 7499 | AE001413 | 7499 | 38003 | 68507, 99011, 129515, 160019, 190523 |
| 484 | ABB86887 | 484 | 30988 | 61492, 91996, 122500, 153004, 183508 | 7500 | AE001414 | 7500 | 38004 | 68508, 99012, 129516, 160020, 190524 |
| 485 | ABB86899 | 485 | 30989 | 61493, 91997, 122501, 153005, 183509 | 7501 | AE001416 | 7501 | 38005 | 68509, 99013, 129517, 160021, 190525 |
| 486 | ABB86907 | 486 | 30990 | 61494, 91998, 122502, 153006, 183510 | 7502 | AE001418 | 7502 | 38006 | 68510, 99014, 129518, 160022, 190526 |
| 487 | ABB86917 | 487 | 30991 | 61495, 91999, 122503, 153007, 183511 | 7503 | AE001419 | 7503 | 38007 | 68511, 99015, 129519, 160023, 190527 |
| 488 | ABB86929 | 488 | 30992 | 61496, 92000, 122504, 153008, 183512 | 7504 | AE001420 | 7504 | 38008 | 68512, 99016, 129520, 160024, 190528 |
| 489 | ABB86937 | 489 | 30993 | 61497, 92001, 122505, 153009, 183513 | 7505 | AE001421 | 7505 | 38009 | 68513, 99017, 129521, 160025, 190529 |
| 490 | ABB86946 | 490 | 30994 | 61498, 92002, 122506, 153010, 183514 | 7506 | AE001422 | 7506 | 38010 | 68514, 99018, 129522, 160026, 190530 |
| 491 | ABB96319 | 491 | 30995 | 61499, 92003, 122507, 153011, 183515 | 7507 | AE001423 | 7507 | 38011 | 68515, 99019, 129523, 160027, 190531 |
| 492 | ABB96330 | 492 | 30996 | 61500, 92004, 122508, 153012, 183516 | 7508 | AE001424 | 7508 | 38012 | 68516, 99020, 129524, 160028, 190532 |
| 493 | ABB96341 | 493 | 30997 | 61501, 92005, 122509, 153013, 183517 | 7509 | AE001425 | 7509 | 38013 | 68517, 99021, 129525, 160029, 190533 |
| 494 | ABB96395 | 494 | 30998 | 61502, 92006, 122510, 153014, 183518 | 7510 | AE001426 | 7510 | 38014 | 68518, 99022, 129526, 160030, 190534 |
| 495 | ABB96487 | 495 | 30999 | 61503, 92007, 122511, 153015, 183519 | 7511 | AE001427 | 7511 | 38015 | 68519, 99023, 129527, 160031, 190535 |
| 496 | ABB96520 | 496 | 31000 | 61504, 92008, 122512, 153016, 183520 | 7512 | AE001428 | 7512 | 38016 | 68520, 99024, 129528, 160032, 190536 |
| 497 | ABB96531 | 497 | 31001 | 61505, 92009, 122513, 153017, 183521 | 7513 | AE001429 | 7513 | 38017 | 68521, 99025, 129529, 160033, 190537 |

FIG. 1 continued

| | | | | | | | | | |
|---|---|---|---|---|---|---|---|---|---|
| 498 | ABC02234 | 498 | 31002 | 61506, 92010, 122514, 153018, 183522 | 7514 | AE001430 | 7514 | 38018 | 68522, 99026, 129530, 160034, 190538 |
| 499 | ABC02255 | 499 | 31003 | 61507, 92011, 122515, 153019, 183523 | 7515 | AE001431 | 7515 | 38019 | 68523, 99027, 129531, 160035, 190539 |
| 500 | ABC02266 | 500 | 31004 | 61508, 92012, 122516, 153020, 183524 | 7516 | AE001432 | 7516 | 38020 | 68524, 99028, 129532, 160036, 190540 |
| 501 | ABC02288 | 501 | 31005 | 61509, 92013, 122517, 153021, 183525 | 7517 | AE001434 | 7517 | 38021 | 68525, 99029, 129533, 160037, 190541 |
| 502 | ABC02299 | 502 | 31006 | 61510, 92014, 122518, 153022, 183526 | 7518 | AE001435 | 7518 | 38022 | 68526, 99030, 129534, 160038, 190542 |
| 503 | ABC02310 | 503 | 31007 | 61511, 92015, 122519, 153023, 183527 | 7519 | AE001436 | 7519 | 38023 | 68527, 99031, 129535, 160039, 190543 |
| 504 | ABC02321 | 504 | 31008 | 61512, 92016, 122520, 153024, 183528 | 7520 | AE001437 | 7520 | 38024 | 68528, 99032, 129536, 160040, 190544 |
| 505 | ABC02332 | 505 | 31009 | 61513, 92017, 122521, 153025, 183529 | 7521 | AE001438 | 7521 | 38025 | 68529, 99033, 129537, 160041, 190545 |
| 506 | ABC39805 | 506 | 31010 | 61514, 92018, 122522, 153026, 183530 | 7522 | AE001440 | 7522 | 38026 | 68530, 99034, 129538, 160042, 190546 |
| 507 | ABC40522 | 507 | 31011 | 61515, 92019, 122523, 153027, 183531 | 7523 | AE001441 | 7523 | 38027 | 68531, 99035, 129539, 160043, 190547 |
| 508 | ABC40533 | 508 | 31012 | 61516, 92020, 122524, 153028, 183532 | 7524 | AE001442 | 7524 | 38028 | 68532, 99036, 129540, 160044, 190548 |
| 509 | ABC40555 | 509 | 31013 | 61517, 92021, 122525, 153029, 183533 | 7525 | AE001443 | 7525 | 38029 | 68533, 99037, 129541, 160045, 190549 |
| 510 | ABC40608 | 510 | 31014 | 61518, 92022, 122526, 153030, 183534 | 7526 | AE001444 | 7526 | 38030 | 68534, 99038, 129542, 160046, 190550 |
| 511 | ABC40619 | 511 | 31015 | 61519, 92023, 122527, 153031, 183535 | 7527 | AE001445 | 7527 | 38031 | 68535, 99039, 129543, 160047, 190551 |
| 512 | ABC40631 | 512 | 31016 | 61520, 92024, 122528, 153032, 183536 | 7528 | AE001446 | 7528 | 38032 | 68536, 99040, 129544, 160048, 190552 |
| 513 | ABC41692 | 513 | 31017 | 61521, 92025, 122529, 153033, 183537 | 7529 | AE001447 | 7529 | 38033 | 68537, 99041, 129545, 160049, 190553 |
| 514 | ABC41714 | 514 | 31018 | 61522, 92026, 122530, 153034, 183538 | 7530 | AE001448 | 7530 | 38034 | 68538, 99042, 129546, 160050, 190554 |
| 515 | ABC41725 | 515 | 31019 | 61523, 92027, 122531, 153035, 183539 | 7531 | AE001449 | 7531 | 38035 | 68539, 99043, 129547, 160051, 190555 |

FIG. 1 continued

| | | | | | | | | | |
|---|---|---|---|---|---|---|---|---|---|
| 516 | ABC41736 | 516 | 31020 | 61524, 92028, 122532, 153036, 183540 | 7532 | AE001450 | 7532 | 38036 | 68540, 99044, 129548, 160052, 190556 |
| 517 | ABC41952 | 517 | 31021 | 61525, 92029, 122533, 153037, 183541 | 7533 | AE001451 | 7533 | 38037 | 68541, 99045, 129549, 160053, 190557 |
| 518 | ABC41953 | 518 | 31022 | 61526, 92030, 122534, 153038, 183542 | 7534 | AE001452 | 7534 | 38038 | 68542, 99046, 129550, 160054, 190558 |
| 519 | ABC41964 | 519 | 31023 | 61527, 92031, 122535, 153039, 183543 | 7535 | AE001453 | 7535 | 38039 | 68543, 99047, 129551, 160055, 190559 |
| 520 | ABC42014 | 520 | 31024 | 61528, 92032, 122536, 153040, 183544 | 7536 | AE001454 | 7536 | 38040 | 68544, 99048, 129552, 160056, 190560 |
| 521 | ABC42114 | 521 | 31025 | 61529, 92033, 122537, 153041, 183545 | 7537 | AE001455 | 7537 | 38041 | 68545, 99049, 129553, 160057, 190561 |
| 522 | ABC42125 | 522 | 31026 | 61530, 92034, 122538, 153042, 183546 | 7538 | AE001456 | 7538 | 38042 | 68546, 99050, 129554, 160058, 190562 |
| 523 | ABC42136 | 523 | 31027 | 61531, 92035, 122539, 153043, 183547 | 7539 | AE001457 | 7539 | 38043 | 68547, 99051, 129555, 160059, 190563 |
| 524 | ABC42147 | 524 | 31028 | 61532, 92036, 122540, 153044, 183548 | 7540 | AE001458 | 7540 | 38044 | 68548, 99052, 129556, 160060, 190564 |
| 525 | ABC42158 | 525 | 31029 | 61533, 92037, 122541, 153045, 183549 | 7541 | AE001459 | 7541 | 38045 | 68549, 99053, 129557, 160061, 190565 |
| 526 | ABC42169 | 526 | 31030 | 61534, 92038, 122542, 153046, 183550 | 7542 | AE001461 | 7542 | 38046 | 68550, 99054, 129558, 160062, 190566 |
| 527 | ABC42180 | 527 | 31031 | 61535, 92039, 122543, 153047, 183551 | 7543 | AE001462 | 7543 | 38047 | 68551, 99055, 129559, 160063, 190567 |
| 528 | ABC42192 | 528 | 31032 | 61536, 92040, 122544, 153048, 183552 | 7544 | AE001463 | 7544 | 38048 | 68552, 99056, 129560, 160064, 190568 |
| 529 | ABC42307 | 529 | 31033 | 61537, 92041, 122545, 153049, 183553 | 7545 | AE001464 | 7545 | 38049 | 68553, 99057, 129561, 160065, 190569 |
| 530 | ABC42318 | 530 | 31034 | 61538, 92042, 122546, 153050, 183554 | 7546 | AE001465 | 7546 | 38050 | 68554, 99058, 129562, 160066, 190570 |
| 531 | ABC42346 | 531 | 31035 | 61539, 92043, 122547, 153051, 183555 | 7547 | AE001466 | 7547 | 38051 | 68555, 99059, 129563, 160067, 190571 |
| 532 | ABC42461 | 532 | 31036 | 61540, 92044, 122548, 153052, 183556 | 7548 | AE001467 | 7548 | 38052 | 68556, 99060, 129564, 160068, 190572 |
| 533 | ABC42494 | 533 | 31037 | 61541, 92045, 122549, 153053, 183557 | 7549 | AE001468 | 7549 | 38053 | 68557, 99061, 129565, 160069, 190573 |

FIG. 1 continued

| | | | | | | | | | |
|---|---|---|---|---|---|---|---|---|---|
| 534 | ABC42505 | 534 | 31038 | 61542, 92046, 122550, 153054, 183558 | 7550 | AE001469 | 7550 | 38054 | 68558, 99062, 129566, 160070, 190574 |
| 535 | ABC42516 | 535 | 31039 | 61543, 92047, 122551, 153055, 183559 | 7551 | AE001470 | 7551 | 38055 | 68559, 99063, 129567, 160071, 190575 |
| 536 | ABC42527 | 536 | 31040 | 61544, 92048, 122552, 153056, 183560 | 7552 | AE001471 | 7552 | 38056 | 68560, 99064, 129568, 160072, 190576 |
| 537 | ABC42574 | 537 | 31041 | 61545, 92049, 122553, 153057, 183561 | 7553 | AE001472 | 7553 | 38057 | 68561, 99065, 129569, 160073, 190577 |
| 538 | ABC42585 | 538 | 31042 | 61546, 92050, 122554, 153058, 183562 | 7554 | AE001473 | 7554 | 38058 | 68562, 99066, 129570, 160074, 190578 |
| 539 | ABC42596 | 539 | 31043 | 61547, 92051, 122555, 153059, 183563 | 7555 | AE001474 | 7555 | 38059 | 68563, 99067, 129571, 160075, 190579 |
| 540 | ABC42607 | 540 | 31044 | 61548, 92052, 122556, 153060, 183564 | 7556 | AE001475 | 7556 | 38060 | 68564, 99068, 129572, 160076, 190580 |
| 541 | ABC42618 | 541 | 31045 | 61549, 92053, 122557, 153061, 183565 | 7557 | AE001476 | 7557 | 38061 | 68565, 99069, 129573, 160077, 190581 |
| 542 | ABC42629 | 542 | 31046 | 61550, 92054, 122558, 153062, 183566 | 7558 | AE001477 | 7558 | 38062 | 68566, 99070, 129574, 160078, 190582 |
| 543 | ABC42640 | 543 | 31047 | 61551, 92055, 122559, 153063, 183567 | 7559 | AE001478 | 7559 | 38063 | 68567, 99071, 129575, 160079, 190583 |
| 544 | ABC42651 | 544 | 31048 | 61552, 92056, 122560, 153064, 183568 | 7560 | AE001479 | 7560 | 38064 | 68568, 99072, 129576, 160080, 190584 |
| 545 | ABC42662 | 545 | 31049 | 61553, 92057, 122561, 153065, 183569 | 7561 | AE001480 | 7561 | 38065 | 68569, 99073, 129577, 160081, 190585 |
| 546 | ABC42673 | 546 | 31050 | 61554, 92058, 122562, 153066, 183570 | 7562 | AE001482 | 7562 | 38066 | 68570, 99074, 129578, 160082, 190586 |
| 547 | ABC42684 | 547 | 31051 | 61555, 92059, 122563, 153067, 183571 | 7563 | AE001483 | 7563 | 38067 | 68571, 99075, 129579, 160083, 190587 |
| 548 | ABC42695 | 548 | 31052 | 61556, 92060, 122564, 153068, 183572 | 7564 | AE001484 | 7564 | 38068 | 68572, 99076, 129580, 160084, 190588 |
| 549 | ABC42706 | 549 | 31053 | 61557, 92061, 122565, 153069, 183573 | 7565 | AE001485 | 7565 | 38069 | 68573, 99077, 129581, 160085, 190589 |
| 550 | ABC42717 | 550 | 31054 | 61558, 92062, 122566, 153070, 183574 | 7566 | AE001487 | 7566 | 38070 | 68574, 99078, 129582, 160086, 190590 |
| 551 | ABC42728 | 551 | 31055 | 61559, 92063, 122567, 153071, 183575 | 7567 | AE001488 | 7567 | 38071 | 68575, 99079, 129583, 160087, 190591 |

FIG. 1 continued

| | | | | | | | | | |
|---|---|---|---|---|---|---|---|---|---|
| 552 | ABC42739 | 552 | 31056 | 61560, 92064, 122568, 153072, 183576 | 7568 | AE001489 | 7568 | 38072 | 68576, 99080, 129584, 160088, 190592 |
| 553 | ABC42750 | 553 | 31057 | 61561, 92065, 122569, 153073, 183577 | 7569 | AE001490 | 7569 | 38073 | 68577, 99081, 129585, 160089, 190593 |
| 554 | ABC42761 | 554 | 31058 | 61562, 92066, 122570, 153074, 183578 | 7570 | AE001491 | 7570 | 38074 | 68578, 99082, 129586, 160090, 190594 |
| 555 | ABC42772 | 555 | 31059 | 61563, 92067, 122571, 153075, 183579 | 7571 | AE001492 | 7571 | 38075 | 68579, 99083, 129587, 160091, 190595 |
| 556 | ABC42783 | 556 | 31060 | 61564, 92068, 122572, 153076, 183580 | 7572 | AE001493 | 7572 | 38076 | 68580, 99084, 129588, 160092, 190596 |
| 557 | ABC42794 | 557 | 31061 | 61565, 92069, 122573, 153077, 183581 | 7573 | AE001494 | 7573 | 38077 | 68581, 99085, 129589, 160093, 190597 |
| 558 | ABC42805 | 558 | 31062 | 61566, 92070, 122574, 153078, 183582 | 7574 | AE001496 | 7574 | 38078 | 68582, 99086, 129590, 160094, 190598 |
| 559 | ABC42816 | 559 | 31063 | 61567, 92071, 122575, 153079, 183583 | 7575 | AE001497 | 7575 | 38079 | 68583, 99087, 129591, 160095, 190599 |
| 560 | ABC42827 | 560 | 31064 | 61568, 92072, 122576, 153080, 183584 | 7576 | AE001498 | 7576 | 38080 | 68584, 99088, 129592, 160096, 190600 |
| 561 | ABC42849 | 561 | 31065 | 61569, 92073, 122577, 153081, 183585 | 7577 | AE001499 | 7577 | 38081 | 68585, 99089, 129593, 160097, 190601 |
| 562 | ABC42882 | 562 | 31066 | 61570, 92074, 122578, 153082, 183586 | 7578 | AE001500 | 7578 | 38082 | 68586, 99090, 129594, 160098, 190602 |
| 563 | ABC42893 | 563 | 31067 | 61571, 92075, 122579, 153083, 183587 | 7579 | AE001501 | 7579 | 38083 | 68587, 99091, 129595, 160099, 190603 |
| 564 | ABC42929 | 564 | 31068 | 61572, 92076, 122580, 153084, 183588 | 7580 | AE001502 | 7580 | 38084 | 68588, 99092, 129596, 160100, 190604 |
| 565 | ABC42940 | 565 | 31069 | 61573, 92077, 122581, 153085, 183589 | 7581 | AE001503 | 7581 | 38085 | 68589, 99093, 129597, 160101, 190605 |
| 566 | ABC42951 | 566 | 31070 | 61574, 92078, 122582, 153086, 183590 | 7582 | AE001505 | 7582 | 38086 | 68590, 99094, 129598, 160102, 190606 |
| 567 | ABC42962 | 567 | 31071 | 61575, 92079, 122583, 153087, 183591 | 7583 | AE001506 | 7583 | 38087 | 68591, 99095, 129599, 160103, 190607 |
| 568 | ABC42973 | 568 | 31072 | 61576, 92080, 122584, 153088, 183592 | 7584 | AE001507 | 7584 | 38088 | 68592, 99096, 129600, 160104, 190608 |
| 569 | ABC42995 | 569 | 31073 | 61577, 92081, 122585, 153089, 183593 | 7585 | AE001508 | 7585 | 38089 | 68593, 99097, 129601, 160105, 190609 |

FIG. 1 continued

| | | | | | | | | | |
|---|---|---|---|---|---|---|---|---|---|
| 570 | ABC43006 | 570 | 31074 | 61578, 92082, 122586, 153090, 183594 | 7586 | AE001510 | 7586 | 38090 | 68594, 99098, 129602, 160106, 190610 |
| 571 | ABC43028 | 571 | 31075 | 61579, 92083, 122587, 153091, 183595 | 7587 | AE001511 | 7587 | 38091 | 68595, 99099, 129603, 160107, 190611 |
| 572 | ABC43039 | 572 | 31076 | 61580, 92084, 122588, 153092, 183596 | 7588 | AE001512 | 7588 | 38092 | 68596, 99100, 129604, 160108, 190612 |
| 573 | ABC43050 | 573 | 31077 | 61581, 92085, 122589, 153093, 183597 | 7589 | AE001513 | 7589 | 38093 | 68597, 99101, 129605, 160109, 190613 |
| 574 | ABC43061 | 574 | 31078 | 61582, 92086, 122590, 153094, 183598 | 7590 | AE001514 | 7590 | 38094 | 68598, 99102, 129606, 160110, 190614 |
| 575 | ABC43072 | 575 | 31079 | 61583, 92087, 122591, 153095, 183599 | 7591 | AE001515 | 7591 | 38095 | 68599, 99103, 129607, 160111, 190615 |
| 576 | ABC43083 | 576 | 31080 | 61584, 92088, 122592, 153096, 183600 | 7592 | AE001516 | 7592 | 38096 | 68600, 99104, 129608, 160112, 190616 |
| 577 | ABC43094 | 577 | 31081 | 61585, 92089, 122593, 153097, 183601 | 7593 | AE001517 | 7593 | 38097 | 68601, 99105, 129609, 160113, 190617 |
| 578 | ABC43116 | 578 | 31082 | 61586, 92090, 122594, 153098, 183602 | 7594 | AE001518 | 7594 | 38098 | 68602, 99106, 129610, 160114, 190618 |
| 579 | ABC43127 | 579 | 31083 | 61587, 92091, 122595, 153099, 183603 | 7595 | AE001519 | 7595 | 38099 | 68603, 99107, 129611, 160115, 190619 |
| 580 | ABC43138 | 580 | 31084 | 61588, 92092, 122596, 153100, 183604 | 7596 | AE001520 | 7596 | 38100 | 68604, 99108, 129612, 160116, 190620 |
| 581 | ABC43149 | 581 | 31085 | 61589, 92093, 122597, 153101, 183605 | 7597 | AE001521 | 7597 | 38101 | 68605, 99109, 129613, 160117, 190621 |
| 582 | ABC43160 | 582 | 31086 | 61590, 92094, 122598, 153102, 183606 | 7598 | AE001522 | 7598 | 38102 | 68606, 99110, 129614, 160118, 190622 |
| 583 | ABC43171 | 583 | 31087 | 61591, 92095, 122599, 153103, 183607 | 7599 | AE001523 | 7599 | 38103 | 68607, 99111, 129615, 160119, 190623 |
| 584 | ABC43182 | 584 | 31088 | 61592, 92096, 122600, 153104, 183608 | 7600 | AE001524 | 7600 | 38104 | 68608, 99112, 129616, 160120, 190624 |
| 585 | ABC43475 | 585 | 31089 | 61593, 92097, 122601, 153105, 183609 | 7601 | AE001525 | 7601 | 38105 | 68609, 99113, 129617, 160121, 190625 |
| 586 | ABC43486 | 586 | 31090 | 61594, 92098, 122602, 153106, 183610 | 7602 | AE001526 | 7602 | 38106 | 68610, 99114, 129618, 160122, 190626 |
| 587 | ABC43497 | 587 | 31091 | 61595, 92099, 122603, 153107, 183611 | 7603 | AE001527 | 7603 | 38107 | 68611, 99115, 129619, 160123, 190627 |

FIG. 1 continued

| | | | | |
|---|---|---|---|---|
| 588 | ABC43508 | 588 | 31092 | 61596, 92100, 122604, 153108, 183612 |
| 589 | ABC43519 | 589 | 31093 | 61597, 92101, 122605, 153109, 183613 |
| 590 | ABC43530 | 590 | 31094 | 61598, 92102, 122606, 153110, 183614 |
| 591 | ABC43552 | 591 | 31095 | 61599, 92103, 122607, 153111, 183615 |
| 592 | ABC46554 | 592 | 31096 | 61600, 92104, 122608, 153112, 183616 |
| 593 | ABC46576 | 593 | 31097 | 61601, 92105, 122609, 153113, 183617 |
| 594 | ABC50167 | 594 | 31098 | 61602, 92106, 122610, 153114, 183618 |
| 595 | ABC50178 | 595 | 31099 | 61603, 92107, 122611, 153115, 183619 |
| 596 | ABC50189 | 596 | 31100 | 61604, 92108, 122612, 153116, 183620 |
| 597 | ABC50200 | 597 | 31101 | 61605, 92109, 122613, 153117, 183621 |
| 598 | ABC50211 | 598 | 31102 | 61606, 92110, 122614, 153118, 183622 |
| 599 | ABC50222 | 599 | 31103 | 61607, 92111, 122615, 153119, 183623 |
| 600 | ABC50233 | 600 | 31104 | 61608, 92112, 122616, 153120, 183624 |
| 601 | ABC50244 | 601 | 31105 | 61609, 92113, 122617, 153121, 183625 |
| 602 | ABC50266 | 602 | 31106 | 61610, 92114, 122618, 153122, 183626 |
| 603 | ABC50277 | 603 | 31107 | 61611, 92115, 122619, 153123, 183627 |
| 604 | ABC50299 | 604 | 31108 | 61612, 92116, 122620, 153124, 183628 |
| 605 | ABC50310 | 605 | 31109 | 61613, 92117, 122621, 153125, 183629 |

| | | | | |
|---|---|---|---|---|
| 7604 | AE001529 | 7604 | 38108 | 68612, 99116, 129620, 160124, 190628 |
| 7605 | AE001530 | 7605 | 38109 | 68613, 99117, 129621, 160125, 190629 |
| 7606 | AE001531 | 7606 | 38110 | 68614, 99118, 129622, 160126, 190630 |
| 7607 | AE001532 | 7607 | 38111 | 68615, 99119, 129623, 160127, 190631 |
| 7608 | AE001533 | 7608 | 38112 | 68616, 99120, 129624, 160128, 190632 |
| 7609 | AE001534 | 7609 | 38113 | 68617, 99121, 129625, 160129, 190633 |
| 7610 | AE001535 | 7610 | 38114 | 68618, 99122, 129626, 160130, 190634 |
| 7611 | AE001536 | 7611 | 38115 | 68619, 99123, 129627, 160131, 190635 |
| 7612 | AE001537 | 7612 | 38116 | 68620, 99124, 129628, 160132, 190636 |
| 7613 | AE001538 | 7613 | 38117 | 68621, 99125, 129629, 160133, 190637 |
| 7614 | AE001539 | 7614 | 38118 | 68622, 99126, 129630, 160134, 190638 |
| 7615 | AE001540 | 7615 | 38119 | 68623, 99127, 129631, 160135, 190639 |
| 7616 | AE001541 | 7616 | 38120 | 68624, 99128, 129632, 160136, 190640 |
| 7617 | AE001542 | 7617 | 38121 | 68625, 99129, 129633, 160137, 190641 |
| 7618 | AE001543 | 7618 | 38122 | 68626, 99130, 129634, 160138, 190642 |
| 7619 | AE001544 | 7619 | 38123 | 68627, 99131, 129635, 160139, 190643 |
| 7620 | AE001545 | 7620 | 38124 | 68628, 99132, 129636, 160140, 190644 |
| 7621 | AE001546 | 7621 | 38125 | 68629, 99133, 129637, 160141, 190645 |

FIG. 1 continued

| | | | | | | | | | |
|---|---|---|---|---|---|---|---|---|---|
| 606 | ABC50321 | 606 | 31110 | 61614, 92118, 122622, 153126, 183630 | 7622 | AE001547 | 7622 | 38126 | 68630, 99134, 129638, 160142, 190646 |
| 607 | ABC50332 | 607 | 31111 | 61615, 92119, 122623, 153127, 183631 | 7623 | AE001548 | 7623 | 38127 | 68631, 99135, 129639, 160143, 190647 |
| 608 | ABC50343 | 608 | 31112 | 61616, 92120, 122624, 153128, 183632 | 7624 | AE001549 | 7624 | 38128 | 68632, 99136, 129640, 160144, 190648 |
| 609 | ABC50354 | 609 | 31113 | 61617, 92121, 122625, 153129, 183633 | 7625 | AE001550 | 7625 | 38129 | 68633, 99137, 129641, 160145, 190649 |
| 610 | ABC50376 | 610 | 31114 | 61618, 92122, 122626, 153130, 183634 | 7626 | AE001551 | 7626 | 38130 | 68634, 99138, 129642, 160146, 190650 |
| 611 | ABC50387 | 611 | 31115 | 61619, 92123, 122627, 153131, 183635 | 7627 | AE001552 | 7627 | 38131 | 68635, 99139, 129643, 160147, 190651 |
| 612 | ABC50409 | 612 | 31116 | 61620, 92124, 122628, 153132, 183636 | 7628 | AE001553 | 7628 | 38132 | 68636, 99140, 129644, 160148, 190652 |
| 613 | ABC50420 | 613 | 31117 | 61621, 92125, 122629, 153133, 183637 | 7629 | AE001554 | 7629 | 38133 | 68637, 99141, 129645, 160149, 190653 |
| 614 | ABC54668 | 614 | 31118 | 61622, 92126, 122630, 153134, 183638 | 7630 | AE001555 | 7630 | 38134 | 68638, 99142, 129646, 160150, 190654 |
| 615 | ABC54679 | 615 | 31119 | 61623, 92127, 122631, 153135, 183639 | 7631 | AE001557 | 7631 | 38135 | 68639, 99143, 129647, 160151, 190655 |
| 616 | ABC67319 | 616 | 31120 | 61624, 92128, 122632, 153136, 183640 | 7632 | AE001558 | 7632 | 38136 | 68640, 99144, 129648, 160152, 190656 |
| 617 | ABC67454 | 617 | 31121 | 61625, 92129, 122633, 153137, 183641 | 7633 | AE001559 | 7633 | 38137 | 68641, 99145, 129649, 160153, 190657 |
| 618 | ABC67471 | 618 | 31122 | 61626, 92130, 122634, 153138, 183642 | 7634 | AE001560 | 7634 | 38138 | 68642, 99146, 129650, 160154, 190658 |
| 619 | ABC67554 | 619 | 31123 | 61627, 92131, 122635, 153139, 183643 | 7635 | AE001561 | 7635 | 38139 | 68643, 99147, 129651, 160155, 190659 |
| 620 | ABC67565 | 620 | 31124 | 61628, 92132, 122636, 153140, 183644 | 7636 | AE001562 | 7636 | 38140 | 68644, 99148, 129652, 160156, 190660 |
| 621 | ABC67576 | 621 | 31125 | 61629, 92133, 122637, 153141, 183645 | 7637 | AE001563 | 7637 | 38141 | 68645, 99149, 129653, 160157, 190661 |
| 622 | ABC67587 | 622 | 31126 | 61630, 92134, 122638, 153142, 183646 | 7638 | AE001564 | 7638 | 38142 | 68646, 99150, 129654, 160158, 190662 |
| 623 | ABC67598 | 623 | 31127 | 61631, 92135, 122639, 153143, 183647 | 7639 | AE001565 | 7639 | 38143 | 68647, 99151, 129655, 160159, 190663 |

FIG. 1 continued

| | | | | | | | | | |
|---|---|---|---|---|---|---|---|---|---|
| 624 | ABC67609 | 624 | 31128 | 61632, 92136, 122640, 153144, 183648 | 7640 | AE001566 | 7640 | 38144 | 68648, 99152, 129656, 160160, 190664 |
| 625 | ABC67620 | 625 | 31129 | 61633, 92137, 122641, 153145, 183649 | 7641 | AE001567 | 7641 | 38145 | 68649, 99153, 129657, 160161, 190665 |
| 626 | ABC67631 | 626 | 31130 | 61634, 92138, 122642, 153146, 183650 | 7642 | AE001568 | 7642 | 38146 | 68650, 99154, 129658, 160162, 190666 |
| 627 | ABC67642 | 627 | 31131 | 61635, 92139, 122643, 153147, 183651 | 7643 | AE001569 | 7643 | 38147 | 68651, 99155, 129659, 160163, 190667 |
| 628 | ABC67653 | 628 | 31132 | 61636, 92140, 122644, 153148, 183652 | 7644 | AE001570 | 7644 | 38148 | 68652, 99156, 129660, 160164, 190668 |
| 629 | ABC67697 | 629 | 31133 | 61637, 92141, 122645, 153149, 183653 | 7645 | AE001571 | 7645 | 38149 | 68653, 99157, 129661, 160165, 190669 |
| 630 | ABC67708 | 630 | 31134 | 61638, 92142, 122646, 153150, 183654 | 7646 | AE001572 | 7646 | 38150 | 68654, 99158, 129662, 160166, 190670 |
| 631 | ABC67719 | 631 | 31135 | 61639, 92143, 122647, 153151, 183655 | 7647 | AE001573 | 7647 | 38151 | 68655, 99159, 129663, 160167, 190671 |
| 632 | ABC67733 | 632 | 31136 | 61640, 92144, 122648, 153152, 183656 | 7648 | AE001574 | 7648 | 38152 | 68656, 99160, 129664, 160168, 190672 |
| 633 | ABC67806 | 633 | 31137 | 61641, 92145, 122649, 153153, 183657 | 7649 | AE001575 | 7649 | 38153 | 68657, 99161, 129665, 160169, 190673 |
| 634 | ABC67817 | 634 | 31138 | 61642, 92146, 122650, 153154, 183658 | 7650 | AE001576 | 7650 | 38154 | 68658, 99162, 129666, 160170, 190674 |
| 635 | ABC67828 | 635 | 31139 | 61643, 92147, 122651, 153155, 183659 | 7651 | AE001577 | 7651 | 38155 | 68659, 99163, 129667, 160171, 190675 |
| 636 | ABC67839 | 636 | 31140 | 61644, 92148, 122652, 153156, 183660 | 7652 | AE001578 | 7652 | 38156 | 68660, 99164, 129668, 160172, 190676 |
| 637 | ABC67850 | 637 | 31141 | 61645, 92149, 122653, 153157, 183661 | 7653 | AE001579 | 7653 | 38157 | 68661, 99165, 129669, 160173, 190677 |
| 638 | ABC67861 | 638 | 31142 | 61646, 92150, 122654, 153158, 183662 | 7654 | AE001581 | 7654 | 38158 | 68662, 99166, 129670, 160174, 190678 |
| 639 | ABC67883 | 639 | 31143 | 61647, 92151, 122655, 153159, 183663 | 7655 | AE001582 | 7655 | 38159 | 68663, 99167, 129671, 160175, 190679 |
| 640 | ABC67894 | 640 | 31144 | 61648, 92152, 122656, 153160, 183664 | 7656 | AE001583 | 7656 | 38160 | 68664, 99168, 129672, 160176, 190680 |
| 641 | ABC67967 | 641 | 31145 | 61649, 92153, 122657, 153161, 183665 | 7657 | AE001584 | 7657 | 38161 | 68665, 99169, 129673, 160177, 190681 |

FIG. 1 continued

| | | | | | | | | | |
|---|---|---|---|---|---|---|---|---|---|
| 642 | ABC67978 | 642 | 31146 | 61650, 92154, 122658, 153162, 183666 | 7658 | AE001585 | 7658 | 38162 | 68666, 99170, 129674, 160178, 190682 |
| 643 | ABC67989 | 643 | 31147 | 61651, 92155, 122659, 153163, 183667 | 7659 | AE001586 | 7659 | 38163 | 68667, 99171, 129675, 160179, 190683 |
| 644 | ABC68000 | 644 | 31148 | 61652, 92156, 122660, 153164, 183668 | 7660 | AE001587 | 7660 | 38164 | 68668, 99172, 129676, 160180, 190684 |
| 645 | ABC68049 | 645 | 31149 | 61653, 92157, 122661, 153165, 183669 | 7661 | AE001588 | 7661 | 38165 | 68669, 99173, 129677, 160181, 190685 |
| 646 | ABC68060 | 646 | 31150 | 61654, 92158, 122662, 153166, 183670 | 7662 | AE001589 | 7662 | 38166 | 68670, 99174, 129678, 160182, 190686 |
| 647 | ABC68071 | 647 | 31151 | 61655, 92159, 122663, 153167, 183671 | 7663 | AE001590 | 7663 | 38167 | 68671, 99175, 129679, 160183, 190687 |
| 648 | ABC68082 | 648 | 31152 | 61656, 92160, 122664, 153168, 183672 | 7664 | AE001591 | 7664 | 38168 | 68672, 99176, 129680, 160184, 190688 |
| 649 | ABC68093 | 649 | 31153 | 61657, 92161, 122665, 153169, 183673 | 7665 | AE001592 | 7665 | 38169 | 68673, 99177, 129681, 160185, 190689 |
| 650 | ABC68222 | 650 | 31154 | 61658, 92162, 122666, 153170, 183674 | 7666 | AE001593 | 7666 | 38170 | 68674, 99178, 129682, 160186, 190690 |
| 651 | ABC68233 | 651 | 31155 | 61659, 92163, 122667, 153171, 183675 | 7667 | AE001594 | 7667 | 38171 | 68675, 99179, 129683, 160187, 190691 |
| 652 | ABC72655 | 652 | 31156 | 61660, 92164, 122668, 153172, 183676 | 7668 | AE001595 | 7668 | 38172 | 68676, 99180, 129684, 160188, 190692 |
| 653 | ABC84400 | 653 | 31157 | 61661, 92165, 122669, 153173, 183677 | 7669 | AE001596 | 7669 | 38173 | 68677, 99181, 129685, 160189, 190693 |
| 654 | ABC84411 | 654 | 31158 | 61662, 92166, 122670, 153174, 183678 | 7670 | AE001597 | 7670 | 38174 | 68678, 99182, 129686, 160190, 190694 |
| 655 | ABC84433 | 655 | 31159 | 61663, 92167, 122671, 153175, 183679 | 7671 | AE001598 | 7671 | 38175 | 68679, 99183, 129687, 160191, 190695 |
| 656 | ABC84444 | 656 | 31160 | 61664, 92168, 122672, 153176, 183680 | 7672 | AE001599 | 7672 | 38176 | 68680, 99184, 129688, 160192, 190696 |
| 657 | ABC84498 | 657 | 31161 | 61665, 92169, 122673, 153177, 183681 | 7673 | AE001600 | 7673 | 38177 | 68681, 99185, 129689, 160193, 190697 |
| 658 | ABC84509 | 658 | 31162 | 61666, 92170, 122674, 153178, 183682 | 7674 | AE001601 | 7674 | 38178 | 68682, 99186, 129690, 160194, 190698 |
| 659 | ABC84520 | 659 | 31163 | 61667, 92171, 122675, 153179, 183683 | 7675 | AE001602 | 7675 | 38179 | 68683, 99187, 129691, 160195, 190699 |

FIG. 1 continued

| | | | | | | | | | |
|---|---|---|---|---|---|---|---|---|---|
| 660 | ABC84531 | 660 | 31164 | 61668, 92172, 122676, 153180, 183684 | 7676 | AE001603 | 7676 | 38180 | 68684, 99188, 129692, 160196, 190700 |
| 661 | ABC84560 | 661 | 31165 | 61669, 92173, 122677, 153181, 183685 | 7677 | AE001604 | 7677 | 38181 | 68685, 99189, 129693, 160197, 190701 |
| 662 | ABC84571 | 662 | 31166 | 61670, 92174, 122678, 153182, 183686 | 7678 | AE001605 | 7678 | 38182 | 68686, 99190, 129694, 160198, 190702 |
| 663 | ABC85754 | 663 | 31167 | 61671, 92175, 122679, 153183, 183687 | 7679 | AE001606 | 7679 | 38183 | 68687, 99191, 129695, 160199, 190703 |
| 664 | ABC85765 | 664 | 31168 | 61672, 92176, 122680, 153184, 183688 | 7680 | AE001607 | 7680 | 38184 | 68688, 99192, 129696, 160200, 190704 |
| 665 | ABC85776 | 665 | 31169 | 61673, 92177, 122681, 153185, 183689 | 7681 | AE001608 | 7681 | 38185 | 68689, 99193, 129697, 160201, 190705 |
| 666 | ABC85787 | 666 | 31170 | 61674, 92178, 122682, 153186, 183690 | 7682 | AE001609 | 7682 | 38186 | 68690, 99194, 129698, 160202, 190706 |
| 667 | ABC85798 | 667 | 31171 | 61675, 92179, 122683, 153187, 183691 | 7683 | AE001610 | 7683 | 38187 | 68691, 99195, 129699, 160203, 190707 |
| 668 | ABC85820 | 668 | 31172 | 61676, 92180, 122684, 153188, 183692 | 7684 | AE001611 | 7684 | 38188 | 68692, 99196, 129700, 160204, 190708 |
| 669 | ABC85831 | 669 | 31173 | 61677, 92181, 122685, 153189, 183693 | 7685 | AE001612 | 7685 | 38189 | 68693, 99197, 129701, 160205, 190709 |
| 670 | ABC85842 | 670 | 31174 | 61678, 92182, 122686, 153190, 183694 | 7686 | AE001613 | 7686 | 38190 | 68694, 99198, 129702, 160206, 190710 |
| 671 | ABC85853 | 671 | 31175 | 61679, 92183, 122687, 153191, 183695 | 7687 | AE001614 | 7687 | 38191 | 68695, 99199, 129703, 160207, 190711 |
| 672 | ABC85864 | 672 | 31176 | 61680, 92184, 122688, 153192, 183696 | 7688 | AE001615 | 7688 | 38192 | 68696, 99200, 129704, 160208, 190712 |
| 673 | ABC85886 | 673 | 31177 | 61681, 92185, 122689, 153193, 183697 | 7689 | AE001616 | 7689 | 38193 | 68697, 99201, 129705, 160209, 190713 |
| 674 | ABC85908 | 674 | 31178 | 61682, 92186, 122690, 153194, 183698 | 7690 | AE001617 | 7690 | 38194 | 68698, 99202, 129706, 160210, 190714 |
| 675 | ABC85919 | 675 | 31179 | 61683, 92187, 122691, 153195, 183699 | 7691 | AE001619 | 7691 | 38195 | 68699, 99203, 129707, 160211, 190715 |
| 676 | ABC85930 | 676 | 31180 | 61684, 92188, 122692, 153196, 183700 | 7692 | AE001620 | 7692 | 38196 | 68700, 99204, 129708, 160212, 190716 |
| 677 | ABC85941 | 677 | 31181 | 61685, 92189, 122693, 153197, 183701 | 7693 | AE001621 | 7693 | 38197 | 68701, 99205, 129709, 160213, 190717 |

FIG. 1 continued

| | | | | | | | | | |
|---|---|---|---|---|---|---|---|---|---|
| 678 | ABC85952 | 678 | 31182 | 61686, 92190, 122694, 153198, 183702 | 7694 | AE001625 | 7694 | 38198 | 68702, 99206, 129710, 160214, 190718 |
| 679 | ABC85974 | 679 | 31183 | 61687, 92191, 122695, 153199, 183703 | 7695 | AE001636 | 7695 | 38199 | 68703, 99207, 129711, 160215, 190719 |
| 680 | ABC85985 | 680 | 31184 | 61688, 92192, 122696, 153200, 183704 | 7696 | AE001642 | 7696 | 38200 | 68704, 99208, 129712, 160216, 190720 |
| 681 | ABC85996 | 681 | 31185 | 61689, 92193, 122697, 153201, 183705 | 7697 | AE001663 | 7697 | 38201 | 68705, 99209, 129713, 160217, 190721 |
| 682 | ABC86007 | 682 | 31186 | 61690, 92194, 122698, 153202, 183706 | 7698 | AE001674 | 7698 | 38202 | 68706, 99210, 129714, 160218, 190722 |
| 683 | ABC86018 | 683 | 31187 | 61691, 92195, 122699, 153203, 183707 | 7699 | AE001691 | 7699 | 38203 | 68707, 99211, 129715, 160219, 190723 |
| 684 | ABC86029 | 684 | 31188 | 61692, 92196, 122700, 153204, 183708 | 7700 | AE001699 | 7700 | 38204 | 68708, 99212, 129716, 160220, 190724 |
| 685 | ABC86040 | 685 | 31189 | 61693, 92197, 122701, 153205, 183709 | 7701 | AE001709 | 7701 | 38205 | 68709, 99213, 129717, 160221, 190725 |
| 686 | ABC86124 | 686 | 31190 | 61694, 92198, 122702, 153206, 183710 | 7702 | AE037530 | 7702 | 38206 | 68710, 99214, 129718, 160222, 190726 |
| 687 | ABC86137 | 687 | 31191 | 61695, 92199, 122703, 153207, 183711 | 7703 | AE072176 | 7703 | 38207 | 68711, 99215, 129719, 160223, 190727 |
| 688 | ABC97374 | 688 | 31192 | 61696, 92200, 122704, 153208, 183712 | 7704 | AE088980 | 7704 | 38208 | 68712, 99216, 129720, 160224, 190728 |
| 689 | ABD15449 | 689 | 31193 | 61697, 92201, 122705, 153209, 183713 | 7705 | AE089021 | 7705 | 38209 | 68713, 99217, 129721, 160225, 190729 |
| 690 | ABD15460 | 690 | 31194 | 61698, 92202, 122706, 153210, 183714 | 7706 | AE089030 | 7706 | 38210 | 68714, 99218, 129722, 160226, 190730 |
| 691 | ABD15471 | 691 | 31195 | 61699, 92203, 122707, 153211, 183715 | 7707 | AE089048 | 7707 | 38211 | 68715, 99219, 129723, 160227, 190731 |
| 692 | ABD15482 | 692 | 31196 | 61700, 92204, 122708, 153212, 183716 | 7708 | AE089065 | 7708 | 38212 | 68716, 99220, 129724, 160228, 190732 |
| 693 | ABD15493 | 693 | 31197 | 61701, 92205, 122709, 153213, 183717 | 7709 | AE089082 | 7709 | 38213 | 68717, 99221, 129725, 160229, 190733 |
| 694 | ABD15526 | 694 | 31198 | 61702, 92206, 122710, 153214, 183718 | 7710 | AE089091 | 7710 | 38214 | 68718, 99222, 129726, 160230, 190734 |
| 695 | ABD15537 | 695 | 31199 | 61703, 92207, 122711, 153215, 183719 | 7711 | AE089100 | 7711 | 38215 | 68719, 99223, 129727, 160231, 190735 |

FIG. 1 continued

| | | | | | | | | | |
|---|---|---|---|---|---|---|---|---|---|
| 696 | ABD15548 | 696 | 31200 | 61704, 92208, 122712, 153216, 183720 | 7712 | AE089109 | 7712 | 38216 | 68720, 99224, 129728, 160232, 190736 |
| 697 | ABD15559 | 697 | 31201 | 61705, 92209, 122713, 153217, 183721 | 7713 | AE089127 | 7713 | 38217 | 68721, 99225, 129729, 160233, 190737 |
| 698 | ABD15570 | 698 | 31202 | 61706, 92210, 122714, 153218, 183722 | 7714 | AE089145 | 7714 | 38218 | 68722, 99226, 129730, 160234, 190738 |
| 699 | ABD15581 | 699 | 31203 | 61707, 92211, 122715, 153219, 183723 | 7715 | AE089163 | 7715 | 38219 | 68723, 99227, 129731, 160235, 190739 |
| 700 | ABD15592 | 700 | 31204 | 61708, 92212, 122716, 153220, 183724 | 7716 | AE089172 | 7716 | 38220 | 68724, 99228, 129732, 160236, 190740 |
| 701 | ABD15603 | 701 | 31205 | 61709, 92213, 122717, 153221, 183725 | 7717 | AE089181 | 7717 | 38221 | 68725, 99229, 129733, 160237, 190741 |
| 702 | ABD15614 | 702 | 31206 | 61710, 92214, 122718, 153222, 183726 | 7718 | AE089192 | 7718 | 38222 | 68726, 99230, 129734, 160238, 190742 |
| 703 | ABD15625 | 703 | 31207 | 61711, 92215, 122719, 153223, 183727 | 7719 | AE089203 | 7719 | 38223 | 68727, 99231, 129735, 160239, 190743 |
| 704 | ABD15636 | 704 | 31208 | 61712, 92216, 122720, 153224, 183728 | 7720 | AE089213 | 7720 | 38224 | 68728, 99232, 129736, 160240, 190744 |
| 705 | ABD15680 | 705 | 31209 | 61713, 92217, 122721, 153225, 183729 | 7721 | AE089224 | 7721 | 38225 | 68729, 99233, 129737, 160241, 190745 |
| 706 | ABD15691 | 706 | 31210 | 61714, 92218, 122722, 153226, 183730 | 7722 | AE089235 | 7722 | 38226 | 68730, 99234, 129738, 160242, 190746 |
| 707 | ABD15702 | 707 | 31211 | 61715, 92219, 122723, 153227, 183731 | 7723 | AE089246 | 7723 | 38227 | 68731, 99235, 129739, 160243, 190747 |
| 708 | ABD15724 | 708 | 31212 | 61716, 92220, 122724, 153228, 183732 | 7724 | AE089257 | 7724 | 38228 | 68732, 99236, 129740, 160244, 190748 |
| 709 | ABD15746 | 709 | 31213 | 61717, 92221, 122725, 153229, 183733 | 7725 | AE089268 | 7725 | 38229 | 68733, 99237, 129741, 160245, 190749 |
| 710 | ABD15757 | 710 | 31214 | 61718, 92222, 122726, 153230, 183734 | 7726 | AE089279 | 7726 | 38230 | 68734, 99238, 129742, 160246, 190750 |
| 711 | ABD15779 | 711 | 31215 | 61719, 92223, 122727, 153231, 183735 | 7727 | AE089289 | 7727 | 38231 | 68735, 99239, 129743, 160247, 190751 |
| 712 | ABD15790 | 712 | 31216 | 61720, 92224, 122728, 153232, 183736 | 7728 | AE089300 | 7728 | 38232 | 68736, 99240, 129744, 160248, 190752 |
| 713 | ABD16292 | 713 | 31217 | 61721, 92225, 122729, 153233, 183737 | 7729 | AE089311 | 7729 | 38233 | 68737, 99241, 129745, 160249, 190753 |

FIG. 1 continued

| | | | | | | | | | |
|---|---|---|---|---|---|---|---|---|---|
| 714 | ABD16303 | 714 | 31218 | 61722, 92226, 122730, 153234, 183738 | 7730 | AEQ99215 | 7730 | 38234 | 68738, 99242, 129746, 160250, 190754 |
| 715 | ABD16325 | 715 | 31219 | 61723, 92227, 122731, 153235, 183739 | 7731 | AEQ38187 | 7731 | 38235 | 68739, 99243, 129747, 160251, 190755 |
| 716 | ABD16336 | 716 | 31220 | 61724, 92228, 122732, 153236, 183740 | 7732 | AEQ38188 | 7732 | 38236 | 68740, 99244, 129748, 160252, 190756 |
| 717 | ABD16347 | 717 | 31221 | 61725, 92229, 122733, 153237, 183741 | 7733 | AEQ38189 | 7733 | 38237 | 68741, 99245, 129749, 160253, 190757 |
| 718 | ABD16358 | 718 | 31222 | 61726, 92230, 122734, 153238, 183742 | 7734 | AEQ38190 | 7734 | 38238 | 68742, 99246, 129750, 160254, 190758 |
| 719 | ABD16472 | 719 | 31223 | 61727, 92231, 122735, 153239, 183743 | 7735 | AEQ38191 | 7735 | 38239 | 68743, 99247, 129751, 160255, 190759 |
| 720 | ABD16483 | 720 | 31224 | 61728, 92232, 122736, 153240, 183744 | 7736 | AEQ38192 | 7736 | 38240 | 68744, 99248, 129752, 160256, 190760 |
| 721 | ABD16494 | 721 | 31225 | 61729, 92233, 122737, 153241, 183745 | 7737 | AEQ38193 | 7737 | 38241 | 68745, 99249, 129753, 160257, 190761 |
| 722 | ABD16505 | 722 | 31226 | 61730, 92234, 122738, 153242, 183746 | 7738 | AEQ38194 | 7738 | 38242 | 68746, 99250, 129754, 160258, 190762 |
| 723 | ABD16516 | 723 | 31227 | 61731, 92235, 122739, 153243, 183747 | 7739 | AEQ38195 | 7739 | 38243 | 68747, 99251, 129755, 160259, 190763 |
| 724 | ABD16527 | 724 | 31228 | 61732, 92236, 122740, 153244, 183748 | 7740 | AEQ38196 | 7740 | 38244 | 68748, 99252, 129756, 160260, 190764 |
| 725 | ABD16538 | 725 | 31229 | 61733, 92237, 122741, 153245, 183749 | 7741 | AEQ38197 | 7741 | 38245 | 68749, 99253, 129757, 160261, 190765 |
| 726 | ABD16549 | 726 | 31230 | 61734, 92238, 122742, 153246, 183750 | 7742 | AEQ38198 | 7742 | 38246 | 68750, 99254, 129758, 160262, 190766 |
| 727 | ABD16560 | 727 | 31231 | 61735, 92239, 122743, 153247, 183751 | 7743 | AEQ62909 | 7743 | 38247 | 68751, 99255, 129759, 160263, 190767 |
| 728 | ABD16571 | 728 | 31232 | 61736, 92240, 122744, 153248, 183752 | 7744 | AEQ62910 | 7744 | 38248 | 68752, 99256, 129760, 160264, 190768 |
| 729 | ABD16718 | 729 | 31233 | 61737, 92241, 122745, 153249, 183753 | 7745 | AEQ62911 | 7745 | 38249 | 68753, 99257, 129761, 160265, 190769 |
| 730 | ABD16729 | 730 | 31234 | 61738, 92242, 122746, 153250, 183754 | 7746 | AEQ62912 | 7746 | 38250 | 68754, 99258, 129762, 160266, 190770 |
| 731 | ABD16751 | 731 | 31235 | 61739, 92243, 122747, 153251, 183755 | 7747 | AEQ62915 | 7747 | 38251 | 68755, 99259, 129763, 160267, 190771 |

FIG. 1 continued

| | | | | | | | | | |
|---|---|---|---|---|---|---|---|---|---|
| 732 | ABD16762 | 732 | 31236 | 61740, 92244, 122748, 153252, 183756 | 7748 | AER08646 | 7748 | 38252 | 68756, 99260, 129764, 160268, 190772 |
| 733 | ABD17323 | 733 | 31237 | 61741, 92245, 122749, 153253, 183757 | 7749 | AER08648 | 7749 | 38253 | 68757, 99261, 129765, 160269, 190773 |
| 734 | ABD38134 | 734 | 31238 | 61742, 92246, 122750, 153254, 183758 | 7750 | AER08652 | 7750 | 38254 | 68758, 99262, 129766, 160270, 190774 |
| 735 | ABD60779 | 735 | 31239 | 61743, 92247, 122751, 153255, 183759 | 7751 | AER08654 | 7751 | 38255 | 68759, 99263, 129767, 160271, 190775 |
| 736 | ABD60790 | 736 | 31240 | 61744, 92248, 122752, 153256, 183760 | 7752 | AER08656 | 7752 | 38256 | 68760, 99264, 129768, 160272, 190776 |
| 737 | ABD60801 | 737 | 31241 | 61745, 92249, 122753, 153257, 183761 | 7753 | AER08660 | 7753 | 38257 | 68761, 99265, 129769, 160273, 190777 |
| 738 | ABD60812 | 738 | 31242 | 61746, 92250, 122754, 153258, 183762 | 7754 | AER08664 | 7754 | 38258 | 68762, 99266, 129770, 160274, 190778 |
| 739 | ABD60823 | 739 | 31243 | 61747, 92251, 122755, 153259, 183763 | 7755 | AER08668 | 7755 | 38259 | 68763, 99267, 129771, 160275, 190779 |
| 740 | ABD60845 | 740 | 31244 | 61748, 92252, 122756, 153260, 183764 | 7756 | AER08670 | 7756 | 38260 | 68764, 99268, 129772, 160276, 190780 |
| 741 | ABD60878 | 741 | 31245 | 61749, 92253, 122757, 153261, 183765 | 7757 | AER08672 | 7757 | 38261 | 68765, 99269, 129773, 160277, 190781 |
| 742 | ABD60889 | 742 | 31246 | 61750, 92254, 122758, 153262, 183766 | 7758 | AER08674 | 7758 | 38262 | 68766, 99270, 129774, 160278, 190782 |
| 743 | ABD60900 | 743 | 31247 | 61751, 92255, 122759, 153263, 183767 | 7759 | AER08676 | 7759 | 38263 | 68767, 99271, 129775, 160279, 190783 |
| 744 | ABD60911 | 744 | 31248 | 61752, 92256, 122760, 153264, 183768 | 7760 | AER08678 | 7760 | 38264 | 68768, 99272, 129776, 160280, 190784 |
| 745 | ABD60922 | 745 | 31249 | 61753, 92257, 122761, 153265, 183769 | 7761 | AER08680 | 7761 | 38265 | 68769, 99273, 129777, 160281, 190785 |
| 746 | ABD60933 | 746 | 31250 | 61754, 92258, 122762, 153266, 183770 | 7762 | AER08682 | 7762 | 38266 | 68770, 99274, 129778, 160282, 190786 |
| 747 | ABD60944 | 747 | 31251 | 61755, 92259, 122763, 153267, 183771 | 7763 | AER08684 | 7763 | 38267 | 68771, 99275, 129779, 160283, 190787 |
| 748 | ABD60955 | 748 | 31252 | 61756, 92260, 122764, 153268, 183772 | 7764 | AER08686 | 7764 | 38268 | 68772, 99276, 129780, 160284, 190788 |
| 749 | ABD61260 | 749 | 31253 | 61757, 92261, 122765, 153269, 183773 | 7765 | AER08688 | 7765 | 38269 | 68773, 99277, 129781, 160285, 190789 |

FIG. 1 continued

| | | | | | | | | | |
|---|---|---|---|---|---|---|---|---|---|
| 750 | ABD61271 | 750 | 31254 | 61758, 92262, 122766, 153270, 183774 | 7766 | AER08690 | 7766 | 38270 | 68774, 99278, 129782, 160286, 190790 |
| 751 | ABD61282 | 751 | 31255 | 61759, 92263, 122767, 153271, 183775 | 7767 | AER08692 | 7767 | 38271 | 68775, 99279, 129783, 160287, 190791 |
| 752 | ABD61293 | 752 | 31256 | 61760, 92264, 122768, 153272, 183776 | 7768 | AER08698 | 7768 | 38272 | 68776, 99280, 129784, 160288, 190792 |
| 753 | ABD61304 | 753 | 31257 | 61761, 92265, 122769, 153273, 183777 | 7769 | AER08700 | 7769 | 38273 | 68777, 99281, 129785, 160289, 190793 |
| 754 | ABD61315 | 754 | 31258 | 61762, 92266, 122770, 153274, 183778 | 7770 | AER92712 | 7770 | 38274 | 68778, 99282, 129786, 160290, 190794 |
| 755 | ABD61337 | 755 | 31259 | 61763, 92267, 122771, 153275, 183779 | 7771 | AET10090 | 7771 | 38275 | 68779, 99283, 129787, 160291, 190795 |
| 756 | ABD61348 | 756 | 31260 | 61764, 92268, 122772, 153276, 183780 | 7772 | AET10091 | 7772 | 38276 | 68780, 99284, 129788, 160292, 190796 |
| 757 | ABD61359 | 757 | 31261 | 61765, 92269, 122773, 153277, 183781 | 7773 | AET10092 | 7773 | 38277 | 68781, 99285, 129789, 160293, 190797 |
| 758 | ABD61370 | 758 | 31262 | 61766, 92270, 122774, 153278, 183782 | 7774 | AET10094 | 7774 | 38278 | 68782, 99286, 129790, 160294, 190798 |
| 759 | ABD61381 | 759 | 31263 | 61767, 92271, 122775, 153279, 183783 | 7775 | AET10095 | 7775 | 38279 | 68783, 99287, 129791, 160295, 190799 |
| 760 | ABD61392 | 760 | 31264 | 61768, 92272, 122776, 153280, 183784 | 7776 | AET10096 | 7776 | 38280 | 68784, 99288, 129792, 160296, 190800 |
| 761 | ABD61403 | 761 | 31265 | 61769, 92273, 122777, 153281, 183785 | 7777 | AET10098 | 7777 | 38281 | 68785, 99289, 129793, 160297, 190801 |
| 762 | ABD61529 | 762 | 31266 | 61770, 92274, 122778, 153282, 183786 | 7778 | AET10099 | 7778 | 38282 | 68786, 99290, 129794, 160298, 190802 |
| 763 | ABD61540 | 763 | 31267 | 61771, 92275, 122779, 153283, 183787 | 7779 | AET10100 | 7779 | 38283 | 68787, 99291, 129795, 160299, 190803 |
| 764 | ABD61757 | 764 | 31268 | 61772, 92276, 122780, 153284, 183788 | 7780 | AET10101 | 7780 | 38284 | 68788, 99292, 129796, 160300, 190804 |
| 765 | ABD61777 | 765 | 31269 | 61773, 92277, 122781, 153285, 183789 | 7781 | AET10102 | 7781 | 38285 | 68789, 99293, 129797, 160301, 190805 |
| 766 | ABD77598 | 766 | 31270 | 61774, 92278, 122782, 153286, 183790 | 7782 | AET10103 | 7782 | 38286 | 68790, 99294, 129798, 160302, 190806 |
| 767 | ABD77609 | 767 | 31271 | 61775, 92279, 122783, 153287, 183791 | 7783 | AET10104 | 7783 | 38287 | 68791, 99295, 129799, 160303, 190807 |

FIG. 1 continued

| | | | | | | | | | |
|---|---|---|---|---|---|---|---|---|---|
| 768 | ABD77620 | 768 | 31272 | 61776, 92280, 122784, 153288, 183792 | 7784 | AET10105 | 7784 | 38288 | 68792, 99296, 129800, 160304, 190808 |
| 769 | ABD77631 | 769 | 31273 | 61777, 92281, 122785, 153289, 183793 | 7785 | AET10106 | 7785 | 38289 | 68793, 99297, 129801, 160305, 190809 |
| 770 | ABD77642 | 770 | 31274 | 61778, 92282, 122786, 153290, 183794 | 7786 | AET10107 | 7786 | 38290 | 68794, 99298, 129802, 160306, 190810 |
| 771 | ABD77653 | 771 | 31275 | 61779, 92283, 122787, 153291, 183795 | 7787 | AET10108 | 7787 | 38291 | 68795, 99299, 129803, 160307, 190811 |
| 772 | ABD77708 | 772 | 31276 | 61780, 92284, 122788, 153292, 183796 | 7788 | AET10109 | 7788 | 38292 | 68796, 99300, 129804, 160308, 190812 |
| 773 | ABD77719 | 773 | 31277 | 61781, 92285, 122789, 153293, 183797 | 7789 | AET10110 | 7789 | 38293 | 68797, 99301, 129805, 160309, 190813 |
| 774 | ABD77730 | 774 | 31278 | 61782, 92286, 122790, 153294, 183798 | 7790 | AET10111 | 7790 | 38294 | 68798, 99302, 129806, 160310, 190814 |
| 775 | ABD77752 | 775 | 31279 | 61783, 92287, 122791, 153295, 183799 | 7791 | AET10113 | 7791 | 38295 | 68799, 99303, 129807, 160311, 190815 |
| 776 | ABD77763 | 776 | 31280 | 61784, 92288, 122792, 153296, 183800 | 7792 | AET10114 | 7792 | 38296 | 68800, 99304, 129808, 160312, 190816 |
| 777 | ABD77774 | 777 | 31281 | 61785, 92289, 122793, 153297, 183801 | 7793 | AET50439 | 7793 | 38297 | 68801, 99305, 129809, 160313, 190817 |
| 778 | ABD77785 | 778 | 31282 | 61786, 92290, 122794, 153298, 183802 | 7794 | AET50440 | 7794 | 38298 | 68802, 99306, 129810, 160314, 190818 |
| 779 | ABD77807 | 779 | 31283 | 61787, 92291, 122795, 153299, 183803 | 7795 | AET50441 | 7795 | 38299 | 68803, 99307, 129811, 160315, 190819 |
| 780 | ABD77818 | 780 | 31284 | 61788, 92292, 122796, 153300, 183804 | 7796 | AET50442 | 7796 | 38300 | 68804, 99308, 129812, 160316, 190820 |
| 781 | ABD77829 | 781 | 31285 | 61789, 92293, 122797, 153301, 183805 | 7797 | AET84163 | 7797 | 38301 | 68805, 99309, 129813, 160317, 190821 |
| 782 | ABD77862 | 782 | 31286 | 61790, 92294, 122798, 153302, 183806 | 7798 | AET84174 | 7798 | 38302 | 68806, 99310, 129814, 160318, 190822 |
| 783 | ABD77884 | 783 | 31287 | 61791, 92295, 122799, 153303, 183807 | 7799 | AET84196 | 7799 | 38303 | 68807, 99311, 129815, 160319, 190823 |
| 784 | ABD77895 | 784 | 31288 | 61792, 92296, 122800, 153304, 183808 | 7800 | AET84207 | 7800 | 38304 | 68808, 99312, 129816, 160320, 190824 |
| 785 | ABD77906 | 785 | 31289 | 61793, 92297, 122801, 153305, 183809 | 7801 | AET84218 | 7801 | 38305 | 68809, 99313, 129817, 160321, 190825 |

FIG. 1 continued

| | | | | | | | | | |
|---|---|---|---|---|---|---|---|---|---|
| 786 | ABD77917 | 786 | 31290 | 61794, 92298, 122802, 153306, 183810 | 7802 | AET84229 | 7802 | 38306 | 68810, 99314, 129818, 160322, 190826 |
| 787 | ABD77928 | 787 | 31291 | 61795, 92299, 122803, 153307, 183811 | 7803 | AET84240 | 7803 | 38307 | 68811, 99315, 129819, 160323, 190827 |
| 788 | ABD77939 | 788 | 31292 | 61796, 92300, 122804, 153308, 183812 | 7804 | AET84251 | 7804 | 38308 | 68812, 99316, 129820, 160324, 190828 |
| 789 | ABD77950 | 789 | 31293 | 61797, 92301, 122805, 153309, 183813 | 7805 | AET84262 | 7805 | 38309 | 68813, 99317, 129821, 160325, 190829 |
| 790 | ABD77961 | 790 | 31294 | 61798, 92302, 122806, 153310, 183814 | 7806 | AET84284 | 7806 | 38310 | 68814, 99318, 129822, 160326, 190830 |
| 791 | ABD77983 | 791 | 31295 | 61799, 92303, 122807, 153311, 183815 | 7807 | AET84306 | 7807 | 38311 | 68815, 99319, 129823, 160327, 190831 |
| 792 | ABD77994 | 792 | 31296 | 61800, 92304, 122808, 153312, 183816 | 7808 | AET84339 | 7808 | 38312 | 68816, 99320, 129824, 160328, 190832 |
| 793 | ABD78005 | 793 | 31297 | 61801, 92305, 122809, 153313, 183817 | 7809 | AET84361 | 7809 | 38313 | 68817, 99321, 129825, 160329, 190833 |
| 794 | ABD78016 | 794 | 31298 | 61802, 92306, 122810, 153314, 183818 | 7810 | AET84372 | 7810 | 38314 | 68818, 99322, 129826, 160330, 190834 |
| 795 | ABD78027 | 795 | 31299 | 61803, 92307, 122811, 153315, 183819 | 7811 | AET84394 | 7811 | 38315 | 68819, 99323, 129827, 160331, 190835 |
| 796 | ABD78038 | 796 | 31300 | 61804, 92308, 122812, 153316, 183820 | 7812 | AET84405 | 7812 | 38316 | 68820, 99324, 129828, 160332, 190836 |
| 797 | ABD78049 | 797 | 31301 | 61805, 92309, 122813, 153317, 183821 | 7813 | AET84416 | 7813 | 38317 | 68821, 99325, 129829, 160333, 190837 |
| 798 | ABD78060 | 798 | 31302 | 61806, 92310, 122814, 153318, 183822 | 7814 | AET84427 | 7814 | 38318 | 68822, 99326, 129830, 160334, 190838 |
| 799 | ABD78071 | 799 | 31303 | 61807, 92311, 122815, 153319, 183823 | 7815 | AET84438 | 7815 | 38319 | 68823, 99327, 129831, 160335, 190839 |
| 800 | ABD78093 | 800 | 31304 | 61808, 92312, 122816, 153320, 183824 | 7816 | AET84449 | 7816 | 38320 | 68824, 99328, 129832, 160336, 190840 |
| 801 | ABD78115 | 801 | 31305 | 61809, 92313, 122817, 153321, 183825 | 7817 | AET98600 | 7817 | 38321 | 68825, 99329, 129833, 160337, 190841 |
| 802 | ABD78126 | 802 | 31306 | 61810, 92314, 122818, 153322, 183826 | 7818 | AEV76874 | 7818 | 38322 | 68826, 99330, 129834, 160338, 190842 |
| 803 | ABD79032 | 803 | 31307 | 61811, 92315, 122819, 153323, 183827 | 7819 | AEW10574 | 7819 | 38323 | 68827, 99331, 129835, 160339, 190843 |

FIG. 1 continued

| | | | | | | | | | |
|---|---|---|---|---|---|---|---|---|---|
| 804 | ABD79112 | 804 | 31308 | 61812, 92316, 122820, 153324, 183828 | 7820 | AEW10584 | 7820 | 38324 | 68828, 99332, 129836, 160340, 190844 |
| 805 | ABD79123 | 805 | 31309 | 61813, 92317, 122821, 153325, 183829 | 7821 | AEW10594 | 7821 | 38325 | 68829, 99333, 129837, 160341, 190845 |
| 806 | ABD79134 | 806 | 31310 | 61814, 92318, 122822, 153326, 183830 | 7822 | AEW10604 | 7822 | 38326 | 68830, 99334, 129838, 160342, 190846 |
| 807 | ABD79145 | 807 | 31311 | 61815, 92319, 122823, 153327, 183831 | 7823 | AEW10614 | 7823 | 38327 | 68831, 99335, 129839, 160343, 190847 |
| 808 | ABD79156 | 808 | 31312 | 61816, 92320, 122824, 153328, 183832 | 7824 | AEW10624 | 7824 | 38328 | 68832, 99336, 129840, 160344, 190848 |
| 809 | ABD79167 | 809 | 31313 | 61817, 92321, 122825, 153329, 183833 | 7825 | AEW10634 | 7825 | 38329 | 68833, 99337, 129841, 160345, 190849 |
| 810 | ABD79178 | 810 | 31314 | 61818, 92322, 122826, 153330, 183834 | 7826 | AEW10644 | 7826 | 38330 | 68834, 99338, 129842, 160346, 190850 |
| 811 | ABD79189 | 811 | 31315 | 61819, 92323, 122827, 153331, 183835 | 7827 | AEW10654 | 7827 | 38331 | 68835, 99339, 129843, 160347, 190851 |
| 812 | ABD79200 | 812 | 31316 | 61820, 92324, 122828, 153332, 183836 | 7828 | AEW10664 | 7828 | 38332 | 68836, 99340, 129844, 160348, 190852 |
| 813 | ABD79211 | 813 | 31317 | 61821, 92325, 122829, 153333, 183837 | 7829 | AEW10674 | 7829 | 38333 | 68837, 99341, 129845, 160349, 190853 |
| 814 | ABD79222 | 814 | 31318 | 61822, 92326, 122830, 153334, 183838 | 7830 | AEW10684 | 7830 | 38334 | 68838, 99342, 129846, 160350, 190854 |
| 815 | ABD79233 | 815 | 31319 | 61823, 92327, 122831, 153335, 183839 | 7831 | AEW10694 | 7831 | 38335 | 68839, 99343, 129847, 160351, 190855 |
| 816 | ABD79244 | 816 | 31320 | 61824, 92328, 122832, 153336, 183840 | 7832 | AEW10704 | 7832 | 38336 | 68840, 99344, 129848, 160352, 190856 |
| 817 | ABD94734 | 817 | 31321 | 61825, 92329, 122833, 153337, 183841 | 7833 | AEW10724 | 7833 | 38337 | 68841, 99345, 129849, 160353, 190857 |
| 818 | ABD94745 | 818 | 31322 | 61826, 92330, 122834, 153338, 183842 | 7834 | AEW10734 | 7834 | 38338 | 68842, 99346, 129850, 160354, 190858 |
| 819 | ABD94767 | 819 | 31323 | 61827, 92331, 122835, 153339, 183843 | 7835 | AEW10744 | 7835 | 38339 | 68843, 99347, 129851, 160355, 190859 |
| 820 | ABD94778 | 820 | 31324 | 61828, 92332, 122836, 153340, 183844 | 7836 | AEW10754 | 7836 | 38340 | 68844, 99348, 129852, 160356, 190860 |
| 821 | ABD94789 | 821 | 31325 | 61829, 92333, 122837, 153341, 183845 | 7837 | AEW10764 | 7837 | 38341 | 68845, 99349, 129853, 160357, 190861 |

FIG. 1 continued

| | | | | | | | | | |
|---|---|---|---|---|---|---|---|---|---|
| 822 | ABD94822 | 822 | 31326 | 61830, 92334, 122838, 153342, 183846 | 7838 | AEW10774 | 7838 | 38342 | 68846, 99350, 129854, 160358, 190862 |
| 823 | ABD94833 | 823 | 31327 | 61831, 92335, 122839, 153343, 183847 | 7839 | AEW10784 | 7839 | 38343 | 68847, 99351, 129855, 160359, 190863 |
| 824 | ABD94844 | 824 | 31328 | 61832, 92336, 122840, 153344, 183848 | 7840 | AEW10794 | 7840 | 38344 | 68848, 99352, 129856, 160360, 190864 |
| 825 | ABD94855 | 825 | 31329 | 61833, 92337, 122841, 153345, 183849 | 7841 | AEW10804 | 7841 | 38345 | 68849, 99353, 129857, 160361, 190865 |
| 826 | ABD94866 | 826 | 31330 | 61834, 92338, 122842, 153346, 183850 | 7842 | AEW10814 | 7842 | 38346 | 68850, 99354, 129858, 160362, 190866 |
| 827 | ABD94877 | 827 | 31331 | 61835, 92339, 122843, 153347, 183851 | 7843 | AEW10824 | 7843 | 38347 | 68851, 99355, 129859, 160363, 190867 |
| 828 | ABD94888 | 828 | 31332 | 61836, 92340, 122844, 153348, 183852 | 7844 | AEW10834 | 7844 | 38348 | 68852, 99356, 129860, 160364, 190868 |
| 829 | ABD94899 | 829 | 31333 | 61837, 92341, 122845, 153349, 183853 | 7845 | AEW10844 | 7845 | 38349 | 68853, 99357, 129861, 160365, 190869 |
| 830 | ABD94910 | 830 | 31334 | 61838, 92342, 122846, 153350, 183854 | 7846 | AEW10854 | 7846 | 38350 | 68854, 99358, 129862, 160366, 190870 |
| 831 | ABD94921 | 831 | 31335 | 61839, 92343, 122847, 153351, 183855 | 7847 | AEW10864 | 7847 | 38351 | 68855, 99359, 129863, 160367, 190871 |
| 832 | ABD94932 | 832 | 31336 | 61840, 92344, 122848, 153352, 183856 | 7848 | AEW10874 | 7848 | 38352 | 68856, 99360, 129864, 160368, 190872 |
| 833 | ABD94943 | 833 | 31337 | 61841, 92345, 122849, 153353, 183857 | 7849 | AEW10884 | 7849 | 38353 | 68857, 99361, 129865, 160369, 190873 |
| 834 | ABD94954 | 834 | 31338 | 61842, 92346, 122850, 153354, 183858 | 7850 | AEW10894 | 7850 | 38354 | 68858, 99362, 129866, 160370, 190874 |
| 835 | ABD94965 | 835 | 31339 | 61843, 92347, 122851, 153355, 183859 | 7851 | AEW10904 | 7851 | 38355 | 68859, 99363, 129867, 160371, 190875 |
| 836 | ABD94987 | 836 | 31340 | 61844, 92348, 122852, 153356, 183860 | 7852 | AEW10914 | 7852 | 38356 | 68860, 99364, 129868, 160372, 190876 |
| 837 | ABD94998 | 837 | 31341 | 61845, 92349, 122853, 153357, 183861 | 7853 | AEW10924 | 7853 | 38357 | 68861, 99365, 129869, 160373, 190877 |
| 838 | ABD95009 | 838 | 31342 | 61846, 92350, 122854, 153358, 183862 | 7854 | AEW10934 | 7854 | 38358 | 68862, 99366, 129870, 160374, 190878 |
| 839 | ABD95020 | 839 | 31343 | 61847, 92351, 122855, 153359, 183863 | 7855 | AEW10944 | 7855 | 38359 | 68863, 99367, 129871, 160375, 190879 |

FIG. 1 continued

| | | | | | | | | | |
|---|---|---|---|---|---|---|---|---|---|
| 840 | ABD95031 | 840 | 31344 | 61848, 92352, 122856, 153360, 183864 | 7856 | AEW10954 | 7856 | 38360 | 68864, 99368, 129872, 160376, 190880 |
| 841 | ABD95042 | 841 | 31345 | 61849, 92353, 122857, 153361, 183865 | 7857 | AEW10964 | 7857 | 38361 | 68865, 99369, 129873, 160377, 190881 |
| 842 | ABD95053 | 842 | 31346 | 61850, 92354, 122858, 153362, 183866 | 7858 | AEW10974 | 7858 | 38362 | 68866, 99370, 129874, 160378, 190882 |
| 843 | ABD95064 | 843 | 31347 | 61851, 92355, 122859, 153363, 183867 | 7859 | AEW10984 | 7859 | 38363 | 68867, 99371, 129875, 160379, 190883 |
| 844 | ABD95075 | 844 | 31348 | 61852, 92356, 122860, 153364, 183868 | 7860 | AEW10994 | 7860 | 38364 | 68868, 99372, 129876, 160380, 190884 |
| 845 | ABD95086 | 845 | 31349 | 61853, 92357, 122861, 153365, 183869 | 7861 | AEW11004 | 7861 | 38365 | 68869, 99373, 129877, 160381, 190885 |
| 846 | ABD95097 | 846 | 31350 | 61854, 92358, 122862, 153366, 183870 | 7862 | AEW11014 | 7862 | 38366 | 68870, 99374, 129878, 160382, 190886 |
| 847 | ABD95119 | 847 | 31351 | 61855, 92359, 122863, 153367, 183871 | 7863 | AEW11024 | 7863 | 38367 | 68871, 99375, 129879, 160383, 190887 |
| 848 | ABD95130 | 848 | 31352 | 61856, 92360, 122864, 153368, 183872 | 7864 | AEW11034 | 7864 | 38368 | 68872, 99376, 129880, 160384, 190888 |
| 849 | ABD95141 | 849 | 31353 | 61857, 92361, 122865, 153369, 183873 | 7865 | AEW11044 | 7865 | 38369 | 68873, 99377, 129881, 160385, 190889 |
| 850 | ABD95152 | 850 | 31354 | 61858, 92362, 122866, 153370, 183874 | 7866 | AEW11054 | 7866 | 38370 | 68874, 99378, 129882, 160386, 190890 |
| 851 | ABD95163 | 851 | 31355 | 61859, 92363, 122867, 153371, 183875 | 7867 | AEW11064 | 7867 | 38371 | 68875, 99379, 129883, 160387, 190891 |
| 852 | ABD95174 | 852 | 31356 | 61860, 92364, 122868, 153372, 183876 | 7868 | AEW11074 | 7868 | 38372 | 68876, 99380, 129884, 160388, 190892 |
| 853 | ABD95185 | 853 | 31357 | 61861, 92365, 122869, 153373, 183877 | 7869 | AEW11084 | 7869 | 38373 | 68877, 99381, 129885, 160389, 190893 |
| 854 | ABD95196 | 854 | 31358 | 61862, 92366, 122870, 153374, 183878 | 7870 | AEW11094 | 7870 | 38374 | 68878, 99382, 129886, 160390, 190894 |
| 855 | ABD95207 | 855 | 31359 | 61863, 92367, 122871, 153375, 183879 | 7871 | AEW11104 | 7871 | 38375 | 68879, 99383, 129887, 160391, 190895 |
| 856 | ABD95218 | 856 | 31360 | 61864, 92368, 122872, 153376, 183880 | 7872 | AEW11114 | 7872 | 38376 | 68880, 99384, 129888, 160392, 190896 |
| 857 | ABD95229 | 857 | 31361 | 61865, 92369, 122873, 153377, 183881 | 7873 | AEW11124 | 7873 | 38377 | 68881, 99385, 129889, 160393, 190897 |

FIG. 1 continued

| | | | | | | | | | |
|---|---|---|---|---|---|---|---|---|---|
| 858 | ABD95240 | 858 | 31362 | 61866, 92370, 122874, 153378, 183882 | 7874 | AEW11134 | 7874 | 38378 | 68882, 99386, 129890, 160394, 190898 |
| 859 | ABD95251 | 859 | 31363 | 61867, 92371, 122875, 153379, 183883 | 7875 | AEW11144 | 7875 | 38379 | 68883, 99387, 129891, 160395, 190899 |
| 860 | ABD95262 | 860 | 31364 | 61868, 92372, 122876, 153380, 183884 | 7876 | AEW11154 | 7876 | 38380 | 68884, 99388, 129892, 160396, 190900 |
| 861 | ABD95273 | 861 | 31365 | 61869, 92373, 122877, 153381, 183885 | 7877 | AEW11164 | 7877 | 38381 | 68885, 99389, 129893, 160397, 190901 |
| 862 | ABD95284 | 862 | 31366 | 61870, 92374, 122878, 153382, 183886 | 7878 | AEW11174 | 7878 | 38382 | 68886, 99390, 129894, 160398, 190902 |
| 863 | ABD95295 | 863 | 31367 | 61871, 92375, 122879, 153383, 183887 | 7879 | AEW11184 | 7879 | 38383 | 68887, 99391, 129895, 160399, 190903 |
| 864 | ABD95306 | 864 | 31368 | 61872, 92376, 122880, 153384, 183888 | 7880 | AEW11194 | 7880 | 38384 | 68888, 99392, 129896, 160400, 190904 |
| 865 | ABD95328 | 865 | 31369 | 61873, 92377, 122881, 153385, 183889 | 7881 | AEW11204 | 7881 | 38385 | 68889, 99393, 129897, 160401, 190905 |
| 866 | ABD95339 | 866 | 31370 | 61874, 92378, 122882, 153386, 183890 | 7882 | AEW11214 | 7882 | 38386 | 68890, 99394, 129898, 160402, 190906 |
| 867 | ABE11657 | 867 | 31371 | 61875, 92379, 122883, 153387, 183891 | 7883 | AEW11224 | 7883 | 38387 | 68891, 99395, 129899, 160403, 190907 |
| 868 | ABE11668 | 868 | 31372 | 61876, 92380, 122884, 153388, 183892 | 7884 | AEW11234 | 7884 | 38388 | 68892, 99396, 129900, 160404, 190908 |
| 869 | ABE11679 | 869 | 31373 | 61877, 92381, 122885, 153389, 183893 | 7885 | AEW11244 | 7885 | 38389 | 68893, 99397, 129901, 160405, 190909 |
| 870 | ABE11690 | 870 | 31374 | 61878, 92382, 122886, 153390, 183894 | 7886 | AEW11254 | 7886 | 38390 | 68894, 99398, 129902, 160406, 190910 |
| 871 | ABE11701 | 871 | 31375 | 61879, 92383, 122887, 153391, 183895 | 7887 | AEW11263 | 7887 | 38391 | 68895, 99399, 129903, 160407, 190911 |
| 872 | ABE11712 | 872 | 31376 | 61880, 92384, 122888, 153392, 183896 | 7888 | AEW11273 | 7888 | 38392 | 68896, 99400, 129904, 160408, 190912 |
| 873 | ABE11723 | 873 | 31377 | 61881, 92385, 122889, 153393, 183897 | 7889 | AEW11283 | 7889 | 38393 | 68897, 99401, 129905, 160409, 190913 |
| 874 | ABE11734 | 874 | 31378 | 61882, 92386, 122890, 153394, 183898 | 7890 | AEW11293 | 7890 | 38394 | 68898, 99402, 129906, 160410, 190914 |
| 875 | ABE11812 | 875 | 31379 | 61883, 92387, 122891, 153395, 183899 | 7891 | AEW11303 | 7891 | 38395 | 68899, 99403, 129907, 160411, 190915 |

FIG. 1 continued

| | | | | | | | | | |
|---|---|---|---|---|---|---|---|---|---|
| 876 | ABE11823 | 876 | 31380 | 61884, 92388, 122892, 153396, 183900 | 7892 | AEW11313 | 7892 | 38396 | 68900, 99404, 129908, 160412, 190916 |
| 877 | ABE11834 | 877 | 31381 | 61885, 92389, 122893, 153397, 183901 | 7893 | AEW11323 | 7893 | 38397 | 68901, 99405, 129909, 160413, 190917 |
| 878 | ABE11845 | 878 | 31382 | 61886, 92390, 122894, 153398, 183902 | 7894 | AEW22712 | 7894 | 38398 | 68902, 99406, 129910, 160414, 190918 |
| 879 | ABE11856 | 879 | 31383 | 61887, 92391, 122895, 153399, 183903 | 7895 | AEW22718 | 7895 | 38399 | 68903, 99407, 129911, 160415, 190919 |
| 880 | ABE11900 | 880 | 31384 | 61888, 92392, 122896, 153400, 183904 | 7896 | AEW22720 | 7896 | 38400 | 68904, 99408, 129912, 160416, 190920 |
| 881 | ABE11942 | 881 | 31385 | 61889, 92393, 122897, 153401, 183905 | 7897 | AEW22722 | 7897 | 38401 | 68905, 99409, 129913, 160417, 190921 |
| 882 | ABE12078 | 882 | 31386 | 61890, 92394, 122898, 153402, 183906 | 7898 | AEW22724 | 7898 | 38402 | 68906, 99410, 129914, 160418, 190922 |
| 883 | ABE12123 | 883 | 31387 | 61891, 92395, 122899, 153403, 183907 | 7899 | AEW25297 | 7899 | 38403 | 68907, 99411, 129915, 160419, 190923 |
| 884 | ABE12248 | 884 | 31388 | 61892, 92396, 122900, 153404, 183908 | 7900 | AEW25306 | 7900 | 38404 | 68908, 99412, 129916, 160420, 190924 |
| 885 | ABE12623 | 885 | 31389 | 61893, 92397, 122901, 153405, 183909 | 7901 | AEW25315 | 7901 | 38405 | 68909, 99413, 129917, 160421, 190925 |
| 886 | ABE12645 | 886 | 31390 | 61894, 92398, 122902, 153406, 183910 | 7902 | AEW25331 | 7902 | 38406 | 68910, 99414, 129918, 160422, 190926 |
| 887 | ABE13076 | 887 | 31391 | 61895, 92399, 122903, 153407, 183911 | 7903 | AEW25349 | 7903 | 38407 | 68911, 99415, 129919, 160423, 190927 |
| 888 | ABE13323 | 888 | 31392 | 61896, 92400, 122904, 153408, 183912 | 7904 | AEW25367 | 7904 | 38408 | 68912, 99416, 129920, 160424, 190928 |
| 889 | ABE13471 | 889 | 31393 | 61897, 92401, 122905, 153409, 183913 | 7905 | AEW25377 | 7905 | 38409 | 68913, 99417, 129921, 160425, 190929 |
| 890 | ABE13555 | 890 | 31394 | 61898, 92402, 122906, 153410, 183914 | 7906 | AEW25385 | 7906 | 38410 | 68914, 99418, 129922, 160426, 190930 |
| 891 | ABE13606 | 891 | 31395 | 61899, 92403, 122907, 153411, 183915 | 7907 | AEW25416 | 7907 | 38411 | 68915, 99419, 129923, 160427, 190931 |
| 892 | ABE13628 | 892 | 31396 | 61900, 92404, 122908, 153412, 183916 | 7908 | AEW25446 | 7908 | 38412 | 68916, 99420, 129924, 160428, 190932 |
| 893 | ABE13824 | 893 | 31397 | 61901, 92405, 122909, 153413, 183917 | 7909 | AEW25454 | 7909 | 38413 | 68917, 99421, 129925, 160429, 190933 |

FIG. 1 continued

| | | | | | | | | | |
|---|---|---|---|---|---|---|---|---|---|
| 894 | ABE14019 | 894 | 31398 | 61902, 92406, 122910, 153414, 183918 | 7910 | AEW25462 | 7910 | 38414 | 68918, 99422, 129926, 160430, 190934 |
| 895 | ABE14030 | 895 | 31399 | 61903, 92407, 122911, 153415, 183919 | 7911 | AEW25472 | 7911 | 38415 | 68919, 99423, 129927, 160431, 190935 |
| 896 | ABE14041 | 896 | 31400 | 61904, 92408, 122912, 153416, 183920 | 7912 | AEW25482 | 7912 | 38416 | 68920, 99424, 129928, 160432, 190936 |
| 897 | ABE14063 | 897 | 31401 | 61905, 92409, 122913, 153417, 183921 | 7913 | AEW25492 | 7913 | 38417 | 68921, 99425, 129929, 160433, 190937 |
| 898 | ABE14124 | 898 | 31402 | 61906, 92410, 122914, 153418, 183922 | 7914 | AEW25501 | 7914 | 38418 | 68922, 99426, 129930, 160434, 190938 |
| 899 | ABE14464 | 899 | 31403 | 61907, 92411, 122915, 153419, 183923 | 7915 | AEW25509 | 7915 | 38419 | 68923, 99427, 129931, 160435, 190939 |
| 900 | ABE14840 | 900 | 31404 | 61908, 92412, 122916, 153420, 183924 | 7916 | AEW25519 | 7916 | 38420 | 68924, 99428, 129932, 160436, 190940 |
| 901 | ABE15578 | 901 | 31405 | 61909, 92413, 122917, 153421, 183925 | 7917 | AEW25528 | 7917 | 38421 | 68925, 99429, 129933, 160437, 190941 |
| 902 | ABE26991 | 902 | 31406 | 61910, 92414, 122918, 153422, 183926 | 7918 | AEW25545 | 7918 | 38422 | 68926, 99430, 129934, 160438, 190942 |
| 903 | ABF47550 | 903 | 31407 | 61911, 92415, 122919, 153423, 183927 | 7919 | AEW25555 | 7919 | 38423 | 68927, 99431, 129935, 160439, 190943 |
| 904 | ABF47561 | 904 | 31408 | 61912, 92416, 122920, 153424, 183928 | 7920 | AEW25564 | 7920 | 38424 | 68928, 99432, 129936, 160440, 190944 |
| 905 | ABF47572 | 905 | 31409 | 61913, 92417, 122921, 153425, 183929 | 7921 | AEW25573 | 7921 | 38425 | 68929, 99433, 129937, 160441, 190945 |
| 906 | ABF47583 | 906 | 31410 | 61914, 92418, 122922, 153426, 183930 | 7922 | AEW25582 | 7922 | 38426 | 68930, 99434, 129938, 160442, 190946 |
| 907 | ABF47594 | 907 | 31411 | 61915, 92419, 122923, 153427, 183931 | 7923 | AEW25590 | 7923 | 38427 | 68931, 99435, 129939, 160443, 190947 |
| 908 | ABF47605 | 908 | 31412 | 61916, 92420, 122924, 153428, 183932 | 7924 | AEW25600 | 7924 | 38428 | 68932, 99436, 129940, 160444, 190948 |
| 909 | ABF47616 | 909 | 31413 | 61917, 92421, 122925, 153429, 183933 | 7925 | AEW25620 | 7925 | 38429 | 68933, 99437, 129941, 160445, 190949 |
| 910 | ABF47627 | 910 | 31414 | 61918, 92422, 122926, 153430, 183934 | 7926 | AEW25629 | 7926 | 38430 | 68934, 99438, 129942, 160446, 190950 |
| 911 | ABF47638 | 911 | 31415 | 61919, 92423, 122927, 153431, 183935 | 7927 | AEW25637 | 7927 | 38431 | 68935, 99439, 129943, 160447, 190951 |

FIG. 1 continued

| | | | | | | | | | |
|---|---|---|---|---|---|---|---|---|---|
| 912 | ABF47649 | 912 | 31416 | 61920, 92424, 122928, 153432, 183936 | 7928 | AEW25646 | 7928 | 38432 | 68936, 99440, 129944, 160448, 190952 |
| 913 | ABF47660 | 913 | 31417 | 61921, 92425, 122929, 153433, 183937 | 7929 | AEW25654 | 7929 | 38433 | 68937, 99441, 129945, 160449, 190953 |
| 914 | ABF47671 | 914 | 31418 | 61922, 92426, 122930, 153434, 183938 | 7930 | AEW25662 | 7930 | 38434 | 68938, 99442, 129946, 160450, 190954 |
| 915 | ABF47693 | 915 | 31419 | 61923, 92427, 122931, 153435, 183939 | 7931 | AEW25669 | 7931 | 38435 | 68939, 99443, 129947, 160451, 190955 |
| 916 | ABF47704 | 916 | 31420 | 61924, 92428, 122932, 153436, 183940 | 7932 | AEW25678 | 7932 | 38436 | 68940, 99444, 129948, 160452, 190956 |
| 917 | ABF47715 | 917 | 31421 | 61925, 92429, 122933, 153437, 183941 | 7933 | AEW25687 | 7933 | 38437 | 68941, 99445, 129949, 160453, 190957 |
| 918 | ABF47726 | 918 | 31422 | 61926, 92430, 122934, 153438, 183942 | 7934 | AEW25696 | 7934 | 38438 | 68942, 99446, 129950, 160454, 190958 |
| 919 | ABF47737 | 919 | 31423 | 61927, 92431, 122935, 153439, 183943 | 7935 | AEW25706 | 7935 | 38439 | 68943, 99447, 129951, 160455, 190959 |
| 920 | ABF47748 | 920 | 31424 | 61928, 92432, 122936, 153440, 183944 | 7936 | AEW91908 | 7936 | 38440 | 68944, 99448, 129952, 160456, 190960 |
| 921 | ABF47770 | 921 | 31425 | 61929, 92433, 122937, 153441, 183945 | 7937 | AEX09175 | 7937 | 38441 | 68945, 99449, 129953, 160457, 190961 |
| 922 | ABF47781 | 922 | 31426 | 61930, 92434, 122938, 153442, 183946 | 7938 | AEX25795 | 7938 | 38442 | 68946, 99450, 129954, 160458, 190962 |
| 923 | ABF47792 | 923 | 31427 | 61931, 92435, 122939, 153443, 183947 | 7939 | AEX25797 | 7939 | 38443 | 68947, 99451, 129955, 160459, 190963 |
| 924 | ABF47803 | 924 | 31428 | 61932, 92436, 122940, 153444, 183948 | 7940 | AEX25798 | 7940 | 38444 | 68948, 99452, 129956, 160460, 190964 |
| 925 | ABF47814 | 925 | 31429 | 61933, 92437, 122941, 153445, 183949 | 7941 | AEX25800 | 7941 | 38445 | 68949, 99453, 129957, 160461, 190965 |
| 926 | ABF47825 | 926 | 31430 | 61934, 92438, 122942, 153446, 183950 | 7942 | AEX25803 | 7942 | 38446 | 68950, 99454, 129958, 160462, 190966 |
| 927 | ABF47836 | 927 | 31431 | 61935, 92439, 122943, 153447, 183951 | 7943 | AEX25808 | 7943 | 38447 | 68951, 99455, 129959, 160463, 190967 |
| 928 | ABF47847 | 928 | 31432 | 61936, 92440, 122944, 153448, 183952 | 7944 | AEX25810 | 7944 | 38448 | 68952, 99456, 129960, 160464, 190968 |
| 929 | ABF47858 | 929 | 31433 | 61937, 92441, 122945, 153449, 183953 | 7945 | AEX25811 | 7945 | 38449 | 68953, 99457, 129961, 160465, 190969 |

FIG. 1 continued

| | | | | | | | | | |
|---|---|---|---|---|---|---|---|---|---|
| 930 | ABF47869 | 930 | 31434 | 61938, 92442, 122946, 153450, 183954 | 7946 | AEX25814 | 7946 | 38450 | 68954, 99458, 129962, 160466, 190970 |
| 931 | ABF47880 | 931 | 31435 | 61939, 92443, 122947, 153451, 183955 | 7947 | AEX25816 | 7947 | 38451 | 68955, 99459, 129963, 160467, 190971 |
| 932 | ABF47891 | 932 | 31436 | 61940, 92444, 122948, 153452, 183956 | 7948 | AEX25818 | 7948 | 38452 | 68956, 99460, 129964, 160468, 190972 |
| 933 | ABF47902 | 933 | 31437 | 61941, 92445, 122949, 153453, 183957 | 7949 | AEX25824 | 7949 | 38453 | 68957, 99461, 129965, 160469, 190973 |
| 934 | ABF47955 | 934 | 31438 | 61942, 92446, 122950, 153454, 183958 | 7950 | AEX33420 | 7950 | 38454 | 68958, 99462, 129966, 160470, 190974 |
| 935 | ABF60576 | 935 | 31439 | 61943, 92447, 122951, 153455, 183959 | 7951 | AEX33453 | 7951 | 38455 | 68959, 99463, 129967, 160471, 190975 |
| 936 | ABF60577 | 936 | 31440 | 61944, 92448, 122952, 153456, 183960 | 7952 | AEX33464 | 7952 | 38456 | 68960, 99464, 129968, 160472, 190976 |
| 937 | ABF60578 | 937 | 31441 | 61945, 92449, 122953, 153457, 183961 | 7953 | AEX33475 | 7953 | 38457 | 68961, 99465, 129969, 160473, 190977 |
| 938 | ABF60579 | 938 | 31442 | 61946, 92450, 122954, 153458, 183962 | 7954 | AEX33486 | 7954 | 38458 | 68962, 99466, 129970, 160474, 190978 |
| 939 | ABF60580 | 939 | 31443 | 61947, 92451, 122955, 153459, 183963 | 7955 | AEX33497 | 7955 | 38459 | 68963, 99467, 129971, 160475, 190979 |
| 940 | ABF60581 | 940 | 31444 | 61948, 92452, 122956, 153460, 183964 | 7956 | AEX33508 | 7956 | 38460 | 68964, 99468, 129972, 160476, 190980 |
| 941 | ABF82651 | 941 | 31445 | 61949, 92453, 122957, 153461, 183965 | 7957 | AEX33519 | 7957 | 38461 | 68965, 99469, 129973, 160477, 190981 |
| 942 | ABF82662 | 942 | 31446 | 61950, 92454, 122958, 153462, 183966 | 7958 | AEX33541 | 7958 | 38462 | 68966, 99470, 129974, 160478, 190982 |
| 943 | ABF82673 | 943 | 31447 | 61951, 92455, 122959, 153463, 183967 | 7959 | AEX33574 | 7959 | 38463 | 68967, 99471, 129975, 160479, 190983 |
| 944 | ABF82684 | 944 | 31448 | 61952, 92456, 122960, 153464, 183968 | 7960 | AEX33585 | 7960 | 38464 | 68968, 99472, 129976, 160480, 190984 |
| 945 | ABF82695 | 945 | 31449 | 61953, 92457, 122961, 153465, 183969 | 7961 | AEX33596 | 7961 | 38465 | 68969, 99473, 129977, 160481, 190985 |
| 946 | ABF82706 | 946 | 31450 | 61954, 92458, 122962, 153466, 183970 | 7962 | AEX33618 | 7962 | 38466 | 68970, 99474, 129978, 160482, 190986 |
| 947 | ABF82819 | 947 | 31451 | 61955, 92459, 122963, 153467, 183971 | 7963 | AEX33629 | 7963 | 38467 | 68971, 99475, 129979, 160483, 190987 |

FIG. 1 continued

| | | | | | | | | | |
|---|---|---|---|---|---|---|---|---|---|
| 948 | ABF82830 | 948 | 31452 | 61956, 92460, 122964, 153468, 183972 | 7964 | AEX33640 | 7964 | 38468 | 68972, 99476, 129980, 160484, 190988 |
| 949 | ABF82841 | 949 | 31453 | 61957, 92461, 122965, 153469, 183973 | 7965 | AEX33836 | 7965 | 38469 | 68973, 99477, 129981, 160485, 190989 |
| 950 | ABF82852 | 950 | 31454 | 61958, 92462, 122966, 153470, 183974 | 7966 | AEX33880 | 7966 | 38470 | 68974, 99478, 129982, 160486, 190990 |
| 951 | ABF82863 | 951 | 31455 | 61959, 92463, 122967, 153471, 183975 | 7967 | AEX33913 | 7967 | 38471 | 68975, 99479, 129983, 160487, 190991 |
| 952 | ABF82874 | 952 | 31456 | 61960, 92464, 122968, 153472, 183976 | 7968 | AEX33924 | 7968 | 38472 | 68976, 99480, 129984, 160488, 190992 |
| 953 | ABF82885 | 953 | 31457 | 61961, 92465, 122969, 153473, 183977 | 7969 | AEX33957 | 7969 | 38473 | 68977, 99481, 129985, 160489, 190993 |
| 954 | ABF82896 | 954 | 31458 | 61962, 92466, 122970, 153474, 183978 | 7970 | AEX33968 | 7970 | 38474 | 68978, 99482, 129986, 160490, 190994 |
| 955 | ABF82907 | 955 | 31459 | 61963, 92467, 122971, 153475, 183979 | 7971 | AEX33979 | 7971 | 38475 | 68979, 99483, 129987, 160491, 190995 |
| 956 | ABF82929 | 956 | 31460 | 61964, 92468, 122972, 153476, 183980 | 7972 | AEX33990 | 7972 | 38476 | 68980, 99484, 129988, 160492, 190996 |
| 957 | ABF82940 | 957 | 31461 | 61965, 92469, 122973, 153477, 183981 | 7973 | AEX34001 | 7973 | 38477 | 68981, 99485, 129989, 160493, 190997 |
| 958 | ABF83447 | 958 | 31462 | 61966, 92470, 122974, 153478, 183982 | 7974 | AEX34012 | 7974 | 38478 | 68982, 99486, 129990, 160494, 190998 |
| 959 | ABG20468 | 959 | 31463 | 61967, 92471, 122975, 153479, 183983 | 7975 | AEX34023 | 7975 | 38479 | 68983, 99487, 129991, 160495, 190999 |
| 960 | ABG20472 | 960 | 31464 | 61968, 92472, 122976, 153480, 183984 | 7976 | AEX34044 | 7976 | 38480 | 68984, 99488, 129992, 160496, 191000 |
| 961 | ABG20478 | 961 | 31465 | 61969, 92473, 122977, 153481, 183985 | 7977 | AEX34089 | 7977 | 38481 | 68985, 99489, 129993, 160497, 191001 |
| 962 | ABG26758 | 962 | 31466 | 61970, 92474, 122978, 153482, 183986 | 7978 | AEX34123 | 7978 | 38482 | 68986, 99490, 129994, 160498, 191002 |
| 963 | ABG26769 | 963 | 31467 | 61971, 92475, 122979, 153483, 183987 | 7979 | AEX34134 | 7979 | 38483 | 68987, 99491, 129995, 160499, 191003 |
| 964 | ABG26780 | 964 | 31468 | 61972, 92476, 122980, 153484, 183988 | 7980 | AEX34145 | 7980 | 38484 | 68988, 99492, 129996, 160500, 191004 |
| 965 | ABG26791 | 965 | 31469 | 61973, 92477, 122981, 153485, 183989 | 7981 | AEX34156 | 7981 | 38485 | 68989, 99493, 129997, 160501, 191005 |

FIG. 1 continued

| | | | | | | | | | |
|---|---|---|---|---|---|---|---|---|---|
| 966 | ABG26802 | 966 | 31470 | 61974, 92478, 122982, 153486, 183990 | 7982 | AEX34178 | 7982 | 38486 | 68990, 99494, 129998, 160502, 191006 |
| 967 | ABG26813 | 967 | 31471 | 61975, 92479, 122983, 153487, 183991 | 7983 | AEX34188 | 7983 | 38487 | 68991, 99495, 129999, 160503, 191007 |
| 968 | ABG26824 | 968 | 31472 | 61976, 92480, 122984, 153488, 183992 | 7984 | AEX34199 | 7984 | 38488 | 68992, 99496, 130000, 160504, 191008 |
| 969 | ABG26835 | 969 | 31473 | 61977, 92481, 122985, 153489, 183993 | 7985 | AEX34221 | 7985 | 38489 | 68993, 99497, 130001, 160505, 191009 |
| 970 | ABG26890 | 970 | 31474 | 61978, 92482, 122986, 153490, 183994 | 7986 | AEX34243 | 7986 | 38490 | 68994, 99498, 130002, 160506, 191010 |
| 971 | ABG26901 | 971 | 31475 | 61979, 92483, 122987, 153491, 183995 | 7987 | AEX34254 | 7987 | 38491 | 68995, 99499, 130003, 160507, 191011 |
| 972 | ABG26912 | 972 | 31476 | 61980, 92484, 122988, 153492, 183996 | 7988 | AEX34265 | 7988 | 38492 | 68996, 99500, 130004, 160508, 191012 |
| 973 | ABG26945 | 973 | 31477 | 61981, 92485, 122989, 153493, 183997 | 7989 | AEX34275 | 7989 | 38493 | 68997, 99501, 130005, 160509, 191013 |
| 974 | ABG26956 | 974 | 31478 | 61982, 92486, 122990, 153494, 183998 | 7990 | AEX34318 | 7990 | 38494 | 68998, 99502, 130006, 160510, 191014 |
| 975 | ABG37120 | 975 | 31479 | 61983, 92487, 122991, 153495, 183999 | 7991 | AEX34329 | 7991 | 38495 | 68999, 99503, 130007, 160511, 191015 |
| 976 | ABG37131 | 976 | 31480 | 61984, 92488, 122992, 153496, 184000 | 7992 | AEX34352 | 7992 | 38496 | 69000, 99504, 130008, 160512, 191016 |
| 977 | ABG37142 | 977 | 31481 | 61985, 92489, 122993, 153497, 184001 | 7993 | AEX34364 | 7993 | 38497 | 69001, 99505, 130009, 160513, 191017 |
| 978 | ABG37164 | 978 | 31482 | 61986, 92490, 122994, 153498, 184002 | 7994 | AEX34375 | 7994 | 38498 | 69002, 99506, 130010, 160514, 191018 |
| 979 | ABG37175 | 979 | 31483 | 61987, 92491, 122995, 153499, 184003 | 7995 | AEX34386 | 7995 | 38499 | 69003, 99507, 130011, 160515, 191019 |
| 980 | ABG37186 | 980 | 31484 | 61988, 92492, 122996, 153500, 184004 | 7996 | AEX34407 | 7996 | 38500 | 69004, 99508, 130012, 160516, 191020 |
| 981 | ABG37197 | 981 | 31485 | 61989, 92493, 122997, 153501, 184005 | 7997 | AEX34440 | 7997 | 38501 | 69005, 99509, 130013, 160517, 191021 |
| 982 | ABG37208 | 982 | 31486 | 61990, 92494, 122998, 153502, 184006 | 7998 | AEX34462 | 7998 | 38502 | 69006, 99510, 130014, 160518, 191022 |
| 983 | ABG37230 | 983 | 31487 | 61991, 92495, 122999, 153503, 184007 | 7999 | AEX34473 | 7999 | 38503 | 69007, 99511, 130015, 160519, 191023 |

FIG. 1 continued

| | | | | | | | | | |
|---|---|---|---|---|---|---|---|---|---|
| 984 | ABG37241 | 984 | 31488 | 61992, 92496, 123000, 153504, 184008 | 8000 | AEX34495 | 8000 | 38504 | 69008, 99512, 130016, 160520, 191024 |
| 985 | ABG37252 | 985 | 31489 | 61993, 92497, 123001, 153505, 184009 | 8001 | AEX34506 | 8001 | 38505 | 69009, 99513, 130017, 160521, 191025 |
| 986 | ABG37263 | 986 | 31490 | 61994, 92498, 123002, 153506, 184010 | 8002 | AEX34517 | 8002 | 38506 | 69010, 99514, 130018, 160522, 191026 |
| 987 | ABG37274 | 987 | 31491 | 61995, 92499, 123003, 153507, 184011 | 8003 | AEX34528 | 8003 | 38507 | 69011, 99515, 130019, 160523, 191027 |
| 988 | ABG37285 | 988 | 31492 | 61996, 92500, 123004, 153508, 184012 | 8004 | AEX34539 | 8004 | 38508 | 69012, 99516, 130020, 160524, 191028 |
| 989 | ABG37296 | 989 | 31493 | 61997, 92501, 123005, 153509, 184013 | 8005 | AEX34550 | 8005 | 38509 | 69013, 99517, 130021, 160525, 191029 |
| 990 | ABG37307 | 990 | 31494 | 61998, 92502, 123006, 153510, 184014 | 8006 | AEX34561 | 8006 | 38510 | 69014, 99518, 130022, 160526, 191030 |
| 991 | ABG37318 | 991 | 31495 | 61999, 92503, 123007, 153511, 184015 | 8007 | AEX34572 | 8007 | 38511 | 69015, 99519, 130023, 160527, 191031 |
| 992 | ABG37329 | 992 | 31496 | 62000, 92504, 123008, 153512, 184016 | 8008 | AEX34583 | 8008 | 38512 | 69016, 99520, 130024, 160528, 191032 |
| 993 | ABG37340 | 993 | 31497 | 62001, 92505, 123009, 153513, 184017 | 8009 | AEX34594 | 8009 | 38513 | 69017, 99521, 130025, 160529, 191033 |
| 994 | ABG37351 | 994 | 31498 | 62002, 92506, 123010, 153514, 184018 | 8010 | AEX34605 | 8010 | 38514 | 69018, 99522, 130026, 160530, 191034 |
| 995 | ABG37362 | 995 | 31499 | 62003, 92507, 123011, 153515, 184019 | 8011 | AEX34616 | 8011 | 38515 | 69019, 99523, 130027, 160531, 191035 |
| 996 | ABG37384 | 996 | 31500 | 62004, 92508, 123012, 153516, 184020 | 8012 | AEX34627 | 8012 | 38516 | 69020, 99524, 130028, 160532, 191036 |
| 997 | ABG37395 | 997 | 31501 | 62005, 92509, 123013, 153517, 184021 | 8013 | AEX34638 | 8013 | 38517 | 69021, 99525, 130029, 160533, 191037 |
| 998 | ABG37406 | 998 | 31502 | 62006, 92510, 123014, 153518, 184022 | 8014 | AEX34650 | 8014 | 38518 | 69022, 99526, 130030, 160534, 191038 |
| 999 | ABG37428 | 999 | 31503 | 62007, 92511, 123015, 153519, 184023 | 8015 | AEX34661 | 8015 | 38519 | 69023, 99527, 130031, 160535, 191039 |
| 1000 | ABG37439 | 1000 | 31504 | 62008, 92512, 123016, 153520, 184024 | 8016 | AEX34672 | 8016 | 38520 | 69024, 99528, 130032, 160536, 191040 |
| 1001 | ABG37461 | 1001 | 31505 | 62009, 92513, 123017, 153521, 184025 | 8017 | AEX34683 | 8017 | 38521 | 69025, 99529, 130033, 160537, 191041 |

FIG. 1 continued

| | | | | | | | | | |
|---|---|---|---|---|---|---|---|---|---|
| 1002 | ABG37472 | 1002 | 31506 | 62010, 92514, 123018, 153522, 184026 | 8018 | AEX34757 | 8018 | 38522 | 69026, 99530, 130034, 160538, 191042 |
| 1003 | ABG37483 | 1003 | 31507 | 62011, 92515, 123019, 153523, 184027 | 8019 | AEX34768 | 8019 | 38523 | 69027, 99531, 130035, 160539, 191043 |
| 1004 | ABG37494 | 1004 | 31508 | 62012, 92516, 123020, 153524, 184028 | 8020 | AEX34779 | 8020 | 38524 | 69028, 99532, 130036, 160540, 191044 |
| 1005 | ABG37505 | 1005 | 31509 | 62013, 92517, 123021, 153525, 184029 | 8021 | AEX34790 | 8021 | 38525 | 69029, 99533, 130037, 160541, 191045 |
| 1006 | ABG37516 | 1006 | 31510 | 62014, 92518, 123022, 153526, 184030 | 8022 | AEX34801 | 8022 | 38526 | 69030, 99534, 130038, 160542, 191046 |
| 1007 | ABG37527 | 1007 | 31511 | 62015, 92519, 123023, 153527, 184031 | 8023 | AEX34812 | 8023 | 38527 | 69031, 99535, 130039, 160543, 191047 |
| 1008 | ABG37538 | 1008 | 31512 | 62016, 92520, 123024, 153528, 184032 | 8024 | AEX34834 | 8024 | 38528 | 69032, 99536, 130040, 160544, 191048 |
| 1009 | ABG37549 | 1009 | 31513 | 62017, 92521, 123025, 153529, 184033 | 8025 | AEX34845 | 8025 | 38529 | 69033, 99537, 130041, 160545, 191049 |
| 1010 | ABG37560 | 1010 | 31514 | 62018, 92522, 123026, 153530, 184034 | 8026 | AEX34856 | 8026 | 38530 | 69034, 99538, 130042, 160546, 191050 |
| 1011 | ABG37571 | 1011 | 31515 | 62019, 92523, 123027, 153531, 184035 | 8027 | AEX34867 | 8027 | 38531 | 69035, 99539, 130043, 160547, 191051 |
| 1012 | ABG37582 | 1012 | 31516 | 62020, 92524, 123028, 153532, 184036 | 8028 | AEX34878 | 8028 | 38532 | 69036, 99540, 130044, 160548, 191052 |
| 1013 | ABG37604 | 1013 | 31517 | 62021, 92525, 123029, 153533, 184037 | 8029 | AEX34889 | 8029 | 38533 | 69037, 99541, 130045, 160549, 191053 |
| 1014 | ABG37615 | 1014 | 31518 | 62022, 92526, 123030, 153534, 184038 | 8030 | AEX34900 | 8030 | 38534 | 69038, 99542, 130046, 160550, 191054 |
| 1015 | ABG47807 | 1015 | 31519 | 62023, 92527, 123031, 153535, 184039 | 8031 | AEX34911 | 8031 | 38535 | 69039, 99543, 130047, 160551, 191055 |
| 1016 | ABG47818 | 1016 | 31520 | 62024, 92528, 123032, 153536, 184040 | 8032 | AEX34922 | 8032 | 38536 | 69040, 99544, 130048, 160552, 191056 |
| 1017 | ABG47829 | 1017 | 31521 | 62025, 92529, 123033, 153537, 184041 | 8033 | AEX34933 | 8033 | 38537 | 69041, 99545, 130049, 160553, 191057 |
| 1018 | ABG47840 | 1018 | 31522 | 62026, 92530, 123034, 153538, 184042 | 8034 | AEX34944 | 8034 | 38538 | 69042, 99546, 130050, 160554, 191058 |
| 1019 | ABG47851 | 1019 | 31523 | 62027, 92531, 123035, 153539, 184043 | 8035 | AEX34955 | 8035 | 38539 | 69043, 99547, 130051, 160555, 191059 |

FIG. 1 continued

| | | | | | | | | | |
|---|---|---|---|---|---|---|---|---|---|
| 1020 | ABG47862 | 1020 | 31524 | 62028, 92532, 123036, 153540, 184044 | 8036 | AEX34966 | 8036 | 38540 | 69044, 99548, 130052, 160556, 191060 |
| 1021 | ABG47873 | 1021 | 31525 | 62029, 92533, 123037, 153541, 184045 | 8037 | AEX34977 | 8037 | 38541 | 69045, 99549, 130053, 160557, 191061 |
| 1022 | ABG47895 | 1022 | 31526 | 62030, 92534, 123038, 153542, 184046 | 8038 | AEX34988 | 8038 | 38542 | 69046, 99550, 130054, 160558, 191062 |
| 1023 | ABG47906 | 1023 | 31527 | 62031, 92535, 123039, 153543, 184047 | 8039 | AEX34999 | 8039 | 38543 | 69047, 99551, 130055, 160559, 191063 |
| 1024 | ABG47917 | 1024 | 31528 | 62032, 92536, 123040, 153544, 184048 | 8040 | AEX35010 | 8040 | 38544 | 69048, 99552, 130056, 160560, 191064 |
| 1025 | ABG47928 | 1025 | 31529 | 62033, 92537, 123041, 153545, 184049 | 8041 | AEX35032 | 8041 | 38545 | 69049, 99553, 130057, 160561, 191065 |
| 1026 | ABG47939 | 1026 | 31530 | 62034, 92538, 123042, 153546, 184050 | 8042 | AEX35043 | 8042 | 38546 | 69050, 99554, 130058, 160562, 191066 |
| 1027 | ABG47950 | 1027 | 31531 | 62035, 92539, 123043, 153547, 184051 | 8043 | AEX35054 | 8043 | 38547 | 69051, 99555, 130059, 160563, 191067 |
| 1028 | ABG47961 | 1028 | 31532 | 62036, 92540, 123044, 153548, 184052 | 8044 | AEX35065 | 8044 | 38548 | 69052, 99556, 130060, 160564, 191068 |
| 1029 | ABG47972 | 1029 | 31533 | 62037, 92541, 123045, 153549, 184053 | 8045 | AEX35076 | 8045 | 38549 | 69053, 99557, 130061, 160565, 191069 |
| 1030 | ABG47983 | 1030 | 31534 | 62038, 92542, 123046, 153550, 184054 | 8046 | AEX35087 | 8046 | 38550 | 69054, 99558, 130062, 160566, 191070 |
| 1031 | ABG47994 | 1031 | 31535 | 62039, 92543, 123047, 153551, 184055 | 8047 | AEX35098 | 8047 | 38551 | 69055, 99559, 130063, 160567, 191071 |
| 1032 | ABG48005 | 1032 | 31536 | 62040, 92544, 123048, 153552, 184056 | 8048 | AEX35109 | 8048 | 38552 | 69056, 99560, 130064, 160568, 191072 |
| 1033 | ABG48016 | 1033 | 31537 | 62041, 92545, 123049, 153553, 184057 | 8049 | AEX35120 | 8049 | 38553 | 69057, 99561, 130065, 160569, 191073 |
| 1034 | ABG48027 | 1034 | 31538 | 62042, 92546, 123050, 153554, 184058 | 8050 | AEX35131 | 8050 | 38554 | 69058, 99562, 130066, 160570, 191074 |
| 1035 | ABG48049 | 1035 | 31539 | 62043, 92547, 123051, 153555, 184059 | 8051 | AEX35142 | 8051 | 38555 | 69059, 99563, 130067, 160571, 191075 |
| 1036 | ABG48060 | 1036 | 31540 | 62044, 92548, 123052, 153556, 184060 | 8052 | AEX35153 | 8052 | 38556 | 69060, 99564, 130068, 160572, 191076 |
| 1037 | ABG48071 | 1037 | 31541 | 62045, 92549, 123053, 153557, 184061 | 8053 | AEX35164 | 8053 | 38557 | 69061, 99565, 130069, 160573, 191077 |

FIG. 1 continued

| | | | | | | | | | |
|---|---|---|---|---|---|---|---|---|---|
| 1038 | ABG48082 | 1038 | 31542 | 62046, 92550, 123054, 153558, 184062 | 8054 | AEX35175 | 8054 | 38558 | 69062, 99566, 130070, 160574, 191078 |
| 1039 | ABG48104 | 1039 | 31543 | 62047, 92551, 123055, 153559, 184063 | 8055 | AEX35186 | 8055 | 38559 | 69063, 99567, 130071, 160575, 191079 |
| 1040 | ABG48115 | 1040 | 31544 | 62048, 92552, 123056, 153560, 184064 | 8056 | AEX35197 | 8056 | 38560 | 69064, 99568, 130072, 160576, 191080 |
| 1041 | ABG48126 | 1041 | 31545 | 62049, 92553, 123057, 153561, 184065 | 8057 | AEX35208 | 8057 | 38561 | 69065, 99569, 130073, 160577, 191081 |
| 1042 | ABG48148 | 1042 | 31546 | 62050, 92554, 123058, 153562, 184066 | 8058 | AEX35219 | 8058 | 38562 | 69066, 99570, 130074, 160578, 191082 |
| 1043 | ABG48159 | 1043 | 31547 | 62051, 92555, 123059, 153563, 184067 | 8059 | AEX35230 | 8059 | 38563 | 69067, 99571, 130075, 160579, 191083 |
| 1044 | ABG48170 | 1044 | 31548 | 62052, 92556, 123060, 153564, 184068 | 8060 | AEX35241 | 8060 | 38564 | 69068, 99572, 130076, 160580, 191084 |
| 1045 | ABG48181 | 1045 | 31549 | 62053, 92557, 123061, 153565, 184069 | 8061 | AEX35263 | 8061 | 38565 | 69069, 99573, 130077, 160581, 191085 |
| 1046 | ABG48192 | 1046 | 31550 | 62054, 92558, 123062, 153566, 184070 | 8062 | AEX35274 | 8062 | 38566 | 69070, 99574, 130078, 160582, 191086 |
| 1047 | ABG48203 | 1047 | 31551 | 62055, 92559, 123063, 153567, 184071 | 8063 | AEX35285 | 8063 | 38567 | 69071, 99575, 130079, 160583, 191087 |
| 1048 | ABG48214 | 1048 | 31552 | 62056, 92560, 123064, 153568, 184072 | 8064 | AEX35296 | 8064 | 38568 | 69072, 99576, 130080, 160584, 191088 |
| 1049 | ABG48236 | 1049 | 31553 | 62057, 92561, 123065, 153569, 184073 | 8065 | AEX35307 | 8065 | 38569 | 69073, 99577, 130081, 160585, 191089 |
| 1050 | ABG48247 | 1050 | 31554 | 62058, 92562, 123066, 153570, 184074 | 8066 | AEX35318 | 8066 | 38570 | 69074, 99578, 130082, 160586, 191090 |
| 1051 | ABG48269 | 1051 | 31555 | 62059, 92563, 123067, 153571, 184075 | 8067 | AEX35329 | 8067 | 38571 | 69075, 99579, 130083, 160587, 191091 |
| 1052 | ABG48291 | 1052 | 31556 | 62060, 92564, 123068, 153572, 184076 | 8068 | AEX35340 | 8068 | 38572 | 69076, 99580, 130084, 160588, 191092 |
| 1053 | ABG48335 | 1053 | 31557 | 62061, 92565, 123069, 153573, 184077 | 8069 | AEX35351 | 8069 | 38573 | 69077, 99581, 130085, 160589, 191093 |
| 1054 | ABG48346 | 1054 | 31558 | 62062, 92566, 123070, 153574, 184078 | 8070 | AEX35362 | 8070 | 38574 | 69078, 99582, 130086, 160590, 191094 |
| 1055 | ABG48357 | 1055 | 31559 | 62063, 92567, 123071, 153575, 184079 | 8071 | AEX35373 | 8071 | 38575 | 69079, 99583, 130087, 160591, 191095 |

FIG. 1 continued

| | | | | | | | | | |
|---|---|---|---|---|---|---|---|---|---|
| 1056 | ABG48368 | 1056 | 31560 | 62064, 92568, 123072, 153576, 184080 | 8072 | AEX35384 | 8072 | 38576 | 69080, 99584, 130088, 160592, 191096 |
| 1057 | ABG67135 | 1057 | 31561 | 62065, 92569, 123073, 153577, 184081 | 8073 | AEX35395 | 8073 | 38577 | 69081, 99585, 130089, 160593, 191097 |
| 1058 | ABG67146 | 1058 | 31562 | 62066, 92570, 123074, 153578, 184082 | 8074 | AEX35406 | 8074 | 38578 | 69082, 99586, 130090, 160594, 191098 |
| 1059 | ABG67157 | 1059 | 31563 | 62067, 92571, 123075, 153579, 184083 | 8075 | AEX35417 | 8075 | 38579 | 69083, 99587, 130091, 160595, 191099 |
| 1060 | ABG67168 | 1060 | 31564 | 62068, 92572, 123076, 153580, 184084 | 8076 | AEX35428 | 8076 | 38580 | 69084, 99588, 130092, 160596, 191100 |
| 1061 | ABG67179 | 1061 | 31565 | 62069, 92573, 123077, 153581, 184085 | 8077 | AEX35439 | 8077 | 38581 | 69085, 99589, 130093, 160597, 191101 |
| 1062 | ABG67190 | 1062 | 31566 | 62070, 92574, 123078, 153582, 184086 | 8078 | AEX35450 | 8078 | 38582 | 69086, 99590, 130094, 160598, 191102 |
| 1063 | ABG67212 | 1063 | 31567 | 62071, 92575, 123079, 153583, 184087 | 8079 | AEX35461 | 8079 | 38583 | 69087, 99591, 130095, 160599, 191103 |
| 1064 | ABG67223 | 1064 | 31568 | 62072, 92576, 123080, 153584, 184088 | 8080 | AEX35472 | 8080 | 38584 | 69088, 99592, 130096, 160600, 191104 |
| 1065 | ABG67234 | 1065 | 31569 | 62073, 92577, 123081, 153585, 184089 | 8081 | AEX35483 | 8081 | 38585 | 69089, 99593, 130097, 160601, 191105 |
| 1066 | ABG67245 | 1066 | 31570 | 62074, 92578, 123082, 153586, 184090 | 8082 | AEX35494 | 8082 | 38586 | 69090, 99594, 130098, 160602, 191106 |
| 1067 | ABG67477 | 1067 | 31571 | 62075, 92579, 123083, 153587, 184091 | 8083 | AEX35505 | 8083 | 38587 | 69091, 99595, 130099, 160603, 191107 |
| 1068 | ABG67491 | 1068 | 31572 | 62076, 92580, 123084, 153588, 184092 | 8084 | AEX35516 | 8084 | 38588 | 69092, 99596, 130100, 160604, 191108 |
| 1069 | ABG67502 | 1069 | 31573 | 62077, 92581, 123085, 153589, 184093 | 8085 | AEX35527 | 8085 | 38589 | 69093, 99597, 130101, 160605, 191109 |
| 1070 | ABG67524 | 1070 | 31574 | 62078, 92582, 123086, 153590, 184094 | 8086 | AEX35549 | 8086 | 38590 | 69094, 99598, 130102, 160606, 191110 |
| 1071 | ABG67535 | 1071 | 31575 | 62079, 92583, 123087, 153591, 184095 | 8087 | AEX35560 | 8087 | 38591 | 69095, 99599, 130103, 160607, 191111 |
| 1072 | ABG67546 | 1072 | 31576 | 62080, 92584, 123088, 153592, 184096 | 8088 | AEX35571 | 8088 | 38592 | 69096, 99600, 130104, 160608, 191112 |
| 1073 | ABG67557 | 1073 | 31577 | 62081, 92585, 123089, 153593, 184097 | 8089 | AEX35582 | 8089 | 38593 | 69097, 99601, 130105, 160609, 191113 |

FIG. 1 continued

| | | | | | | | | | |
|---|---|---|---|---|---|---|---|---|---|
| 1074 | ABG67568 | 1074 | 31578 | 62082, 92586, 123090, 153594, 184098 | 8090 | AEX35593 | 8090 | 38594 | 69098, 99602, 130106, 160610, 191114 |
| 1075 | ABG67579 | 1075 | 31579 | 62083, 92587, 123091, 153595, 184099 | 8091 | AEX35604 | 8091 | 38595 | 69099, 99603, 130107, 160611, 191115 |
| 1076 | ABG67590 | 1076 | 31580 | 62084, 92588, 123092, 153596, 184100 | 8092 | AEX35615 | 8092 | 38596 | 69100, 99604, 130108, 160612, 191116 |
| 1077 | ABG67601 | 1077 | 31581 | 62085, 92589, 123093, 153597, 184101 | 8093 | AEX35626 | 8093 | 38597 | 69101, 99605, 130109, 160613, 191117 |
| 1078 | ABG67612 | 1078 | 31582 | 62086, 92590, 123094, 153598, 184102 | 8094 | AEX35637 | 8094 | 38598 | 69102, 99606, 130110, 160614, 191118 |
| 1079 | ABG67623 | 1079 | 31583 | 62087, 92591, 123095, 153599, 184103 | 8095 | AEX35648 | 8095 | 38599 | 69103, 99607, 130111, 160615, 191119 |
| 1080 | ABG67634 | 1080 | 31584 | 62088, 92592, 123096, 153600, 184104 | 8096 | AEX36102 | 8096 | 38600 | 69104, 99608, 130112, 160616, 191120 |
| 1081 | ABG67645 | 1081 | 31585 | 62089, 92593, 123097, 153601, 184105 | 8097 | AEX36113 | 8097 | 38601 | 69105, 99609, 130113, 160617, 191121 |
| 1082 | ABG67656 | 1082 | 31586 | 62090, 92594, 123098, 153602, 184106 | 8098 | AEX36124 | 8098 | 38602 | 69106, 99610, 130114, 160618, 191122 |
| 1083 | ABG67667 | 1083 | 31587 | 62091, 92595, 123099, 153603, 184107 | 8099 | AEX36146 | 8099 | 38603 | 69107, 99611, 130115, 160619, 191123 |
| 1084 | ABG79941 | 1084 | 31588 | 62092, 92596, 123100, 153604, 184108 | 8100 | AEX36168 | 8100 | 38604 | 69108, 99612, 130116, 160620, 191124 |
| 1085 | ABG79952 | 1085 | 31589 | 62093, 92597, 123101, 153605, 184109 | 8101 | AEX36179 | 8101 | 38605 | 69109, 99613, 130117, 160621, 191125 |
| 1086 | ABG79974 | 1086 | 31590 | 62094, 92598, 123102, 153606, 184110 | 8102 | AEX36190 | 8102 | 38606 | 69110, 99614, 130118, 160622, 191126 |
| 1087 | ABG79985 | 1087 | 31591 | 62095, 92599, 123103, 153607, 184111 | 8103 | AEX36201 | 8103 | 38607 | 69111, 99615, 130119, 160623, 191127 |
| 1088 | ABG79996 | 1088 | 31592 | 62096, 92600, 123104, 153608, 184112 | 8104 | AEX36212 | 8104 | 38608 | 69112, 99616, 130120, 160624, 191128 |
| 1089 | ABG80007 | 1089 | 31593 | 62097, 92601, 123105, 153609, 184113 | 8105 | AEX36223 | 8105 | 38609 | 69113, 99617, 130121, 160625, 191129 |
| 1090 | ABG80018 | 1090 | 31594 | 62098, 92602, 123106, 153610, 184114 | 8106 | AEX36234 | 8106 | 38610 | 69114, 99618, 130122, 160626, 191130 |
| 1091 | ABG80029 | 1091 | 31595 | 62099, 92603, 123107, 153611, 184115 | 8107 | AEX36245 | 8107 | 38611 | 69115, 99619, 130123, 160627, 191131 |

FIG. 1 continued

| | | | | | | | | | |
|---|---|---|---|---|---|---|---|---|---|
| 1092 | ABG80040 | 1092 | 31596 | 62100, 92604, 123108, 153612, 184116 | 8108 | AEX36256 | 8108 | 38612 | 69116, 99620, 130124, 160628, 191132 |
| 1093 | ABG80051 | 1093 | 31597 | 62101, 92605, 123109, 153613, 184117 | 8109 | AEX36267 | 8109 | 38613 | 69117, 99621, 130125, 160629, 191133 |
| 1094 | ABG80062 | 1094 | 31598 | 62102, 92606, 123110, 153614, 184118 | 8110 | AEX36289 | 8110 | 38614 | 69118, 99622, 130126, 160630, 191134 |
| 1095 | ABG80073 | 1095 | 31599 | 62103, 92607, 123111, 153615, 184119 | 8111 | AEX36300 | 8111 | 38615 | 69119, 99623, 130127, 160631, 191135 |
| 1096 | ABG80084 | 1096 | 31600 | 62104, 92608, 123112, 153616, 184120 | 8112 | AEX36311 | 8112 | 38616 | 69120, 99624, 130128, 160632, 191136 |
| 1097 | ABG80095 | 1097 | 31601 | 62105, 92609, 123113, 153617, 184121 | 8113 | AEX36322 | 8113 | 38617 | 69121, 99625, 130129, 160633, 191137 |
| 1098 | ABG80106 | 1098 | 31602 | 62106, 92610, 123114, 153618, 184122 | 8114 | AEX36333 | 8114 | 38618 | 69122, 99626, 130130, 160634, 191138 |
| 1099 | ABG80117 | 1099 | 31603 | 62107, 92611, 123115, 153619, 184123 | 8115 | AEX36344 | 8115 | 38619 | 69123, 99627, 130131, 160635, 191139 |
| 1100 | ABG80128 | 1100 | 31604 | 62108, 92612, 123116, 153620, 184124 | 8116 | AEX36366 | 8116 | 38620 | 69124, 99628, 130132, 160636, 191140 |
| 1101 | ABG80139 | 1101 | 31605 | 62109, 92613, 123117, 153621, 184125 | 8117 | AEX36377 | 8117 | 38621 | 69125, 99629, 130133, 160637, 191141 |
| 1102 | ABG80150 | 1102 | 31606 | 62110, 92614, 123118, 153622, 184126 | 8118 | AEX36388 | 8118 | 38622 | 69126, 99630, 130134, 160638, 191142 |
| 1103 | ABG80161 | 1103 | 31607 | 62111, 92615, 123119, 153623, 184127 | 8119 | AEX36399 | 8119 | 38623 | 69127, 99631, 130135, 160639, 191143 |
| 1104 | ABG80172 | 1104 | 31608 | 62112, 92616, 123120, 153624, 184128 | 8120 | AEX36410 | 8120 | 38624 | 69128, 99632, 130136, 160640, 191144 |
| 1105 | ABG80183 | 1105 | 31609 | 62113, 92617, 123121, 153625, 184129 | 8121 | AEX36421 | 8121 | 38625 | 69129, 99633, 130137, 160641, 191145 |
| 1106 | ABG80194 | 1106 | 31610 | 62114, 92618, 123122, 153626, 184130 | 8122 | AEX36432 | 8122 | 38626 | 69130, 99634, 130138, 160642, 191146 |
| 1107 | ABG80205 | 1107 | 31611 | 62115, 92619, 123123, 153627, 184131 | 8123 | AEX36443 | 8123 | 38627 | 69131, 99635, 130139, 160643, 191147 |
| 1108 | ABG80216 | 1108 | 31612 | 62116, 92620, 123124, 153628, 184132 | 8124 | AEX36454 | 8124 | 38628 | 69132, 99636, 130140, 160644, 191148 |
| 1109 | ABG80227 | 1109 | 31613 | 62117, 92621, 123125, 153629, 184133 | 8125 | AEX36465 | 8125 | 38629 | 69133, 99637, 130141, 160645, 191149 |

FIG. 1 continued

| | | | | | | | | | |
|---|---|---|---|---|---|---|---|---|---|
| 1110 | ABG80238 | 1110 | 31614 | 62118, 92622, 123126, 153630, 184134 | 8126 | AEX36476 | 8126 | 38630 | 69134, 99638, 130142, 160646, 191150 |
| 1111 | ABG80249 | 1111 | 31615 | 62119, 92623, 123127, 153631, 184135 | 8127 | AEX36487 | 8127 | 38631 | 69135, 99639, 130143, 160647, 191151 |
| 1112 | ABG80260 | 1112 | 31616 | 62120, 92624, 123128, 153632, 184136 | 8128 | AEX36498 | 8128 | 38632 | 69136, 99640, 130144, 160648, 191152 |
| 1113 | ABG80271 | 1113 | 31617 | 62121, 92625, 123129, 153633, 184137 | 8129 | AEX36509 | 8129 | 38633 | 69137, 99641, 130145, 160649, 191153 |
| 1114 | ABG80282 | 1114 | 31618 | 62122, 92626, 123130, 153634, 184138 | 8130 | AEX36520 | 8130 | 38634 | 69138, 99642, 130146, 160650, 191154 |
| 1115 | ABG80293 | 1115 | 31619 | 62123, 92627, 123131, 153635, 184139 | 8131 | AEX36531 | 8131 | 38635 | 69139, 99643, 130147, 160651, 191155 |
| 1116 | ABG80304 | 1116 | 31620 | 62124, 92628, 123132, 153636, 184140 | 8132 | AEX36542 | 8132 | 38636 | 69140, 99644, 130148, 160652, 191156 |
| 1117 | ABG80315 | 1117 | 31621 | 62125, 92629, 123133, 153637, 184141 | 8133 | AEX36553 | 8133 | 38637 | 69141, 99645, 130149, 160653, 191157 |
| 1118 | ABG80326 | 1118 | 31622 | 62126, 92630, 123134, 153638, 184142 | 8134 | AEX36564 | 8134 | 38638 | 69142, 99646, 130150, 160654, 191158 |
| 1119 | ABG80337 | 1119 | 31623 | 62127, 92631, 123135, 153639, 184143 | 8135 | AEX36575 | 8135 | 38639 | 69143, 99647, 130151, 160655, 191159 |
| 1120 | ABG80359 | 1120 | 31624 | 62128, 92632, 123136, 153640, 184144 | 8136 | AEX36586 | 8136 | 38640 | 69144, 99648, 130152, 160656, 191160 |
| 1121 | ABG80370 | 1121 | 31625 | 62129, 92633, 123137, 153641, 184145 | 8137 | AEX36597 | 8137 | 38641 | 69145, 99649, 130153, 160657, 191161 |
| 1122 | ABG80392 | 1122 | 31626 | 62130, 92634, 123138, 153642, 184146 | 8138 | AEX36608 | 8138 | 38642 | 69146, 99650, 130154, 160658, 191162 |
| 1123 | ABG80403 | 1123 | 31627 | 62131, 92635, 123139, 153643, 184147 | 8139 | AEX36619 | 8139 | 38643 | 69147, 99651, 130155, 160659, 191163 |
| 1124 | ABG80414 | 1124 | 31628 | 62132, 92636, 123140, 153644, 184148 | 8140 | AEX63617 | 8140 | 38644 | 69148, 99652, 130156, 160660, 191164 |
| 1125 | ABG80425 | 1125 | 31629 | 62133, 92637, 123141, 153645, 184149 | 8141 | AEX92873 | 8141 | 38645 | 69149, 99653, 130157, 160661, 191165 |
| 1126 | ABG88289 | 1126 | 31630 | 62134, 92638, 123142, 153646, 184150 | 8142 | AEY69088 | 8142 | 38646 | 69150, 99654, 130158, 160662, 191166 |
| 1127 | ABG88300 | 1127 | 31631 | 62135, 92639, 123143, 153647, 184151 | 8143 | AEY69098 | 8143 | 38647 | 69151, 99655, 130159, 160663, 191167 |

FIG. 1 continued

| | | | | | | | | | |
|---|---|---|---|---|---|---|---|---|---|
| 1128 | ABG88311 | 1128 | 31632 | 62136, 92640, 123144, 153648, 184152 | 8144 | AEY69120 | 8144 | 38648 | 69152, 99656, 130160, 160664, 191168 |
| 1129 | ABG88322 | 1129 | 31633 | 62137, 92641, 123145, 153649, 184153 | 8145 | AEY69131 | 8145 | 38649 | 69153, 99657, 130161, 160665, 191169 |
| 1130 | ABG88333 | 1130 | 31634 | 62138, 92642, 123146, 153650, 184154 | 8146 | AEY69153 | 8146 | 38650 | 69154, 99658, 130162, 160666, 191170 |
| 1131 | ABG88344 | 1131 | 31635 | 62139, 92643, 123147, 153651, 184155 | 8147 | AEY69164 | 8147 | 38651 | 69155, 99659, 130163, 160667, 191171 |
| 1132 | ABG88355 | 1132 | 31636 | 62140, 92644, 123148, 153652, 184156 | 8148 | AEY69175 | 8148 | 38652 | 69156, 99660, 130164, 160668, 191172 |
| 1133 | ABG88366 | 1133 | 31637 | 62141, 92645, 123149, 153653, 184157 | 8149 | AEY69186 | 8149 | 38653 | 69157, 99661, 130165, 160669, 191173 |
| 1134 | ABG88377 | 1134 | 31638 | 62142, 92646, 123150, 153654, 184158 | 8150 | AEY69197 | 8150 | 38654 | 69158, 99662, 130166, 160670, 191174 |
| 1135 | ABG88388 | 1135 | 31639 | 62143, 92647, 123151, 153655, 184159 | 8151 | AEY69208 | 8151 | 38655 | 69159, 99663, 130167, 160671, 191175 |
| 1136 | ABG88399 | 1136 | 31640 | 62144, 92648, 123152, 153656, 184160 | 8152 | AEY69219 | 8152 | 38656 | 69160, 99664, 130168, 160672, 191176 |
| 1137 | ABG88410 | 1137 | 31641 | 62145, 92649, 123153, 153657, 184161 | 8153 | AEY69258 | 8153 | 38657 | 69161, 99665, 130169, 160673, 191177 |
| 1138 | ABG88421 | 1138 | 31642 | 62146, 92650, 123154, 153658, 184162 | 8154 | AEY69269 | 8154 | 38658 | 69162, 99666, 130170, 160674, 191178 |
| 1139 | ABG88432 | 1139 | 31643 | 62147, 92651, 123155, 153659, 184163 | 8155 | AEY69291 | 8155 | 38659 | 69163, 99667, 130171, 160675, 191179 |
| 1140 | ABG88443 | 1140 | 31644 | 62148, 92652, 123156, 153660, 184164 | 8156 | AEY69302 | 8156 | 38660 | 69164, 99668, 130172, 160676, 191180 |
| 1141 | ABG88454 | 1141 | 31645 | 62149, 92653, 123157, 153661, 184165 | 8157 | AEY69313 | 8157 | 38661 | 69165, 99669, 130173, 160677, 191181 |
| 1142 | ABG88465 | 1142 | 31646 | 62150, 92654, 123158, 153662, 184166 | 8158 | AEY69785 | 8158 | 38662 | 69166, 99670, 130174, 160678, 191182 |
| 1143 | ABG88476 | 1143 | 31647 | 62151, 92655, 123159, 153663, 184167 | 8159 | AEY69807 | 8159 | 38663 | 69167, 99671, 130175, 160679, 191183 |
| 1144 | ABG88487 | 1144 | 31648 | 62152, 92656, 123160, 153664, 184168 | 8160 | AEY69818 | 8160 | 38664 | 69168, 99672, 130176, 160680, 191184 |
| 1145 | ABG88498 | 1145 | 31649 | 62153, 92657, 123161, 153665, 184169 | 8161 | AEY69829 | 8161 | 38665 | 69169, 99673, 130177, 160681, 191185 |

FIG. 1 continued

| | | | | | | | | | |
|---|---|---|---|---|---|---|---|---|---|
| 1146 | ABG88509 | 1146 | 31650 | 62154, 92658, 123162, 153666, 184170 | 8162 | AEY69840 | 8162 | 38666 | 69170, 99674, 130178, 160682, 191186 |
| 1147 | ABG88520 | 1147 | 31651 | 62155, 92659, 123163, 153667, 184171 | 8163 | AEY69851 | 8163 | 38667 | 69171, 99675, 130179, 160683, 191187 |
| 1148 | ABG88531 | 1148 | 31652 | 62156, 92660, 123164, 153668, 184172 | 8164 | AEY69873 | 8164 | 38668 | 69172, 99676, 130180, 160684, 191188 |
| 1149 | ABG88553 | 1149 | 31653 | 62157, 92661, 123165, 153669, 184173 | 8165 | AEY69884 | 8165 | 38669 | 69173, 99677, 130181, 160685, 191189 |
| 1150 | ABG88564 | 1150 | 31654 | 62158, 92662, 123166, 153670, 184174 | 8166 | AEY69895 | 8166 | 38670 | 69174, 99678, 130182, 160686, 191190 |
| 1151 | ABG88575 | 1151 | 31655 | 62159, 92663, 123167, 153671, 184175 | 8167 | AEY69906 | 8167 | 38671 | 69175, 99679, 130183, 160687, 191191 |
| 1152 | ABG88586 | 1152 | 31656 | 62160, 92664, 123168, 153672, 184176 | 8168 | AEY69917 | 8168 | 38672 | 69176, 99680, 130184, 160688, 191192 |
| 1153 | ABG88597 | 1153 | 31657 | 62161, 92665, 123169, 153673, 184177 | 8169 | AEY69939 | 8169 | 38673 | 69177, 99681, 130185, 160689, 191193 |
| 1154 | ABG88608 | 1154 | 31658 | 62162, 92666, 123170, 153674, 184178 | 8170 | AEY69950 | 8170 | 38674 | 69178, 99682, 130186, 160690, 191194 |
| 1155 | ABG88619 | 1155 | 31659 | 62163, 92667, 123171, 153675, 184179 | 8171 | AEY69961 | 8171 | 38675 | 69179, 99683, 130187, 160691, 191195 |
| 1156 | ABG88630 | 1156 | 31660 | 62164, 92668, 123172, 153676, 184180 | 8172 | AEY69994 | 8172 | 38676 | 69180, 99684, 130188, 160692, 191196 |
| 1157 | ABG88641 | 1157 | 31661 | 62165, 92669, 123173, 153677, 184181 | 8173 | AEY70005 | 8173 | 38677 | 69181, 99685, 130189, 160693, 191197 |
| 1158 | ABG88652 | 1158 | 31662 | 62166, 92670, 123174, 153678, 184182 | 8174 | AEY70016 | 8174 | 38678 | 69182, 99686, 130190, 160694, 191198 |
| 1159 | ABG88663 | 1159 | 31663 | 62167, 92671, 123175, 153679, 184183 | 8175 | AEY70256 | 8175 | 38679 | 69183, 99687, 130191, 160695, 191199 |
| 1160 | ABG88674 | 1160 | 31664 | 62168, 92672, 123176, 153680, 184184 | 8176 | AEY70267 | 8176 | 38680 | 69184, 99688, 130192, 160696, 191200 |
| 1161 | ABG88685 | 1161 | 31665 | 62169, 92673, 123177, 153681, 184185 | 8177 | AEY70278 | 8177 | 38681 | 69185, 99689, 130193, 160697, 191201 |
| 1162 | ABG88696 | 1162 | 31666 | 62170, 92674, 123178, 153682, 184186 | 8178 | AEY70289 | 8178 | 38682 | 69186, 99690, 130194, 160698, 191202 |
| 1163 | ABG88707 | 1163 | 31667 | 62171, 92675, 123179, 153683, 184187 | 8179 | AEY70300 | 8179 | 38683 | 69187, 99691, 130195, 160699, 191203 |

FIG. 1 continued

| | | | | | | | | | |
|---|---|---|---|---|---|---|---|---|---|
| 1164 | ABG88718 | 1164 | 31668 | 62172, 92676, 123180, 153684, 184188 | 8180 | AEY70311 | 8180 | 38684 | 69188, 99692, 130196, 160700, 191204 |
| 1165 | ABG88729 | 1165 | 31669 | 62173, 92677, 123181, 153685, 184189 | 8181 | AEY70333 | 8181 | 38685 | 69189, 99693, 130197, 160701, 191205 |
| 1166 | ABG88740 | 1166 | 31670 | 62174, 92678, 123182, 153686, 184190 | 8182 | AEY70344 | 8182 | 38686 | 69190, 99694, 130198, 160702, 191206 |
| 1167 | ABG88751 | 1167 | 31671 | 62175, 92679, 123183, 153687, 184191 | 8183 | AEY70355 | 8183 | 38687 | 69191, 99695, 130199, 160703, 191207 |
| 1168 | ABG88762 | 1168 | 31672 | 62176, 92680, 123184, 153688, 184192 | 8184 | AEY70365 | 8184 | 38688 | 69192, 99696, 130200, 160704, 191208 |
| 1169 | ABG88773 | 1169 | 31673 | 62177, 92681, 123185, 153689, 184193 | 8185 | AEY70376 | 8185 | 38689 | 69193, 99697, 130201, 160705, 191209 |
| 1170 | ABG88784 | 1170 | 31674 | 62178, 92682, 123186, 153690, 184194 | 8186 | AFB18656 | 8186 | 38690 | 69194, 99698, 130202, 160706, 191210 |
| 1171 | ABG88806 | 1171 | 31675 | 62179, 92683, 123187, 153691, 184195 | 8187 | AFB40597 | 8187 | 38691 | 69195, 99699, 130203, 160707, 191211 |
| 1172 | ABI16504 | 1172 | 31676 | 62180, 92684, 123188, 153692, 184196 | 8188 | AFB40598 | 8188 | 38692 | 69196, 99700, 130204, 160708, 191212 |
| 1173 | ABI20793 | 1173 | 31677 | 62181, 92685, 123189, 153693, 184197 | 8189 | AFB40599 | 8189 | 38693 | 69197, 99701, 130205, 160709, 191213 |
| 1174 | ABI20837 | 1174 | 31678 | 62182, 92686, 123190, 153694, 184198 | 8190 | AFB40600 | 8190 | 38694 | 69198, 99702, 130206, 160710, 191214 |
| 1175 | ABI20848 | 1175 | 31679 | 62183, 92687, 123191, 153695, 184199 | 8191 | AFB40601 | 8191 | 38695 | 69199, 99703, 130207, 160711, 191215 |
| 1176 | ABI20859 | 1176 | 31680 | 62184, 92688, 123192, 153696, 184200 | 8192 | AFB40602 | 8192 | 38696 | 69200, 99704, 130208, 160712, 191216 |
| 1177 | ABI20870 | 1177 | 31681 | 62185, 92689, 123193, 153697, 184201 | 8193 | AFB40603 | 8193 | 38697 | 69201, 99705, 130209, 160713, 191217 |
| 1178 | ABI20881 | 1178 | 31682 | 62186, 92690, 123194, 153698, 184202 | 8194 | AFB40604 | 8194 | 38698 | 69202, 99706, 130210, 160714, 191218 |
| 1179 | ABI20892 | 1179 | 31683 | 62187, 92691, 123195, 153699, 184203 | 8195 | AFB70138 | 8195 | 38699 | 69203, 99707, 130211, 160715, 191219 |
| 1180 | ABI20903 | 1180 | 31684 | 62188, 92692, 123196, 153700, 184204 | 8196 | AFB70145 | 8196 | 38700 | 69204, 99708, 130212, 160716, 191220 |
| 1181 | ABI20914 | 1181 | 31685 | 62189, 92693, 123197, 153701, 184205 | 8197 | AFB70154 | 8197 | 38701 | 69205, 99709, 130213, 160717, 191221 |

FIG. 1 continued

| | | | | | | | | | |
|---|---|---|---|---|---|---|---|---|---|
| 1182 | ABI20925 | 1182 | 31686 | 62190, 92694, 123198, 153702, 184206 | 8198 | AFB70156 | 8198 | 38702 | 69206, 99710, 130214, 160718, 191222 |
| 1183 | ABI20936 | 1183 | 31687 | 62191, 92695, 123199, 153703, 184207 | 8199 | AFB70158 | 8199 | 38703 | 69207, 99711, 130215, 160719, 191223 |
| 1184 | ABI20947 | 1184 | 31688 | 62192, 92696, 123200, 153704, 184208 | 8200 | AFB70160 | 8200 | 38704 | 69208, 99712, 130216, 160720, 191224 |
| 1185 | ABI20958 | 1185 | 31689 | 62193, 92697, 123201, 153705, 184209 | 8201 | AFB70162 | 8201 | 38705 | 69209, 99713, 130217, 160721, 191225 |
| 1186 | ABI20969 | 1186 | 31690 | 62194, 92698, 123202, 153706, 184210 | 8202 | AFB70167 | 8202 | 38706 | 69210, 99714, 130218, 160722, 191226 |
| 1187 | ABI20980 | 1187 | 31691 | 62195, 92699, 123203, 153707, 184211 | 8203 | AFB70177 | 8203 | 38707 | 69211, 99715, 130219, 160723, 191227 |
| 1188 | ABI20991 | 1188 | 31692 | 62196, 92700, 123204, 153708, 184212 | 8204 | AFB70187 | 8204 | 38708 | 69212, 99716, 130220, 160724, 191228 |
| 1189 | ABI21002 | 1189 | 31693 | 62197, 92701, 123205, 153709, 184213 | 8205 | AFB70197 | 8205 | 38709 | 69213, 99717, 130221, 160725, 191229 |
| 1190 | ABI21013 | 1190 | 31694 | 62198, 92702, 123206, 153710, 184214 | 8206 | AFB70207 | 8206 | 38710 | 69214, 99718, 130222, 160726, 191230 |
| 1191 | ABI21024 | 1191 | 31695 | 62199, 92703, 123207, 153711, 184215 | 8207 | AFB70217 | 8207 | 38711 | 69215, 99719, 130223, 160727, 191231 |
| 1192 | ABI21035 | 1192 | 31696 | 62200, 92704, 123208, 153712, 184216 | 8208 | AFB70227 | 8208 | 38712 | 69216, 99720, 130224, 160728, 191232 |
| 1193 | ABI21046 | 1193 | 31697 | 62201, 92705, 123209, 153713, 184217 | 8209 | AFB70247 | 8209 | 38713 | 69217, 99721, 130225, 160729, 191233 |
| 1194 | ABI21057 | 1194 | 31698 | 62202, 92706, 123210, 153714, 184218 | 8210 | AFB70257 | 8210 | 38714 | 69218, 99722, 130226, 160730, 191234 |
| 1195 | ABI21068 | 1195 | 31699 | 62203, 92707, 123211, 153715, 184219 | 8211 | AFB70267 | 8211 | 38715 | 69219, 99723, 130227, 160731, 191235 |
| 1196 | ABI21079 | 1196 | 31700 | 62204, 92708, 123212, 153716, 184220 | 8212 | AFB70277 | 8212 | 38716 | 69220, 99724, 130228, 160732, 191236 |
| 1197 | ABI21090 | 1197 | 31701 | 62205, 92709, 123213, 153717, 184221 | 8213 | AFB70287 | 8213 | 38717 | 69221, 99725, 130229, 160733, 191237 |
| 1198 | ABI21101 | 1198 | 31702 | 62206, 92710, 123214, 153718, 184222 | 8214 | AFB70297 | 8214 | 38718 | 69222, 99726, 130230, 160734, 191238 |
| 1199 | ABI21123 | 1199 | 31703 | 62207, 92711, 123215, 153719, 184223 | 8215 | AFB70307 | 8215 | 38719 | 69223, 99727, 130231, 160735, 191239 |

FIG. 1 continued

| | | | | | | | | | |
|---|---|---|---|---|---|---|---|---|---|
| 1200 | ABI21134 | 1200 | 31704 | 62208, 92712, 123216, 153720, 184224 | 8216 | AFB70317 | 8216 | 38720 | 69224, 99728, 130232, 160736, 191240 |
| 1201 | ABI21156 | 1201 | 31705 | 62209, 92713, 123217, 153721, 184225 | 8217 | AFB70327 | 8217 | 38721 | 69225, 99729, 130233, 160737, 191241 |
| 1202 | ABI21167 | 1202 | 31706 | 62210, 92714, 123218, 153722, 184226 | 8218 | AFB70337 | 8218 | 38722 | 69226, 99730, 130234, 160738, 191242 |
| 1203 | ABI21178 | 1203 | 31707 | 62211, 92715, 123219, 153723, 184227 | 8219 | AFB70347 | 8219 | 38723 | 69227, 99731, 130235, 160739, 191243 |
| 1204 | ABI21200 | 1204 | 31708 | 62212, 92716, 123220, 153724, 184228 | 8220 | AFB70367 | 8220 | 38724 | 69228, 99732, 130236, 160740, 191244 |
| 1205 | ABI21211 | 1205 | 31709 | 62213, 92717, 123221, 153725, 184229 | 8221 | AFB70377 | 8221 | 38725 | 69229, 99733, 130237, 160741, 191245 |
| 1206 | ABI21233 | 1206 | 31710 | 62214, 92718, 123222, 153726, 184230 | 8222 | AFB70387 | 8222 | 38726 | 69230, 99734, 130238, 160742, 191246 |
| 1207 | ABI21244 | 1207 | 31711 | 62215, 92719, 123223, 153727, 184231 | 8223 | AFB70397 | 8223 | 38727 | 69231, 99735, 130239, 160743, 191247 |
| 1208 | ABI21255 | 1208 | 31712 | 62216, 92720, 123224, 153728, 184232 | 8224 | AFB70407 | 8224 | 38728 | 69232, 99736, 130240, 160744, 191248 |
| 1209 | ABI21266 | 1209 | 31713 | 62217, 92721, 123225, 153729, 184233 | 8225 | AFB77618 | 8225 | 38729 | 69233, 99737, 130241, 160745, 191249 |
| 1210 | ABI21277 | 1210 | 31714 | 62218, 92722, 123226, 153730, 184234 | 8226 | AFB77619 | 8226 | 38730 | 69234, 99738, 130242, 160746, 191250 |
| 1211 | ABI21299 | 1211 | 31715 | 62219, 92723, 123227, 153731, 184235 | 8227 | AFB77620 | 8227 | 38731 | 69235, 99739, 130243, 160747, 191251 |
| 1212 | ABI21310 | 1212 | 31716 | 62220, 92724, 123228, 153732, 184236 | 8228 | AFB77621 | 8228 | 38732 | 69236, 99740, 130244, 160748, 191252 |
| 1213 | ABI21321 | 1213 | 31717 | 62221, 92725, 123229, 153733, 184237 | 8229 | AFB77622 | 8229 | 38733 | 69237, 99741, 130245, 160749, 191253 |
| 1214 | ABI21332 | 1214 | 31718 | 62222, 92726, 123230, 153734, 184238 | 8230 | AFB77623 | 8230 | 38734 | 69238, 99742, 130246, 160750, 191254 |
| 1215 | ABI21343 | 1215 | 31719 | 62223, 92727, 123231, 153735, 184239 | 8231 | AFB77624 | 8231 | 38735 | 69239, 99743, 130247, 160751, 191255 |
| 1216 | ABI21354 | 1216 | 31720 | 62224, 92728, 123232, 153736, 184240 | 8232 | AFB77625 | 8232 | 38736 | 69240, 99744, 130248, 160752, 191256 |
| 1217 | ABI21365 | 1217 | 31721 | 62225, 92729, 123233, 153737, 184241 | 8233 | AFB77627 | 8233 | 38737 | 69241, 99745, 130249, 160753, 191257 |

FIG. 1 continued

| | | | | | | | | | |
|---|---|---|---|---|---|---|---|---|---|
| 1218 | ABI21376 | 1218 | 31722 | 62226, 92730, 123234, 153738, 184242 | 8234 | AFB77628 | 8234 | 38738 | 69242, 99746, 130250, 160754, 191258 |
| 1219 | ABI21387 | 1219 | 31723 | 62227, 92731, 123235, 153739, 184243 | 8235 | AFB77629 | 8235 | 38739 | 69243, 99747, 130251, 160755, 191259 |
| 1220 | ABI21398 | 1220 | 31724 | 62228, 92732, 123236, 153740, 184244 | 8236 | AFB77630 | 8236 | 38740 | 69244, 99748, 130252, 160756, 191260 |
| 1221 | ABI21409 | 1221 | 31725 | 62229, 92733, 123237, 153741, 184245 | 8237 | AFB77631 | 8237 | 38741 | 69245, 99749, 130253, 160757, 191261 |
| 1222 | ABI21420 | 1222 | 31726 | 62230, 92734, 123238, 153742, 184246 | 8238 | AFB77632 | 8238 | 38742 | 69246, 99750, 130254, 160758, 191262 |
| 1223 | ABI21431 | 1223 | 31727 | 62231, 92735, 123239, 153743, 184247 | 8239 | AFB77633 | 8239 | 38743 | 69247, 99751, 130255, 160759, 191263 |
| 1224 | ABI21442 | 1224 | 31728 | 62232, 92736, 123240, 153744, 184248 | 8240 | AFB77634 | 8240 | 38744 | 69248, 99752, 130256, 160760, 191264 |
| 1225 | ABI21453 | 1225 | 31729 | 62233, 92737, 123241, 153745, 184249 | 8241 | AFB77635 | 8241 | 38745 | 69249, 99753, 130257, 160761, 191265 |
| 1226 | ABI21464 | 1226 | 31730 | 62234, 92738, 123242, 153746, 184250 | 8242 | AFB77636 | 8242 | 38746 | 69250, 99754, 130258, 160762, 191266 |
| 1227 | ABI21475 | 1227 | 31731 | 62235, 92739, 123243, 153747, 184251 | 8243 | AFB77637 | 8243 | 38747 | 69251, 99755, 130259, 160763, 191267 |
| 1228 | ABI21486 | 1228 | 31732 | 62236, 92740, 123244, 153748, 184252 | 8244 | AFB77638 | 8244 | 38748 | 69252, 99756, 130260, 160764, 191268 |
| 1229 | ABI21497 | 1229 | 31733 | 62237, 92741, 123245, 153749, 184253 | 8245 | AFB77639 | 8245 | 38749 | 69253, 99757, 130261, 160765, 191269 |
| 1230 | ABI21530 | 1230 | 31734 | 62238, 92742, 123246, 153750, 184254 | 8246 | AFB77640 | 8246 | 38750 | 69254, 99758, 130262, 160766, 191270 |
| 1231 | ABI21552 | 1231 | 31735 | 62239, 92743, 123247, 153751, 184255 | 8247 | AFB77641 | 8247 | 38751 | 69255, 99759, 130263, 160767, 191271 |
| 1232 | ABI21563 | 1232 | 31736 | 62240, 92744, 123248, 153752, 184256 | 8248 | AFB77642 | 8248 | 38752 | 69256, 99760, 130264, 160768, 191272 |
| 1233 | ABI21574 | 1233 | 31737 | 62241, 92745, 123249, 153753, 184257 | 8249 | AFB77643 | 8249 | 38753 | 69257, 99761, 130265, 160769, 191273 |
| 1234 | ABI21736 | 1234 | 31738 | 62242, 92746, 123250, 153754, 184258 | 8250 | AFB77691 | 8250 | 38754 | 69258, 99762, 130266, 160770, 191274 |
| 1235 | ABI22159 | 1235 | 31739 | 62243, 92747, 123251, 153755, 184259 | 8251 | AFB77692 | 8251 | 38755 | 69259, 99763, 130267, 160771, 191275 |

FIG. 1 continued

| | | | | | | | | | |
|---|---|---|---|---|---|---|---|---|---|
| 1236 | ABI23979 | 1236 | 31740 | 62244, 92748, 123252, 153756, 184260 | 8252 | AFB77693 | 8252 | 38756 | 69260, 99764, 130268, 160772, 191276 |
| 1237 | ABI26646 | 1237 | 31741 | 62245, 92749, 123253, 153757, 184261 | 8253 | AFB77694 | 8253 | 38757 | 69261, 99765, 130269, 160773, 191277 |
| 1238 | ABI30367 | 1238 | 31742 | 62246, 92750, 123254, 153758, 184262 | 8254 | AFB77695 | 8254 | 38758 | 69262, 99766, 130270, 160774, 191278 |
| 1239 | ABI30378 | 1239 | 31743 | 62247, 92751, 123255, 153759, 184263 | 8255 | AFB78126 | 8255 | 38759 | 69263, 99767, 130271, 160775, 191279 |
| 1240 | ABI30400 | 1240 | 31744 | 62248, 92752, 123256, 153760, 184264 | 8256 | AFC34056 | 8256 | 38760 | 69264, 99768, 130272, 160776, 191280 |
| 1241 | ABI30411 | 1241 | 31745 | 62249, 92753, 123257, 153761, 184265 | 8257 | AFC34057 | 8257 | 38761 | 69265, 99769, 130273, 160777, 191281 |
| 1242 | ABI30422 | 1242 | 31746 | 62250, 92754, 123258, 153762, 184266 | 8258 | AFD32426 | 8258 | 38762 | 69266, 99770, 130274, 160778, 191282 |
| 1243 | ABI30433 | 1243 | 31747 | 62251, 92755, 123259, 153763, 184267 | 8259 | AFD32427 | 8259 | 38763 | 69267, 99771, 130275, 160779, 191283 |
| 1244 | ABI30444 | 1244 | 31748 | 62252, 92756, 123260, 153764, 184268 | 8260 | AFD32428 | 8260 | 38764 | 69268, 99772, 130276, 160780, 191284 |
| 1245 | ABI30455 | 1245 | 31749 | 62253, 92757, 123261, 153765, 184269 | 8261 | AFD32429 | 8261 | 38765 | 69269, 99773, 130277, 160781, 191285 |
| 1246 | ABI30466 | 1246 | 31750 | 62254, 92758, 123262, 153766, 184270 | 8262 | AFD63527 | 8262 | 38766 | 69270, 99774, 130278, 160782, 191286 |
| 1247 | ABI30477 | 1247 | 31751 | 62255, 92759, 123263, 153767, 184271 | 8263 | AFD63538 | 8263 | 38767 | 69271, 99775, 130279, 160783, 191287 |
| 1248 | ABI30488 | 1248 | 31752 | 62256, 92760, 123264, 153768, 184272 | 8264 | AFD63549 | 8264 | 38768 | 69272, 99776, 130280, 160784, 191288 |
| 1249 | ABI30499 | 1249 | 31753 | 62257, 92761, 123265, 153769, 184273 | 8265 | AFD63571 | 8265 | 38769 | 69273, 99777, 130281, 160785, 191289 |
| 1250 | ABI30510 | 1250 | 31754 | 62258, 92762, 123266, 153770, 184274 | 8266 | AFD63615 | 8266 | 38770 | 69274, 99778, 130282, 160786, 191290 |
| 1251 | ABI30521 | 1251 | 31755 | 62259, 92763, 123267, 153771, 184275 | 8267 | AFD63626 | 8267 | 38771 | 69275, 99779, 130283, 160787, 191291 |
| 1252 | ABI30532 | 1252 | 31756 | 62260, 92764, 123268, 153772, 184276 | 8268 | AFD63637 | 8268 | 38772 | 69276, 99780, 130284, 160788, 191292 |
| 1253 | ABI30543 | 1253 | 31757 | 62261, 92765, 123269, 153773, 184277 | 8269 | AFD63648 | 8269 | 38773 | 69277, 99781, 130285, 160789, 191293 |

FIG. 1 continued

| | | | | | | | | | |
|---|---|---|---|---|---|---|---|---|---|
| 1254 | ABI30554 | 1254 | 31758 | 62262, 92766, 123270, 153774, 184278 | 8270 | AFD63659 | 8270 | 38774 | 69278, 99782, 130286, 160790, 191294 |
| 1255 | ABI30565 | 1255 | 31759 | 62263, 92767, 123271, 153775, 184279 | 8271 | AFD63681 | 8271 | 38775 | 69279, 99783, 130287, 160791, 191295 |
| 1256 | ABI30587 | 1256 | 31760 | 62264, 92768, 123272, 153776, 184280 | 8272 | AFD63692 | 8272 | 38776 | 69280, 99784, 130288, 160792, 191296 |
| 1257 | ABI30609 | 1257 | 31761 | 62265, 92769, 123273, 153777, 184281 | 8273 | AFD63703 | 8273 | 38777 | 69281, 99785, 130289, 160793, 191297 |
| 1258 | ABI30620 | 1258 | 31762 | 62266, 92770, 123274, 153778, 184282 | 8274 | AFD63714 | 8274 | 38778 | 69282, 99786, 130290, 160794, 191298 |
| 1259 | ABI30733 | 1259 | 31763 | 62267, 92771, 123275, 153779, 184283 | 8275 | AFD63736 | 8275 | 38779 | 69283, 99787, 130291, 160795, 191299 |
| 1260 | ABI30744 | 1260 | 31764 | 62268, 92772, 123276, 153780, 184284 | 8276 | AFD63747 | 8276 | 38780 | 69284, 99788, 130292, 160796, 191300 |
| 1261 | ABI30755 | 1261 | 31765 | 62269, 92773, 123277, 153781, 184285 | 8277 | AFD63758 | 8277 | 38781 | 69285, 99789, 130293, 160797, 191301 |
| 1262 | ABI30766 | 1262 | 31766 | 62270, 92774, 123278, 153782, 184286 | 8278 | AFD63769 | 8278 | 38782 | 69286, 99790, 130294, 160798, 191302 |
| 1263 | ABI30777 | 1263 | 31767 | 62271, 92775, 123279, 153783, 184287 | 8279 | AFD63780 | 8279 | 38783 | 69287, 99791, 130295, 160799, 191303 |
| 1264 | ABI30788 | 1264 | 31768 | 62272, 92776, 123280, 153784, 184288 | 8280 | AFD63791 | 8280 | 38784 | 69288, 99792, 130296, 160800, 191304 |
| 1265 | ABI30799 | 1265 | 31769 | 62273, 92777, 123281, 153785, 184289 | 8281 | AFD63802 | 8281 | 38785 | 69289, 99793, 130297, 160801, 191305 |
| 1266 | ABI30810 | 1266 | 31770 | 62274, 92778, 123282, 153786, 184290 | 8282 | AFD63813 | 8282 | 38786 | 69290, 99794, 130298, 160802, 191306 |
| 1267 | ABI30821 | 1267 | 31771 | 62275, 92779, 123283, 153787, 184291 | 8283 | AFD63824 | 8283 | 38787 | 69291, 99795, 130299, 160803, 191307 |
| 1268 | ABI30832 | 1268 | 31772 | 62276, 92780, 123284, 153788, 184292 | 8284 | AFD63846 | 8284 | 38788 | 69292, 99796, 130300, 160804, 191308 |
| 1269 | ABI30843 | 1269 | 31773 | 62277, 92781, 123285, 153789, 184293 | 8285 | AFD63857 | 8285 | 38789 | 69293, 99797, 130301, 160805, 191309 |
| 1270 | ABI30865 | 1270 | 31774 | 62278, 92782, 123286, 153790, 184294 | 8286 | AFD63868 | 8286 | 38790 | 69294, 99798, 130302, 160806, 191310 |
| 1271 | ABI36155 | 1271 | 31775 | 62279, 92783, 123287, 153791, 184295 | 8287 | AFD63890 | 8287 | 38791 | 69295, 99799, 130303, 160807, 191311 |

FIG. 1 continued

| | | | | | | | | | |
|---|---|---|---|---|---|---|---|---|---|
| 1272 | ABI36166 | 1272 | 31776 | 62280, 92784, 123288, 153792, 184296 | 8288 | AFD63901 | 8288 | 38792 | 69296, 99800, 130304, 160808, 191312 |
| 1273 | ABI36177 | 1273 | 31777 | 62281, 92785, 123289, 153793, 184297 | 8289 | AFD63912 | 8289 | 38793 | 69297, 99801, 130305, 160809, 191313 |
| 1274 | ABI36406 | 1274 | 31778 | 62282, 92786, 123290, 153794, 184298 | 8290 | AFD63923 | 8290 | 38794 | 69298, 99802, 130306, 160810, 191314 |
| 1275 | ABI36450 | 1275 | 31779 | 62283, 92787, 123291, 153795, 184299 | 8291 | AFD63934 | 8291 | 38795 | 69299, 99803, 130307, 160811, 191315 |
| 1276 | ABI49396 | 1276 | 31780 | 62284, 92788, 123292, 153796, 184300 | 8292 | AFD63945 | 8292 | 38796 | 69300, 99804, 130308, 160812, 191316 |
| 1277 | ABI85000 | 1277 | 31781 | 62285, 92789, 123293, 153797, 184301 | 8293 | AFD63956 | 8293 | 38797 | 69301, 99805, 130309, 160813, 191317 |
| 1278 | ABI92291 | 1278 | 31782 | 62286, 92790, 123294, 153798, 184302 | 8294 | AFD63967 | 8294 | 38798 | 69302, 99806, 130310, 160814, 191318 |
| 1279 | ABI92302 | 1279 | 31783 | 62287, 92791, 123295, 153799, 184303 | 8295 | AFD63989 | 8295 | 38799 | 69303, 99807, 130311, 160815, 191319 |
| 1280 | ABI92313 | 1280 | 31784 | 62288, 92792, 123296, 153800, 184304 | 8296 | AFD64000 | 8296 | 38800 | 69304, 99808, 130312, 160816, 191320 |
| 1281 | ABI92324 | 1281 | 31785 | 62289, 92793, 123297, 153801, 184305 | 8297 | AFD64011 | 8297 | 38801 | 69305, 99809, 130313, 160817, 191321 |
| 1282 | ABI92335 | 1282 | 31786 | 62290, 92794, 123298, 153802, 184306 | 8298 | AFD64022 | 8298 | 38802 | 69306, 99810, 130314, 160818, 191322 |
| 1283 | ABI92346 | 1283 | 31787 | 62291, 92795, 123299, 153803, 184307 | 8299 | AFD64033 | 8299 | 38803 | 69307, 99811, 130315, 160819, 191323 |
| 1284 | ABI92357 | 1284 | 31788 | 62292, 92796, 123300, 153804, 184308 | 8300 | AFD64044 | 8300 | 38804 | 69308, 99812, 130316, 160820, 191324 |
| 1285 | ABI92368 | 1285 | 31789 | 62293, 92797, 123301, 153805, 184309 | 8301 | AFD64055 | 8301 | 38805 | 69309, 99813, 130317, 160821, 191325 |
| 1286 | ABI92379 | 1286 | 31790 | 62294, 92798, 123302, 153806, 184310 | 8302 | AFD64066 | 8302 | 38806 | 69310, 99814, 130318, 160822, 191326 |
| 1287 | ABI92390 | 1287 | 31791 | 62295, 92799, 123303, 153807, 184311 | 8303 | AFD64077 | 8303 | 38807 | 69311, 99815, 130319, 160823, 191327 |
| 1288 | ABI92401 | 1288 | 31792 | 62296, 92800, 123304, 153808, 184312 | 8304 | AFD64088 | 8304 | 38808 | 69312, 99816, 130320, 160824, 191328 |
| 1289 | ABI92412 | 1289 | 31793 | 62297, 92801, 123305, 153809, 184313 | 8305 | AFD64099 | 8305 | 38809 | 69313, 99817, 130321, 160825, 191329 |

FIG. 1 continued

| | | | | | | | | | |
|---|---|---|---|---|---|---|---|---|---|
| 1290 | ABI92423 | 1290 | 31794 | 62298, 92802, 123306, 153810, 184314 | 8306 | AFD64110 | 8306 | 38810 | 69314, 99818, 130322, 160826, 191330 |
| 1291 | ABI92434 | 1291 | 31795 | 62299, 92803, 123307, 153811, 184315 | 8307 | AFD64121 | 8307 | 38811 | 69315, 99819, 130323, 160827, 191331 |
| 1292 | ABI92445 | 1292 | 31796 | 62300, 92804, 123308, 153812, 184316 | 8308 | AFD64132 | 8308 | 38812 | 69316, 99820, 130324, 160828, 191332 |
| 1293 | ABI92456 | 1293 | 31797 | 62301, 92805, 123309, 153813, 184317 | 8309 | AFD64143 | 8309 | 38813 | 69317, 99821, 130325, 160829, 191333 |
| 1294 | ABI92467 | 1294 | 31798 | 62302, 92806, 123310, 153814, 184318 | 8310 | AFD64154 | 8310 | 38814 | 69318, 99822, 130326, 160830, 191334 |
| 1295 | ABI92478 | 1295 | 31799 | 62303, 92807, 123311, 153815, 184319 | 8311 | AFD64179 | 8311 | 38815 | 69319, 99823, 130327, 160831, 191335 |
| 1296 | ABI92489 | 1296 | 31800 | 62304, 92808, 123312, 153816, 184320 | 8312 | AFD64190 | 8312 | 38816 | 69320, 99824, 130328, 160832, 191336 |
| 1297 | ABI92500 | 1297 | 31801 | 62305, 92809, 123313, 153817, 184321 | 8313 | AFD64201 | 8313 | 38817 | 69321, 99825, 130329, 160833, 191337 |
| 1298 | ABI92511 | 1298 | 31802 | 62306, 92810, 123314, 153818, 184322 | 8314 | AFD64212 | 8314 | 38818 | 69322, 99826, 130330, 160834, 191338 |
| 1299 | ABI92522 | 1299 | 31803 | 62307, 92811, 123315, 153819, 184323 | 8315 | AFD64223 | 8315 | 38819 | 69323, 99827, 130331, 160835, 191339 |
| 1300 | ABI92533 | 1300 | 31804 | 62308, 92812, 123316, 153820, 184324 | 8316 | AFD64315 | 8316 | 38820 | 69324, 99828, 130332, 160836, 191340 |
| 1301 | ABI92544 | 1301 | 31805 | 62309, 92813, 123317, 153821, 184325 | 8317 | AFD64326 | 8317 | 38821 | 69325, 99829, 130333, 160837, 191341 |
| 1302 | ABI92577 | 1302 | 31806 | 62310, 92814, 123318, 153822, 184326 | 8318 | AFD64337 | 8318 | 38822 | 69326, 99830, 130334, 160838, 191342 |
| 1303 | ABI92588 | 1303 | 31807 | 62311, 92815, 123319, 153823, 184327 | 8319 | AFD64348 | 8319 | 38823 | 69327, 99831, 130335, 160839, 191343 |
| 1304 | ABI92599 | 1304 | 31808 | 62312, 92816, 123320, 153824, 184328 | 8320 | AFD64359 | 8320 | 38824 | 69328, 99832, 130336, 160840, 191344 |
| 1305 | ABI92610 | 1305 | 31809 | 62313, 92817, 123321, 153825, 184329 | 8321 | AFD64370 | 8321 | 38825 | 69329, 99833, 130337, 160841, 191345 |
| 1306 | ABI92621 | 1306 | 31810 | 62314, 92818, 123322, 153826, 184330 | 8322 | AFD64381 | 8322 | 38826 | 69330, 99834, 130338, 160842, 191346 |
| 1307 | ABI92632 | 1307 | 31811 | 62315, 92819, 123323, 153827, 184331 | 8323 | AFD64392 | 8323 | 38827 | 69331, 99835, 130339, 160843, 191347 |

FIG. 1 continued

| | | | | | | | | | |
|---|---|---|---|---|---|---|---|---|---|
| 1308 | ABI92643 | 1308 | 31812 | 62316, 92820, 123324, 153828, 184332 | 8324 | AFD64403 | 8324 | 38828 | 69332, 99836, 130340, 160844, 191348 |
| 1309 | ABI92665 | 1309 | 31813 | 62317, 92821, 123325, 153829, 184333 | 8325 | AFD64414 | 8325 | 38829 | 69333, 99837, 130341, 160845, 191349 |
| 1310 | ABI92676 | 1310 | 31814 | 62318, 92822, 123326, 153830, 184334 | 8326 | AFD64425 | 8326 | 38830 | 69334, 99838, 130342, 160846, 191350 |
| 1311 | ABI92687 | 1311 | 31815 | 62319, 92823, 123327, 153831, 184335 | 8327 | AFD64436 | 8327 | 38831 | 69335, 99839, 130343, 160847, 191351 |
| 1312 | ABI92698 | 1312 | 31816 | 62320, 92824, 123328, 153832, 184336 | 8328 | AFD64447 | 8328 | 38832 | 69336, 99840, 130344, 160848, 191352 |
| 1313 | ABI92709 | 1313 | 31817 | 62321, 92825, 123329, 153833, 184337 | 8329 | AFD64458 | 8329 | 38833 | 69337, 99841, 130345, 160849, 191353 |
| 1314 | ABI92720 | 1314 | 31818 | 62322, 92826, 123330, 153834, 184338 | 8330 | AFD64795 | 8330 | 38834 | 69338, 99842, 130346, 160850, 191354 |
| 1315 | ABI92731 | 1315 | 31819 | 62323, 92827, 123331, 153835, 184339 | 8331 | AFD64799 | 8331 | 38835 | 69339, 99843, 130347, 160851, 191355 |
| 1316 | ABI92742 | 1316 | 31820 | 62324, 92828, 123332, 153836, 184340 | 8332 | AFD64802 | 8332 | 38836 | 69340, 99844, 130348, 160852, 191356 |
| 1317 | ABI92753 | 1317 | 31821 | 62325, 92829, 123333, 153837, 184341 | 8333 | AFD64804 | 8333 | 38837 | 69341, 99845, 130349, 160853, 191357 |
| 1318 | ABI92764 | 1318 | 31822 | 62326, 92830, 123334, 153838, 184342 | 8334 | AFD64806 | 8334 | 38838 | 69342, 99846, 130350, 160854, 191358 |
| 1319 | ABI92775 | 1319 | 31823 | 62327, 92831, 123335, 153839, 184343 | 8335 | AFD64807 | 8335 | 38839 | 69343, 99847, 130351, 160855, 191359 |
| 1320 | ABI92786 | 1320 | 31824 | 62328, 92832, 123336, 153840, 184344 | 8336 | AFD64810 | 8336 | 38840 | 69344, 99848, 130352, 160856, 191360 |
| 1321 | ABI92797 | 1321 | 31825 | 62329, 92833, 123337, 153841, 184345 | 8337 | AFD64812 | 8337 | 38841 | 69345, 99849, 130353, 160857, 191361 |
| 1322 | ABI92808 | 1322 | 31826 | 62330, 92834, 123338, 153842, 184346 | 8338 | AFD64814 | 8338 | 38842 | 69346, 99850, 130354, 160858, 191362 |
| 1323 | ABI92819 | 1323 | 31827 | 62331, 92835, 123339, 153843, 184347 | 8339 | AFD64816 | 8339 | 38843 | 69347, 99851, 130355, 160859, 191363 |
| 1324 | ABI92841 | 1324 | 31828 | 62332, 92836, 123340, 153844, 184348 | 8340 | AFD64818 | 8340 | 38844 | 69348, 99852, 130356, 160860, 191364 |
| 1325 | ABI92852 | 1325 | 31829 | 62333, 92837, 123341, 153845, 184349 | 8341 | AFD64819 | 8341 | 38845 | 69349, 99853, 130357, 160861, 191365 |

FIG. 1 continued

| | | | | | | | | | |
|---|---|---|---|---|---|---|---|---|---|
| 1326 | ABI92863 | 1326 | 31830 | 62334, 92838, 123342, 153846, 184350 | 8342 | AFD64820 | 8342 | 38846 | 69350, 99854, 130358, 160862, 191366 |
| 1327 | ABI92874 | 1327 | 31831 | 62335, 92839, 123343, 153847, 184351 | 8343 | AFD64822 | 8343 | 38847 | 69351, 99855, 130359, 160863, 191367 |
| 1328 | ABI92885 | 1328 | 31832 | 62336, 92840, 123344, 153848, 184352 | 8344 | AFD64823 | 8344 | 38848 | 69352, 99856, 130360, 160864, 191368 |
| 1329 | ABI92907 | 1329 | 31833 | 62337, 92841, 123345, 153849, 184353 | 8345 | AFD64824 | 8345 | 38849 | 69353, 99857, 130361, 160865, 191369 |
| 1330 | ABI92918 | 1330 | 31834 | 62338, 92842, 123346, 153850, 184354 | 8346 | AFD64825 | 8346 | 38850 | 69354, 99858, 130362, 160866, 191370 |
| 1331 | ABI92929 | 1331 | 31835 | 62339, 92843, 123347, 153851, 184355 | 8347 | AFD64827 | 8347 | 38851 | 69355, 99859, 130363, 160867, 191371 |
| 1332 | ABI92940 | 1332 | 31836 | 62340, 92844, 123348, 153852, 184356 | 8348 | AFD64828 | 8348 | 38852 | 69356, 99860, 130364, 160868, 191372 |
| 1333 | ABI92951 | 1333 | 31837 | 62341, 92845, 123349, 153853, 184357 | 8349 | AFD64830 | 8349 | 38853 | 69357, 99861, 130365, 160869, 191373 |
| 1334 | ABI92962 | 1334 | 31838 | 62342, 92846, 123350, 153854, 184358 | 8350 | AFD98095 | 8350 | 38854 | 69358, 99862, 130366, 160870, 191374 |
| 1335 | ABI92973 | 1335 | 31839 | 62343, 92847, 123351, 153855, 184359 | 8351 | AFD98106 | 8351 | 38855 | 69359, 99863, 130367, 160871, 191375 |
| 1336 | ABI92984 | 1336 | 31840 | 62344, 92848, 123352, 153856, 184360 | 8352 | AFD98128 | 8352 | 38856 | 69360, 99864, 130368, 160872, 191376 |
| 1337 | ABI92995 | 1337 | 31841 | 62345, 92849, 123353, 153857, 184361 | 8353 | AFD98139 | 8353 | 38857 | 69361, 99865, 130369, 160873, 191377 |
| 1338 | ABI93006 | 1338 | 31842 | 62346, 92850, 123354, 153858, 184362 | 8354 | AFD98161 | 8354 | 38858 | 69362, 99866, 130370, 160874, 191378 |
| 1339 | ABI93017 | 1339 | 31843 | 62347, 92851, 123355, 153859, 184363 | 8355 | AFD98172 | 8355 | 38859 | 69363, 99867, 130371, 160875, 191379 |
| 1340 | ABI93028 | 1340 | 31844 | 62348, 92852, 123356, 153860, 184364 | 8356 | AFD98183 | 8356 | 38860 | 69364, 99868, 130372, 160876, 191380 |
| 1341 | ABI93039 | 1341 | 31845 | 62349, 92853, 123357, 153861, 184365 | 8357 | AFD98194 | 8357 | 38861 | 69365, 99869, 130373, 160877, 191381 |
| 1342 | ABI93061 | 1342 | 31846 | 62350, 92854, 123358, 153862, 184366 | 8358 | AFD98205 | 8358 | 38862 | 69366, 99870, 130374, 160878, 191382 |
| 1343 | ABI93072 | 1343 | 31847 | 62351, 92855, 123359, 153863, 184367 | 8359 | AFD98215 | 8359 | 38863 | 69367, 99871, 130375, 160879, 191383 |

FIG. 1 continued

| | | | | | | | | | |
|---|---|---|---|---|---|---|---|---|---|
| 1344 | ABI93083 | 1344 | 31848 | 62352, 92856, 123360, 153864, 184368 | 8360 | AFD98226 | 8360 | 38864 | 69368, 99872, 130376, 160880, 191384 |
| 1345 | ABI93094 | 1345 | 31849 | 62353, 92857, 123361, 153865, 184369 | 8361 | AFD98237 | 8361 | 38865 | 69369, 99873, 130377, 160881, 191385 |
| 1346 | ABI93105 | 1346 | 31850 | 62354, 92858, 123362, 153866, 184370 | 8362 | AFD98248 | 8362 | 38866 | 69370, 99874, 130378, 160882, 191386 |
| 1347 | ABI93116 | 1347 | 31851 | 62355, 92859, 123363, 153867, 184371 | 8363 | AFD98259 | 8363 | 38867 | 69371, 99875, 130379, 160883, 191387 |
| 1348 | ABI94581 | 1348 | 31852 | 62356, 92860, 123364, 153868, 184372 | 8364 | AFD98270 | 8364 | 38868 | 69372, 99876, 130380, 160884, 191388 |
| 1349 | ABI95228 | 1349 | 31853 | 62357, 92861, 123365, 153869, 184373 | 8365 | AFD98280 | 8365 | 38869 | 69373, 99877, 130381, 160885, 191389 |
| 1350 | ABI95239 | 1350 | 31854 | 62358, 92862, 123366, 153870, 184374 | 8366 | AFD98290 | 8366 | 38870 | 69374, 99878, 130382, 160886, 191390 |
| 1351 | ABI95250 | 1351 | 31855 | 62359, 92863, 123367, 153871, 184375 | 8367 | AFD98310 | 8367 | 38871 | 69375, 99879, 130383, 160887, 191391 |
| 1352 | ABI95261 | 1352 | 31856 | 62360, 92864, 123368, 153872, 184376 | 8368 | AFD98320 | 8368 | 38872 | 69376, 99880, 130384, 160888, 191392 |
| 1353 | ABI95272 | 1353 | 31857 | 62361, 92865, 123369, 153873, 184377 | 8369 | AFD98340 | 8369 | 38873 | 69377, 99881, 130385, 160889, 191393 |
| 1354 | ABI95283 | 1354 | 31858 | 62362, 92866, 123370, 153874, 184378 | 8370 | AFD98351 | 8370 | 38874 | 69378, 99882, 130386, 160890, 191394 |
| 1355 | ABI95294 | 1355 | 31859 | 62363, 92867, 123371, 153875, 184379 | 8371 | AFD98362 | 8371 | 38875 | 69379, 99883, 130387, 160891, 191395 |
| 1356 | ABI96104 | 1356 | 31860 | 62364, 92868, 123372, 153876, 184380 | 8372 | AFD98373 | 8372 | 38876 | 69380, 99884, 130388, 160892, 191396 |
| 1357 | ABJ09107 | 1357 | 31861 | 62365, 92869, 123373, 153877, 184381 | 8373 | AFD98384 | 8373 | 38877 | 69381, 99885, 130389, 160893, 191397 |
| 1358 | ABJ09140 | 1358 | 31862 | 62366, 92870, 123374, 153878, 184382 | 8374 | AFD98395 | 8374 | 38878 | 69382, 99886, 130390, 160894, 191398 |
| 1359 | ABJ09151 | 1359 | 31863 | 62367, 92871, 123375, 153879, 184383 | 8375 | AFD98406 | 8375 | 38879 | 69383, 99887, 130391, 160895, 191399 |
| 1360 | ABJ09162 | 1360 | 31864 | 62368, 92872, 123376, 153880, 184384 | 8376 | AFD98417 | 8376 | 38880 | 69384, 99888, 130392, 160896, 191400 |
| 1361 | ABJ09173 | 1361 | 31865 | 62369, 92873, 123377, 153881, 184385 | 8377 | AFD98428 | 8377 | 38881 | 69385, 99889, 130393, 160897, 191401 |

FIG. 1 continued

| | | | | | | | | | |
|---|---|---|---|---|---|---|---|---|---|
| 1362 | ABJ09184 | 1362 | 31866 | 62370, 92874, 123378, 153882, 184386 | 8378 | AFD98439 | 8378 | 38882 | 69386, 99890, 130394, 160898, 191402 |
| 1363 | ABJ09195 | 1363 | 31867 | 62371, 92875, 123379, 153883, 184387 | 8379 | AFD98449 | 8379 | 38883 | 69387, 99891, 130395, 160899, 191403 |
| 1364 | ABJ09206 | 1364 | 31868 | 62372, 92876, 123380, 153884, 184388 | 8380 | AFD98460 | 8380 | 38884 | 69388, 99892, 130396, 160900, 191404 |
| 1365 | ABJ09217 | 1365 | 31869 | 62373, 92877, 123381, 153885, 184389 | 8381 | AFD98471 | 8381 | 38885 | 69389, 99893, 130397, 160901, 191405 |
| 1366 | ABJ09228 | 1366 | 31870 | 62374, 92878, 123382, 153886, 184390 | 8382 | AFD98481 | 8382 | 38886 | 69390, 99894, 130398, 160902, 191406 |
| 1367 | ABJ09239 | 1367 | 31871 | 62375, 92879, 123383, 153887, 184391 | 8383 | AFD98492 | 8383 | 38887 | 69391, 99895, 130399, 160903, 191407 |
| 1368 | ABJ09250 | 1368 | 31872 | 62376, 92880, 123384, 153888, 184392 | 8384 | AFD98503 | 8384 | 38888 | 69392, 99896, 130400, 160904, 191408 |
| 1369 | ABJ09261 | 1369 | 31873 | 62377, 92881, 123385, 153889, 184393 | 8385 | AFD98514 | 8385 | 38889 | 69393, 99897, 130401, 160905, 191409 |
| 1370 | ABJ09272 | 1370 | 31874 | 62378, 92882, 123386, 153890, 184394 | 8386 | AFD98525 | 8386 | 38890 | 69394, 99898, 130402, 160906, 191410 |
| 1371 | ABJ09294 | 1371 | 31875 | 62379, 92883, 123387, 153891, 184395 | 8387 | AFD98558 | 8387 | 38891 | 69395, 99899, 130403, 160907, 191411 |
| 1372 | ABJ09305 | 1372 | 31876 | 62380, 92884, 123388, 153892, 184396 | 8388 | AFD98569 | 8388 | 38892 | 69396, 99900, 130404, 160908, 191412 |
| 1373 | ABJ09316 | 1373 | 31877 | 62381, 92885, 123389, 153893, 184397 | 8389 | AFD98580 | 8389 | 38893 | 69397, 99901, 130405, 160909, 191413 |
| 1374 | ABJ09338 | 1374 | 31878 | 62382, 92886, 123390, 153894, 184398 | 8390 | AFE02942 | 8390 | 38894 | 69398, 99902, 130406, 160910, 191414 |
| 1375 | ABJ09349 | 1375 | 31879 | 62383, 92887, 123391, 153895, 184399 | 8391 | AFE18688 | 8391 | 38895 | 69399, 99903, 130407, 160911, 191415 |
| 1376 | ABJ09360 | 1376 | 31880 | 62384, 92888, 123392, 153896, 184400 | 8392 | AFE47624 | 8392 | 38896 | 69400, 99904, 130408, 160912, 191416 |
| 1377 | ABJ09371 | 1377 | 31881 | 62385, 92889, 123393, 153897, 184401 | 8393 | AFE47635 | 8393 | 38897 | 69401, 99905, 130409, 160913, 191417 |
| 1378 | ABJ09382 | 1378 | 31882 | 62386, 92890, 123394, 153898, 184402 | 8394 | AFF18506 | 8394 | 38898 | 69402, 99906, 130410, 160914, 191418 |
| 1379 | ABJ16587 | 1379 | 31883 | 62387, 92891, 123395, 153899, 184403 | 8395 | AFF57124 | 8395 | 38899 | 69403, 99907, 130411, 160915, 191419 |

FIG. 1 continued

| | | | | | | | | | |
|---|---|---|---|---|---|---|---|---|---|
| 1380 | ABJ16598 | 1380 | 31884 | 62388, 92892, 123396, 153900, 184404 | 8396 | AFF57128 | 8396 | 38900 | 69404, 99908, 130412, 160916, 191420 |
| 1381 | ABJ16620 | 1381 | 31885 | 62389, 92893, 123397, 153901, 184405 | 8397 | AFF57132 | 8397 | 38901 | 69405, 99909, 130413, 160917, 191421 |
| 1382 | ABJ16631 | 1382 | 31886 | 62390, 92894, 123398, 153902, 184406 | 8398 | AFF57136 | 8398 | 38902 | 69406, 99910, 130414, 160918, 191422 |
| 1383 | ABJ16664 | 1383 | 31887 | 62391, 92895, 123399, 153903, 184407 | 8399 | AFF57144 | 8399 | 38903 | 69407, 99911, 130415, 160919, 191423 |
| 1384 | ABJ16675 | 1384 | 31888 | 62392, 92896, 123400, 153904, 184408 | 8400 | AFF57148 | 8400 | 38904 | 69408, 99912, 130416, 160920, 191424 |
| 1385 | ABJ16686 | 1385 | 31889 | 62393, 92897, 123401, 153905, 184409 | 8401 | AFF57160 | 8401 | 38905 | 69409, 99913, 130417, 160921, 191425 |
| 1386 | ABJ16697 | 1386 | 31890 | 62394, 92898, 123402, 153906, 184410 | 8402 | AFF57164 | 8402 | 38906 | 69410, 99914, 130418, 160922, 191426 |
| 1387 | ABJ16730 | 1387 | 31891 | 62395, 92899, 123403, 153907, 184411 | 8403 | AFF57168 | 8403 | 38907 | 69411, 99915, 130419, 160923, 191427 |
| 1388 | ABJ16741 | 1388 | 31892 | 62396, 92900, 123404, 153908, 184412 | 8404 | AFF57172 | 8404 | 38908 | 69412, 99916, 130420, 160924, 191428 |
| 1389 | ABJ16752 | 1389 | 31893 | 62397, 92901, 123405, 153909, 184413 | 8405 | AFF57176 | 8405 | 38909 | 69413, 99917, 130421, 160925, 191429 |
| 1390 | ABJ16763 | 1390 | 31894 | 62398, 92902, 123406, 153910, 184414 | 8406 | AFF57184 | 8406 | 38910 | 69414, 99918, 130422, 160926, 191430 |
| 1391 | ABJ16774 | 1391 | 31895 | 62399, 92903, 123407, 153911, 184415 | 8407 | AFF57188 | 8407 | 38911 | 69415, 99919, 130423, 160927, 191431 |
| 1392 | ABJ16785 | 1392 | 31896 | 62400, 92904, 123408, 153912, 184416 | 8408 | AFF60787 | 8408 | 38912 | 69416, 99920, 130424, 160928, 191432 |
| 1393 | ABJ53438 | 1393 | 31897 | 62401, 92905, 123409, 153913, 184417 | 8409 | AFG29042 | 8409 | 38913 | 69417, 99921, 130425, 160929, 191433 |
| 1394 | ABJ53449 | 1394 | 31898 | 62402, 92906, 123410, 153914, 184418 | 8410 | AFG29044 | 8410 | 38914 | 69418, 99922, 130426, 160930, 191434 |
| 1395 | ABJ53471 | 1395 | 31899 | 62403, 92907, 123411, 153915, 184419 | 8411 | AFG31060 | 8411 | 38915 | 69419, 99923, 130427, 160931, 191435 |
| 1396 | ABJ53482 | 1396 | 31900 | 62404, 92908, 123412, 153916, 184420 | 8412 | AFG31070 | 8412 | 38916 | 69420, 99924, 130428, 160932, 191436 |
| 1397 | ABJ53493 | 1397 | 31901 | 62405, 92909, 123413, 153917, 184421 | 8413 | AFG31080 | 8413 | 38917 | 69421, 99925, 130429, 160933, 191437 |

FIG. 1 continued

| | | | | | | | | | |
|---|---|---|---|---|---|---|---|---|---|
| 1398 | ABJ53504 | 1398 | 31902 | 62406, 92910, 123414, 153918, 184422 | 8414 | AFG31100 | 8414 | 38918 | 69422, 99926, 130430, 160934, 191438 |
| 1399 | ABJ53515 | 1399 | 31903 | 62407, 92911, 123415, 153919, 184423 | 8415 | AFG31110 | 8415 | 38919 | 69423, 99927, 130431, 160935, 191439 |
| 1400 | ABK39962 | 1400 | 31904 | 62408, 92912, 123416, 153920, 184424 | 8416 | AFG31120 | 8416 | 38920 | 69424, 99928, 130432, 160936, 191440 |
| 1401 | ABK39973 | 1401 | 31905 | 62409, 92913, 123417, 153921, 184425 | 8417 | AFG31130 | 8417 | 38921 | 69425, 99929, 130433, 160937, 191441 |
| 1402 | ABK39984 | 1402 | 31906 | 62410, 92914, 123418, 153922, 184426 | 8418 | AFG31140 | 8418 | 38922 | 69426, 99930, 130434, 160938, 191442 |
| 1403 | ABK39995 | 1403 | 31907 | 62411, 92915, 123419, 153923, 184427 | 8419 | AFG31150 | 8419 | 38923 | 69427, 99931, 130435, 160939, 191443 |
| 1404 | ABK40017 | 1404 | 31908 | 62412, 92916, 123420, 153924, 184428 | 8420 | AFG31160 | 8420 | 38924 | 69428, 99932, 130436, 160940, 191444 |
| 1405 | ABK40028 | 1405 | 31909 | 62413, 92917, 123421, 153925, 184429 | 8421 | AFG31170 | 8421 | 38925 | 69429, 99933, 130437, 160941, 191445 |
| 1406 | ABK40039 | 1406 | 31910 | 62414, 92918, 123422, 153926, 184430 | 8422 | AFG31180 | 8422 | 38926 | 69430, 99934, 130438, 160942, 191446 |
| 1407 | ABK40050 | 1407 | 31911 | 62415, 92919, 123423, 153927, 184431 | 8423 | AFG31190 | 8423 | 38927 | 69431, 99935, 130439, 160943, 191447 |
| 1408 | ABK40061 | 1408 | 31912 | 62416, 92920, 123424, 153928, 184432 | 8424 | AFG31200 | 8424 | 38928 | 69432, 99936, 130440, 160944, 191448 |
| 1409 | ABK40075 | 1409 | 31913 | 62417, 92921, 123425, 153929, 184433 | 8425 | AFG31210 | 8425 | 38929 | 69433, 99937, 130441, 160945, 191449 |
| 1410 | ABK40510 | 1410 | 31914 | 62418, 92922, 123426, 153930, 184434 | 8426 | AFG31220 | 8426 | 38930 | 69434, 99938, 130442, 160946, 191450 |
| 1411 | ABK40534 | 1411 | 31915 | 62419, 92923, 123427, 153931, 184435 | 8427 | AFG31230 | 8427 | 38931 | 69435, 99939, 130443, 160947, 191451 |
| 1412 | ABK40546 | 1412 | 31916 | 62420, 92924, 123428, 153932, 184436 | 8428 | AFG31240 | 8428 | 38932 | 69436, 99940, 130444, 160948, 191452 |
| 1413 | ABK40557 | 1413 | 31917 | 62421, 92925, 123429, 153933, 184437 | 8429 | AFG31250 | 8429 | 38933 | 69437, 99941, 130445, 160949, 191453 |
| 1414 | ABK40568 | 1414 | 31918 | 62422, 92926, 123430, 153934, 184438 | 8430 | AFG31260 | 8430 | 38934 | 69438, 99942, 130446, 160950, 191454 |
| 1415 | ABK40579 | 1415 | 31919 | 62423, 92927, 123431, 153935, 184439 | 8431 | AFG31270 | 8431 | 38935 | 69439, 99943, 130447, 160951, 191455 |

FIG. 1 continued

| | | | | | | | | | |
|---|---|---|---|---|---|---|---|---|---|
| 1416 | ABK40590 | 1416 | 31920 | 62424, 92928, 123432, 153936, 184440 | 8432 | AFG31280 | 8432 | 38936 | 69440, 99944, 130448, 160952, 191456 |
| 1417 | ABK40601 | 1417 | 31921 | 62425, 92929, 123433, 153937, 184441 | 8433 | AFG31290 | 8433 | 38937 | 69441, 99945, 130449, 160953, 191457 |
| 1418 | ABK40612 | 1418 | 31922 | 62426, 92930, 123434, 153938, 184442 | 8434 | AFG31300 | 8434 | 38938 | 69442, 99946, 130450, 160954, 191458 |
| 1419 | ABK40623 | 1419 | 31923 | 62427, 92931, 123435, 153939, 184443 | 8435 | AFG31310 | 8435 | 38939 | 69443, 99947, 130451, 160955, 191459 |
| 1420 | ABK40645 | 1420 | 31924 | 62428, 92932, 123436, 153940, 184444 | 8436 | AFG31323 | 8436 | 38940 | 69444, 99948, 130452, 160956, 191460 |
| 1421 | ABK40656 | 1421 | 31925 | 62429, 92933, 123437, 153941, 184445 | 8437 | AFG31333 | 8437 | 38941 | 69445, 99949, 130453, 160957, 191461 |
| 1422 | ABK40667 | 1422 | 31926 | 62430, 92934, 123438, 153942, 184446 | 8438 | AFG31343 | 8438 | 38942 | 69446, 99950, 130454, 160958, 191462 |
| 1423 | ABK40678 | 1423 | 31927 | 62431, 92935, 123439, 153943, 184447 | 8439 | AFG31353 | 8439 | 38943 | 69447, 99951, 130455, 160959, 191463 |
| 1424 | ABK40689 | 1424 | 31928 | 62432, 92936, 123440, 153944, 184448 | 8440 | AFG31363 | 8440 | 38944 | 69448, 99952, 130456, 160960, 191464 |
| 1425 | ABK40700 | 1425 | 31929 | 62433, 92937, 123441, 153945, 184449 | 8441 | AFG31376 | 8441 | 38945 | 69449, 99953, 130457, 160961, 191465 |
| 1426 | ABK40711 | 1426 | 31930 | 62434, 92938, 123442, 153946, 184450 | 8442 | AFG31386 | 8442 | 38946 | 69450, 99954, 130458, 160962, 191466 |
| 1427 | ABK40722 | 1427 | 31931 | 62435, 92939, 123443, 153947, 184451 | 8443 | AFG31396 | 8443 | 38947 | 69451, 99955, 130459, 160963, 191467 |
| 1428 | ABK40733 | 1428 | 31932 | 62436, 92940, 123444, 153948, 184452 | 8444 | AFG31406 | 8444 | 38948 | 69452, 99956, 130460, 160964, 191468 |
| 1429 | ABK40744 | 1429 | 31933 | 62437, 92941, 123445, 153949, 184453 | 8445 | AFG31416 | 8445 | 38949 | 69453, 99957, 130461, 160965, 191469 |
| 1430 | ABK79948 | 1430 | 31934 | 62438, 92942, 123446, 153950, 184454 | 8446 | AFG31426 | 8446 | 38950 | 69454, 99958, 130462, 160966, 191470 |
| 1431 | ABK79959 | 1431 | 31935 | 62439, 92943, 123447, 153951, 184455 | 8447 | AFG31436 | 8447 | 38951 | 69455, 99959, 130463, 160967, 191471 |
| 1432 | ABK79970 | 1432 | 31936 | 62440, 92944, 123448, 153952, 184456 | 8448 | AFG31446 | 8448 | 38952 | 69456, 99960, 130464, 160968, 191472 |
| 1433 | ABK79981 | 1433 | 31937 | 62441, 92945, 123449, 153953, 184457 | 8449 | AFG31456 | 8449 | 38953 | 69457, 99961, 130465, 160969, 191473 |

FIG. 1 continued

| | | | | | | | | | |
|---|---|---|---|---|---|---|---|---|---|
| 1434 | ABK79992 | 1434 | 31938 | 62442, 92946, 123450, 153954, 184458 | 8450 | AFG31466 | 8450 | 38954 | 69458, 99962, 130466, 160970, 191474 |
| 1435 | ABK80025 | 1435 | 31939 | 62443, 92947, 123451, 153955, 184459 | 8451 | AFG31486 | 8451 | 38955 | 69459, 99963, 130467, 160971, 191475 |
| 1436 | ABK80036 | 1436 | 31940 | 62444, 92948, 123452, 153956, 184460 | 8452 | AFG31496 | 8452 | 38956 | 69460, 99964, 130468, 160972, 191476 |
| 1437 | ABK80047 | 1437 | 31941 | 62445, 92949, 123453, 153957, 184461 | 8453 | AFG31506 | 8453 | 38957 | 69461, 99965, 130469, 160973, 191477 |
| 1438 | ABK80058 | 1438 | 31942 | 62446, 92950, 123454, 153958, 184462 | 8454 | AFG31516 | 8454 | 38958 | 69462, 99966, 130470, 160974, 191478 |
| 1439 | ABK80069 | 1439 | 31943 | 62447, 92951, 123455, 153959, 184463 | 8455 | AFG31526 | 8455 | 38959 | 69463, 99967, 130471, 160975, 191479 |
| 1440 | ABK80080 | 1440 | 31944 | 62448, 92952, 123456, 153960, 184464 | 8456 | AFG31536 | 8456 | 38960 | 69464, 99968, 130472, 160976, 191480 |
| 1441 | ABK80091 | 1441 | 31945 | 62449, 92953, 123457, 153961, 184465 | 8457 | AFG31546 | 8457 | 38961 | 69465, 99969, 130473, 160977, 191481 |
| 1442 | ABK80102 | 1442 | 31946 | 62450, 92954, 123458, 153962, 184466 | 8458 | AFG31556 | 8458 | 38962 | 69466, 99970, 130474, 160978, 191482 |
| 1443 | ABK80113 | 1443 | 31947 | 62451, 92955, 123459, 153963, 184467 | 8459 | AFG31566 | 8459 | 38963 | 69467, 99971, 130475, 160979, 191483 |
| 1444 | ABK80124 | 1444 | 31948 | 62452, 92956, 123460, 153964, 184468 | 8460 | AFG31586 | 8460 | 38964 | 69468, 99972, 130476, 160980, 191484 |
| 1445 | ABK80135 | 1445 | 31949 | 62453, 92957, 123461, 153965, 184469 | 8461 | AFG31596 | 8461 | 38965 | 69469, 99973, 130477, 160981, 191485 |
| 1446 | ABK80146 | 1446 | 31950 | 62454, 92958, 123462, 153966, 184470 | 8462 | AFG31606 | 8462 | 38966 | 69470, 99974, 130478, 160982, 191486 |
| 1447 | ABK80157 | 1447 | 31951 | 62455, 92959, 123463, 153967, 184471 | 8463 | AFG31616 | 8463 | 38967 | 69471, 99975, 130479, 160983, 191487 |
| 1448 | ABK80168 | 1448 | 31952 | 62456, 92960, 123464, 153968, 184472 | 8464 | AFG31626 | 8464 | 38968 | 69472, 99976, 130480, 160984, 191488 |
| 1449 | ABK80179 | 1449 | 31953 | 62457, 92961, 123465, 153969, 184473 | 8465 | AFG31636 | 8465 | 38969 | 69473, 99977, 130481, 160985, 191489 |
| 1450 | ABK80190 | 1450 | 31954 | 62458, 92962, 123466, 153970, 184474 | 8466 | AFG31646 | 8466 | 38970 | 69474, 99978, 130482, 160986, 191490 |
| 1451 | ABK80201 | 1451 | 31955 | 62459, 92963, 123467, 153971, 184475 | 8467 | AFG31656 | 8467 | 38971 | 69475, 99979, 130483, 160987, 191491 |

FIG. 1 continued

| | | | | | | | | | |
|---|---|---|---|---|---|---|---|---|---|
| 1452 | ABK80212 | 1452 | 31956 | 62460, 92964, 123468, 153972, 184476 | 8468 | AFG31666 | 8468 | 38972 | 69476, 99980, 130484, 160988, 191492 |
| 1453 | ABK80223 | 1453 | 31957 | 62461, 92965, 123469, 153973, 184477 | 8469 | AFG71865 | 8469 | 38973 | 69477, 99981, 130485, 160989, 191493 |
| 1454 | ABK80234 | 1454 | 31958 | 62462, 92966, 123470, 153974, 184478 | 8470 | AFG71876 | 8470 | 38974 | 69478, 99982, 130486, 160990, 191494 |
| 1455 | ABK80245 | 1455 | 31959 | 62463, 92967, 123471, 153975, 184479 | 8471 | AFG71898 | 8471 | 38975 | 69479, 99983, 130487, 160991, 191495 |
| 1456 | ABK80256 | 1456 | 31960 | 62464, 92968, 123472, 153976, 184480 | 8472 | AFG71920 | 8472 | 38976 | 69480, 99984, 130488, 160992, 191496 |
| 1457 | ABK80267 | 1457 | 31961 | 62465, 92969, 123473, 153977, 184481 | 8473 | AFG71931 | 8473 | 38977 | 69481, 99985, 130489, 160993, 191497 |
| 1458 | ABK80278 | 1458 | 31962 | 62466, 92970, 123474, 153978, 184482 | 8474 | AFG71942 | 8474 | 38978 | 69482, 99986, 130490, 160994, 191498 |
| 1459 | ABK80289 | 1459 | 31963 | 62467, 92971, 123475, 153979, 184483 | 8475 | AFG71953 | 8475 | 38979 | 69483, 99987, 130491, 160995, 191499 |
| 1460 | ABK80300 | 1460 | 31964 | 62468, 92972, 123476, 153980, 184484 | 8476 | AFG71975 | 8476 | 38980 | 69484, 99988, 130492, 160996, 191500 |
| 1461 | ABK80311 | 1461 | 31965 | 62469, 92973, 123477, 153981, 184485 | 8477 | AFG71996 | 8477 | 38981 | 69485, 99989, 130493, 160997, 191501 |
| 1462 | ABL07019 | 1462 | 31966 | 62470, 92974, 123478, 153982, 184486 | 8478 | AFG72007 | 8478 | 38982 | 69486, 99990, 130494, 160998, 191502 |
| 1463 | ABL07030 | 1463 | 31967 | 62471, 92975, 123479, 153983, 184487 | 8479 | AFG72029 | 8479 | 38983 | 69487, 99991, 130495, 160999, 191503 |
| 1464 | ABL10088 | 1464 | 31968 | 62472, 92976, 123480, 153984, 184488 | 8480 | AFG72040 | 8480 | 38984 | 69488, 99992, 130496, 161000, 191504 |
| 1465 | ABL31766 | 1465 | 31969 | 62473, 92977, 123481, 153985, 184489 | 8481 | AFG72051 | 8481 | 38985 | 69489, 99993, 130497, 161001, 191505 |
| 1466 | ABL31780 | 1466 | 31970 | 62474, 92978, 123482, 153986, 184490 | 8482 | AFG72085 | 8482 | 38986 | 69490, 99994, 130498, 161002, 191506 |
| 1467 | ABL67165 | 1467 | 31971 | 62475, 92979, 123483, 153987, 184491 | 8483 | AFG72107 | 8483 | 38987 | 69491, 99995, 130499, 161003, 191507 |
| 1468 | ABL67176 | 1468 | 31972 | 62476, 92980, 123484, 153988, 184492 | 8484 | AFG72118 | 8484 | 38988 | 69492, 99996, 130500, 161004, 191508 |
| 1469 | ABL67187 | 1469 | 31973 | 62477, 92981, 123485, 153989, 184493 | 8485 | AFG72129 | 8485 | 38989 | 69493, 99997, 130501, 161005, 191509 |

FIG. 1 continued

| | | | | | | | | | |
|---|---|---|---|---|---|---|---|---|---|
| 1470 | ABL67209 | 1470 | 31974 | 62478, 92982, 123486, 153990, 184494 | 8486 | AFG72140 | 8486 | 38990 | 69494, 99998, 130502, 161006, 191510 |
| 1471 | ABL67253 | 1471 | 31975 | 62479, 92983, 123487, 153991, 184495 | 8487 | AFG72151 | 8487 | 38991 | 69495, 99999, 130503, 161007, 191511 |
| 1472 | ABL67264 | 1472 | 31976 | 62480, 92984, 123488, 153992, 184496 | 8488 | AFG72184 | 8488 | 38992 | 69496, 100000, 130504, 161008, 191512 |
| 1473 | ABL67275 | 1473 | 31977 | 62481, 92985, 123489, 153993, 184497 | 8489 | AFG72195 | 8489 | 38993 | 69497, 100001, 130505, 161009, 191513 |
| 1474 | ABL67286 | 1474 | 31978 | 62482, 92986, 123490, 153994, 184498 | 8490 | AFG72206 | 8490 | 38994 | 69498, 100002, 130506, 161010, 191514 |
| 1475 | ABL67297 | 1475 | 31979 | 62483, 92987, 123491, 153995, 184499 | 8491 | AFG72217 | 8491 | 38995 | 69499, 100003, 130507, 161011, 191515 |
| 1476 | ABL67308 | 1476 | 31980 | 62484, 92988, 123492, 153996, 184500 | 8492 | AFG72228 | 8492 | 38996 | 69500, 100004, 130508, 161012, 191516 |
| 1477 | ABL67319 | 1477 | 31981 | 62485, 92989, 123493, 153997, 184501 | 8493 | AFG72239 | 8493 | 38997 | 69501, 100005, 130509, 161013, 191517 |
| 1478 | ABL67330 | 1478 | 31982 | 62486, 92990, 123494, 153998, 184502 | 8494 | AFG72272 | 8494 | 38998 | 69502, 100006, 130510, 161014, 191518 |
| 1479 | ABL67341 | 1479 | 31983 | 62487, 92991, 123495, 153999, 184503 | 8495 | AFG72316 | 8495 | 38999 | 69503, 100007, 130511, 161015, 191519 |
| 1480 | ABL67352 | 1480 | 31984 | 62488, 92992, 123496, 154000, 184504 | 8496 | AFG72339 | 8496 | 39000 | 69504, 100008, 130512, 161016, 191520 |
| 1481 | ABL67363 | 1481 | 31985 | 62489, 92993, 123497, 154001, 184505 | 8497 | AFG72350 | 8497 | 39001 | 69505, 100009, 130513, 161017, 191521 |
| 1482 | ABL67374 | 1482 | 31986 | 62490, 92994, 123498, 154002, 184506 | 8498 | AFG72372 | 8498 | 39002 | 69506, 100010, 130514, 161018, 191522 |
| 1483 | ABL67385 | 1483 | 31987 | 62491, 92995, 123499, 154003, 184507 | 8499 | AFG72383 | 8499 | 39003 | 69507, 100011, 130515, 161019, 191523 |
| 1484 | ABL67396 | 1484 | 31988 | 62492, 92996, 123500, 154004, 184508 | 8500 | AFG72394 | 8500 | 39004 | 69508, 100012, 130516, 161020, 191524 |
| 1485 | ABL67407 | 1485 | 31989 | 62493, 92997, 123501, 154005, 184509 | 8501 | AFG72405 | 8501 | 39005 | 69509, 100013, 130517, 161021, 191525 |
| 1486 | ABL67418 | 1486 | 31990 | 62494, 92998, 123502, 154006, 184510 | 8502 | AFG72449 | 8502 | 39006 | 69510, 100014, 130518, 161022, 191526 |
| 1487 | ABL67781 | 1487 | 31991 | 62495, 92999, 123503, 154007, 184511 | 8503 | AFG72460 | 8503 | 39007 | 69511, 100015, 130519, 161023, 191527 |

FIG. 1 continued

| | | | | | | | | | |
|---|---|---|---|---|---|---|---|---|---|
| 1488 | ABL67794 | 1488 | 31992 | 62496, 93000, 123504, 154008, 184512 | 8504 | AFG72504 | 8504 | 39008 | 69512, 100016, 130520, 161024, 191528 |
| 1489 | ABL67816 | 1489 | 31993 | 62497, 93001, 123505, 154009, 184513 | 8505 | AFG72515 | 8505 | 39009 | 69513, 100017, 130521, 161025, 191529 |
| 1490 | ABL67827 | 1490 | 31994 | 62498, 93002, 123506, 154010, 184514 | 8506 | AFG72526 | 8506 | 39010 | 69514, 100018, 130522, 161026, 191530 |
| 1491 | ABM22015 | 1491 | 31995 | 62499, 93003, 123507, 154011, 184515 | 8507 | AFG72581 | 8507 | 39011 | 69515, 100019, 130523, 161027, 191531 |
| 1492 | ABM22026 | 1492 | 31996 | 62500, 93004, 123508, 154012, 184516 | 8508 | AFG72603 | 8508 | 39012 | 69516, 100020, 130524, 161028, 191532 |
| 1493 | ABM22037 | 1493 | 31997 | 62501, 93005, 123509, 154013, 184517 | 8509 | AFG72614 | 8509 | 39013 | 69517, 100021, 130525, 161029, 191533 |
| 1494 | ABM22059 | 1494 | 31998 | 62502, 93006, 123510, 154014, 184518 | 8510 | AFG72625 | 8510 | 39014 | 69518, 100022, 130526, 161030, 191534 |
| 1495 | ABM22070 | 1495 | 31999 | 62503, 93007, 123511, 154015, 184519 | 8511 | AFG72636 | 8511 | 39015 | 69519, 100023, 130527, 161031, 191535 |
| 1496 | ABM22081 | 1496 | 32000 | 62504, 93008, 123512, 154016, 184520 | 8512 | AFG72658 | 8512 | 39016 | 69520, 100024, 130528, 161032, 191536 |
| 1497 | ABM22092 | 1497 | 32001 | 62505, 93009, 123513, 154017, 184521 | 8513 | AFG72680 | 8513 | 39017 | 69521, 100025, 130529, 161033, 191537 |
| 1498 | ABM22103 | 1498 | 32002 | 62506, 93010, 123514, 154018, 184522 | 8514 | AFG72691 | 8514 | 39018 | 69522, 100026, 130530, 161034, 191538 |
| 1499 | ABM22114 | 1499 | 32003 | 62507, 93011, 123515, 154019, 184523 | 8515 | AFG72713 | 8515 | 39019 | 69523, 100027, 130531, 161035, 191539 |
| 1500 | ABM22125 | 1500 | 32004 | 62508, 93012, 123516, 154020, 184524 | 8516 | AFG72724 | 8516 | 39020 | 69524, 100028, 130532, 161036, 191540 |
| 1501 | ABM22136 | 1501 | 32005 | 62509, 93013, 123517, 154021, 184525 | 8517 | AFG72735 | 8517 | 39021 | 69525, 100029, 130533, 161037, 191541 |
| 1502 | ABM22147 | 1502 | 32006 | 62510, 93014, 123518, 154022, 184526 | 8518 | AFG72757 | 8518 | 39022 | 69526, 100030, 130534, 161038, 191542 |
| 1503 | ABM22158 | 1503 | 32007 | 62511, 93015, 123519, 154023, 184527 | 8519 | AFG72779 | 8519 | 39023 | 69527, 100031, 130535, 161039, 191543 |
| 1504 | ABM22169 | 1504 | 32008 | 62512, 93016, 123520, 154024, 184528 | 8520 | AFG72801 | 8520 | 39024 | 69528, 100032, 130536, 161040, 191544 |
| 1505 | ABM22180 | 1505 | 32009 | 62513, 93017, 123521, 154025, 184529 | 8521 | AFG72812 | 8521 | 39025 | 69529, 100033, 130537, 161041, 191545 |

FIG. 1 continued

| | | | | | | | | | |
|---|---|---|---|---|---|---|---|---|---|
| 1506 | ABM22191 | 1506 | 32010 | 62514, 93018, 123522, 154026, 184530 | 8522 | AFG72823 | 8522 | 39026 | 69530, 100034, 130538, 161042, 191546 |
| 1507 | ABM22202 | 1507 | 32011 | 62515, 93019, 123523, 154027, 184531 | 8523 | AFG72834 | 8523 | 39027 | 69531, 100035, 130539, 161043, 191547 |
| 1508 | ABM22213 | 1508 | 32012 | 62516, 93020, 123524, 154028, 184532 | 8524 | AFG72845 | 8524 | 39028 | 69532, 100036, 130540, 161044, 191548 |
| 1509 | ABM22224 | 1509 | 32013 | 62517, 93021, 123525, 154029, 184533 | 8525 | AFG72856 | 8525 | 39029 | 69533, 100037, 130541, 161045, 191549 |
| 1510 | ABM22235 | 1510 | 32014 | 62518, 93022, 123526, 154030, 184534 | 8526 | AFG72867 | 8526 | 39030 | 69534, 100038, 130542, 161046, 191550 |
| 1511 | ABM22268 | 1511 | 32015 | 62519, 93023, 123527, 154031, 184535 | 8527 | AFG72922 | 8527 | 39031 | 69535, 100039, 130543, 161047, 191551 |
| 1512 | ABM22279 | 1512 | 32016 | 62520, 93024, 123528, 154032, 184536 | 8528 | AFG72933 | 8528 | 39032 | 69536, 100040, 130544, 161048, 191552 |
| 1513 | ABM22290 | 1513 | 32017 | 62521, 93025, 123529, 154033, 184537 | 8529 | AFG72955 | 8529 | 39033 | 69537, 100041, 130545, 161049, 191553 |
| 1514 | ABM22301 | 1514 | 32018 | 62522, 93026, 123530, 154034, 184538 | 8530 | AFG98808 | 8530 | 39034 | 69538, 100042, 130546, 161050, 191554 |
| 1515 | ABM22312 | 1515 | 32019 | 62523, 93027, 123531, 154035, 184539 | 8531 | AFG98819 | 8531 | 39035 | 69539, 100043, 130547, 161051, 191555 |
| 1516 | ABM22323 | 1516 | 32020 | 62524, 93028, 123532, 154036, 184540 | 8532 | AFG98830 | 8532 | 39036 | 69540, 100044, 130548, 161052, 191556 |
| 1517 | ABM22334 | 1517 | 32021 | 62525, 93029, 123533, 154037, 184541 | 8533 | AFG98841 | 8533 | 39037 | 69541, 100045, 130549, 161053, 191557 |
| 1518 | ABM22345 | 1518 | 32022 | 62526, 93030, 123534, 154038, 184542 | 8534 | AFG98852 | 8534 | 39038 | 69542, 100046, 130550, 161054, 191558 |
| 1519 | ABM22356 | 1519 | 32023 | 62527, 93031, 123535, 154039, 184543 | 8535 | AFG98863 | 8535 | 39039 | 69543, 100047, 130551, 161055, 191559 |
| 1520 | ABM22367 | 1520 | 32024 | 62528, 93032, 123536, 154040, 184544 | 8536 | AFG98874 | 8536 | 39040 | 69544, 100048, 130552, 161056, 191560 |
| 1521 | ABM66864 | 1521 | 32025 | 62529, 93033, 123537, 154041, 184545 | 8537 | AFG98885 | 8537 | 39041 | 69545, 100049, 130553, 161057, 191561 |
| 1522 | ABM66886 | 1522 | 32026 | 62530, 93034, 123538, 154042, 184546 | 8538 | AFG98896 | 8538 | 39042 | 69546, 100050, 130554, 161058, 191562 |
| 1523 | ABM66897 | 1523 | 32027 | 62531, 93035, 123539, 154043, 184547 | 8539 | AFG98907 | 8539 | 39043 | 69547, 100051, 130555, 161059, 191563 |

FIG. 1 continued

| | | | | | | | | | |
|---|---|---|---|---|---|---|---|---|---|
| 1524 | ABM66908 | 1524 | 32028 | 62532, 93036, 123540, 154044, 184548 | 8540 | AFG98918 | 8540 | 39044 | 69548, 100052, 130556, 161060, 191564 |
| 1525 | ABM66919 | 1525 | 32029 | 62533, 93037, 123541, 154045, 184549 | 8541 | AFG98929 | 8541 | 39045 | 69549, 100053, 130557, 161061, 191565 |
| 1526 | ABM66930 | 1526 | 32030 | 62534, 93038, 123542, 154046, 184550 | 8542 | AFG98940 | 8542 | 39046 | 69550, 100054, 130558, 161062, 191566 |
| 1527 | ABM66941 | 1527 | 32031 | 62535, 93039, 123543, 154047, 184551 | 8543 | AFG98962 | 8543 | 39047 | 69551, 100055, 130559, 161063, 191567 |
| 1528 | ABM66952 | 1528 | 32032 | 62536, 93040, 123544, 154048, 184552 | 8544 | AFG98973 | 8544 | 39048 | 69552, 100056, 130560, 161064, 191568 |
| 1529 | ABM66963 | 1529 | 32033 | 62537, 93041, 123545, 154049, 184553 | 8545 | AFG98984 | 8545 | 39049 | 69553, 100057, 130561, 161065, 191569 |
| 1530 | ABM66974 | 1530 | 32034 | 62538, 93042, 123546, 154050, 184554 | 8546 | AFG98995 | 8546 | 39050 | 69554, 100058, 130562, 161066, 191570 |
| 1531 | ABM66985 | 1531 | 32035 | 62539, 93043, 123547, 154051, 184555 | 8547 | AFG99006 | 8547 | 39051 | 69555, 100059, 130563, 161067, 191571 |
| 1532 | ABM66996 | 1532 | 32036 | 62540, 93044, 123548, 154052, 184556 | 8548 | AFG99017 | 8548 | 39052 | 69556, 100060, 130564, 161068, 191572 |
| 1533 | ABM67007 | 1533 | 32037 | 62541, 93045, 123549, 154053, 184557 | 8549 | AFG99028 | 8549 | 39053 | 69557, 100061, 130565, 161069, 191573 |
| 1534 | ABM67018 | 1534 | 32038 | 62542, 93046, 123550, 154054, 184558 | 8550 | AFG99039 | 8550 | 39054 | 69558, 100062, 130566, 161070, 191574 |
| 1535 | ABM67029 | 1535 | 32039 | 62543, 93047, 123551, 154055, 184559 | 8551 | AFG99050 | 8551 | 39055 | 69559, 100063, 130567, 161071, 191575 |
| 1536 | ABM67051 | 1536 | 32040 | 62544, 93048, 123552, 154056, 184560 | 8552 | AFG99061 | 8552 | 39056 | 69560, 100064, 130568, 161072, 191576 |
| 1537 | ABM90467 | 1537 | 32041 | 62545, 93049, 123553, 154057, 184561 | 8553 | AFG99072 | 8553 | 39057 | 69561, 100065, 130569, 161073, 191577 |
| 1538 | ABM90511 | 1538 | 32042 | 62546, 93050, 123554, 154058, 184562 | 8554 | AFG99083 | 8554 | 39058 | 69562, 100066, 130570, 161074, 191578 |
| 1539 | ABM90533 | 1539 | 32043 | 62547, 93051, 123555, 154059, 184563 | 8555 | AFG99094 | 8555 | 39059 | 69563, 100067, 130571, 161075, 191579 |
| 1540 | ABM90544 | 1540 | 32044 | 62548, 93052, 123556, 154060, 184564 | 8556 | AFG99116 | 8556 | 39060 | 69564, 100068, 130572, 161076, 191580 |
| 1541 | ABN50900 | 1541 | 32045 | 62549, 93053, 123557, 154061, 184565 | 8557 | AFG99127 | 8557 | 39061 | 69565, 100069, 130573, 161077, 191581 |

FIG. 1 continued

| | | | | | | | | | |
|---|---|---|---|---|---|---|---|---|---|
| 1542 | ABN50917 | 1542 | 32046 | 62550, 93054, 123558, 154062, 184566 | 8558 | AFG99138 | 8558 | 39062 | 69566, 100070, 130574, 161078, 191582 |
| 1543 | ABN50928 | 1543 | 32047 | 62551, 93055, 123559, 154063, 184567 | 8559 | AFG99149 | 8559 | 39063 | 69567, 100071, 130575, 161079, 191583 |
| 1544 | ABN50940 | 1544 | 32048 | 62552, 93056, 123560, 154064, 184568 | 8560 | AFG99171 | 8560 | 39064 | 69568, 100072, 130576, 161080, 191584 |
| 1545 | ABN50951 | 1545 | 32049 | 62553, 93057, 123561, 154065, 184569 | 8561 | AFG99182 | 8561 | 39065 | 69569, 100073, 130577, 161081, 191585 |
| 1546 | ABN50962 | 1546 | 32050 | 62554, 93058, 123562, 154066, 184570 | 8562 | AFG99193 | 8562 | 39066 | 69570, 100074, 130578, 161082, 191586 |
| 1547 | ABN50973 | 1547 | 32051 | 62555, 93059, 123563, 154067, 184571 | 8563 | AFG99204 | 8563 | 39067 | 69571, 100075, 130579, 161083, 191587 |
| 1548 | ABN50984 | 1548 | 32052 | 62556, 93060, 123564, 154068, 184572 | 8564 | AFG99215 | 8564 | 39068 | 69572, 100076, 130580, 161084, 191588 |
| 1549 | ABN50995 | 1549 | 32053 | 62557, 93061, 123565, 154069, 184573 | 8565 | AFG99226 | 8565 | 39069 | 69573, 100077, 130581, 161085, 191589 |
| 1550 | ABN51043 | 1550 | 32054 | 62558, 93062, 123566, 154070, 184574 | 8566 | AFG99237 | 8566 | 39070 | 69574, 100078, 130582, 161086, 191590 |
| 1551 | ABN51054 | 1551 | 32055 | 62559, 93063, 123567, 154071, 184575 | 8567 | AFG99248 | 8567 | 39071 | 69575, 100079, 130583, 161087, 191591 |
| 1552 | ABN51066 | 1552 | 32056 | 62560, 93064, 123568, 154072, 184576 | 8568 | AFG99259 | 8568 | 39072 | 69576, 100080, 130584, 161088, 191592 |
| 1553 | ABN51077 | 1553 | 32057 | 62561, 93065, 123569, 154073, 184577 | 8569 | AFG99270 | 8569 | 39073 | 69577, 100081, 130585, 161089, 191593 |
| 1554 | ABN51088 | 1554 | 32058 | 62562, 93066, 123570, 154074, 184578 | 8570 | AFG99281 | 8570 | 39074 | 69578, 100082, 130586, 161090, 191594 |
| 1555 | ABN51099 | 1555 | 32059 | 62563, 93067, 123571, 154075, 184579 | 8571 | AFG99292 | 8571 | 39075 | 69579, 100083, 130587, 161091, 191595 |
| 1556 | ABN51110 | 1556 | 32060 | 62564, 93068, 123572, 154076, 184580 | 8572 | AFG99303 | 8572 | 39076 | 69580, 100084, 130588, 161092, 191596 |
| 1557 | ABN51121 | 1557 | 32061 | 62565, 93069, 123573, 154077, 184581 | 8573 | AFG99314 | 8573 | 39077 | 69581, 100085, 130589, 161093, 191597 |
| 1558 | ABN51132 | 1558 | 32062 | 62566, 93070, 123574, 154078, 184582 | 8574 | AFG99336 | 8574 | 39078 | 69582, 100086, 130590, 161094, 191598 |
| 1559 | ABN51143 | 1559 | 32063 | 62567, 93071, 123575, 154079, 184583 | 8575 | AFG99347 | 8575 | 39079 | 69583, 100087, 130591, 161095, 191599 |

FIG. 1 continued

| | | | | | | | | | |
|---|---|---|---|---|---|---|---|---|---|
| 1560 | ABN51154 | 1560 | 32064 | 62568, 93072, 123576, 154080, 184584 | 8576 | AFG99358 | 8576 | 39080 | 69584, 100088, 130592, 161096, 191600 |
| 1561 | ABN59390 | 1561 | 32065 | 62569, 93073, 123577, 154081, 184585 | 8577 | AFG99369 | 8577 | 39081 | 69585, 100089, 130593, 161097, 191601 |
| 1562 | ABN59401 | 1562 | 32066 | 62570, 93074, 123578, 154082, 184586 | 8578 | AFG99380 | 8578 | 39082 | 69586, 100090, 130594, 161098, 191602 |
| 1563 | ABN59412 | 1563 | 32067 | 62571, 93075, 123579, 154083, 184587 | 8579 | AFG99391 | 8579 | 39083 | 69587, 100091, 130595, 161099, 191603 |
| 1564 | ABN59423 | 1564 | 32068 | 62572, 93076, 123580, 154084, 184588 | 8580 | AFG99402 | 8580 | 39084 | 69588, 100092, 130596, 161100, 191604 |
| 1565 | AB032656 | 1565 | 32069 | 62573, 93077, 123581, 154085, 184589 | 8581 | AFG99413 | 8581 | 39085 | 69589, 100093, 130597, 161101, 191605 |
| 1566 | AB032667 | 1566 | 32070 | 62574, 93078, 123582, 154086, 184590 | 8582 | AFG99424 | 8582 | 39086 | 69590, 100094, 130598, 161102, 191606 |
| 1567 | AB032678 | 1567 | 32071 | 62575, 93079, 123583, 154087, 184591 | 8583 | AFG99435 | 8583 | 39087 | 69591, 100095, 130599, 161103, 191607 |
| 1568 | AB032692 | 1568 | 32072 | 62576, 93080, 123584, 154088, 184592 | 8584 | AFG99446 | 8584 | 39088 | 69592, 100096, 130600, 161104, 191608 |
| 1569 | AB032751 | 1569 | 32073 | 62577, 93081, 123585, 154089, 184593 | 8585 | AFG99457 | 8585 | 39089 | 69593, 100097, 130601, 161105, 191609 |
| 1570 | AB032762 | 1570 | 32074 | 62578, 93082, 123586, 154090, 184594 | 8586 | AFG99468 | 8586 | 39090 | 69594, 100098, 130602, 161106, 191610 |
| 1571 | AB032775 | 1571 | 32075 | 62579, 93083, 123587, 154091, 184595 | 8587 | AFG99490 | 8587 | 39091 | 69595, 100099, 130603, 161107, 191611 |
| 1572 | AB032790 | 1572 | 32076 | 62580, 93084, 123588, 154092, 184596 | 8588 | AFG99501 | 8588 | 39092 | 69596, 100100, 130604, 161108, 191612 |
| 1573 | AB032803 | 1573 | 32077 | 62581, 93085, 123589, 154093, 184597 | 8589 | AFG99512 | 8589 | 39093 | 69597, 100101, 130605, 161109, 191613 |
| 1574 | AB032816 | 1574 | 32078 | 62582, 93086, 123590, 154094, 184598 | 8590 | AFG99523 | 8590 | 39094 | 69598, 100102, 130606, 161110, 191614 |
| 1575 | AB032827 | 1575 | 32079 | 62583, 93087, 123591, 154095, 184599 | 8591 | AFG99534 | 8591 | 39095 | 69599, 100103, 130607, 161111, 191615 |
| 1576 | AB032838 | 1576 | 32080 | 62584, 93088, 123592, 154096, 184600 | 8592 | AFG99545 | 8592 | 39096 | 69600, 100104, 130608, 161112, 191616 |
| 1577 | AB032849 | 1577 | 32081 | 62585, 93089, 123593, 154097, 184601 | 8593 | AFG99556 | 8593 | 39097 | 69601, 100105, 130609, 161113, 191617 |

FIG. 1 continued

| | | | | | | | | | |
|---|---|---|---|---|---|---|---|---|---|
| 1578 | AB032860 | 1578 | 32082 | 62586, 93090, 123594, 154098, 184602 | 8594 | AFG99567 | 8594 | 39098 | 69602, 100106, 130610, 161114, 191618 |
| 1579 | AB032871 | 1579 | 32083 | 62587, 93091, 123595, 154099, 184603 | 8595 | AFG99578 | 8595 | 39099 | 69603, 100107, 130611, 161115, 191619 |
| 1580 | AB032882 | 1580 | 32084 | 62588, 93092, 123596, 154100, 184604 | 8596 | AFG99589 | 8596 | 39100 | 69604, 100108, 130612, 161116, 191620 |
| 1581 | AB032893 | 1581 | 32085 | 62589, 93093, 123597, 154101, 184605 | 8597 | AFG99600 | 8597 | 39101 | 69605, 100109, 130613, 161117, 191621 |
| 1582 | AB032904 | 1582 | 32086 | 62590, 93094, 123598, 154102, 184606 | 8598 | AFG99611 | 8598 | 39102 | 69606, 100110, 130614, 161118, 191622 |
| 1583 | AB032915 | 1583 | 32087 | 62591, 93095, 123599, 154103, 184607 | 8599 | AFG99622 | 8599 | 39103 | 69607, 100111, 130615, 161119, 191623 |
| 1584 | AB032926 | 1584 | 32088 | 62592, 93096, 123600, 154104, 184608 | 8600 | AFG99633 | 8600 | 39104 | 69608, 100112, 130616, 161120, 191624 |
| 1585 | AB032937 | 1585 | 32089 | 62593, 93097, 123601, 154105, 184609 | 8601 | AFG99644 | 8601 | 39105 | 69609, 100113, 130617, 161121, 191625 |
| 1586 | AB032948 | 1586 | 32090 | 62594, 93098, 123602, 154106, 184610 | 8602 | AFG99655 | 8602 | 39106 | 69610, 100114, 130618, 161122, 191626 |
| 1587 | AB032959 | 1587 | 32091 | 62595, 93099, 123603, 154107, 184611 | 8603 | AFG99666 | 8603 | 39107 | 69611, 100115, 130619, 161123, 191627 |
| 1588 | AB032970 | 1588 | 32092 | 62596, 93100, 123604, 154108, 184612 | 8604 | AFG99677 | 8604 | 39108 | 69612, 100116, 130620, 161124, 191628 |
| 1589 | AB032981 | 1589 | 32093 | 62597, 93101, 123605, 154109, 184613 | 8605 | AFG99688 | 8605 | 39109 | 69613, 100117, 130621, 161125, 191629 |
| 1590 | AB032992 | 1590 | 32094 | 62598, 93102, 123606, 154110, 184614 | 8606 | AFG99701 | 8606 | 39110 | 69614, 100118, 130622, 161126, 191630 |
| 1591 | AB033006 | 1591 | 32095 | 62599, 93103, 123607, 154111, 184615 | 8607 | AFG99712 | 8607 | 39111 | 69615, 100119, 130623, 161127, 191631 |
| 1592 | AB033025 | 1592 | 32096 | 62600, 93104, 123608, 154112, 184616 | 8608 | AFG99723 | 8608 | 39112 | 69616, 100120, 130624, 161128, 191632 |
| 1593 | AB033036 | 1593 | 32097 | 62601, 93105, 123609, 154113, 184617 | 8609 | AFG99734 | 8609 | 39113 | 69617, 100121, 130625, 161129, 191633 |
| 1594 | AB033047 | 1594 | 32098 | 62602, 93106, 123610, 154114, 184618 | 8610 | AFG99745 | 8610 | 39114 | 69618, 100122, 130626, 161130, 191634 |
| 1595 | AB033058 | 1595 | 32099 | 62603, 93107, 123611, 154115, 184619 | 8611 | AFG99756 | 8611 | 39115 | 69619, 100123, 130627, 161131, 191635 |

FIG. 1 continued

| | | | | | | | | | |
|---|---|---|---|---|---|---|---|---|---|
| 1596 | AB033069 | 1596 | 32100 | 62604, 93108, 123612, 154116, 184620 | 8612 | AFG99767 | 8612 | 39116 | 69620, 100124, 130628, 161132, 191636 |
| 1597 | AB037988 | 1597 | 32101 | 62605, 93109, 123613, 154117, 184621 | 8613 | AFG99778 | 8613 | 39117 | 69621, 100125, 130629, 161133, 191637 |
| 1598 | AB038010 | 1598 | 32102 | 62606, 93110, 123614, 154118, 184622 | 8614 | AFG99789 | 8614 | 39118 | 69622, 100126, 130630, 161134, 191638 |
| 1599 | AB038021 | 1599 | 32103 | 62607, 93111, 123615, 154119, 184623 | 8615 | AFG99800 | 8615 | 39119 | 69623, 100127, 130631, 161135, 191639 |
| 1600 | AB038032 | 1600 | 32104 | 62608, 93112, 123616, 154120, 184624 | 8616 | AFG99811 | 8616 | 39120 | 69624, 100128, 130632, 161136, 191640 |
| 1601 | AB038043 | 1601 | 32105 | 62609, 93113, 123617, 154121, 184625 | 8617 | AFG99822 | 8617 | 39121 | 69625, 100129, 130633, 161137, 191641 |
| 1602 | AB038054 | 1602 | 32106 | 62610, 93114, 123618, 154122, 184626 | 8618 | AFG99833 | 8618 | 39122 | 69626, 100130, 130634, 161138, 191642 |
| 1603 | AB038065 | 1603 | 32107 | 62611, 93115, 123619, 154123, 184627 | 8619 | AFG99844 | 8619 | 39123 | 69627, 100131, 130635, 161139, 191643 |
| 1604 | AB038076 | 1604 | 32108 | 62612, 93116, 123620, 154124, 184628 | 8620 | AFG99855 | 8620 | 39124 | 69628, 100132, 130636, 161140, 191644 |
| 1605 | AB038087 | 1605 | 32109 | 62613, 93117, 123621, 154125, 184629 | 8621 | AFG99866 | 8621 | 39125 | 69629, 100133, 130637, 161141, 191645 |
| 1606 | AB038098 | 1606 | 32110 | 62614, 93118, 123622, 154126, 184630 | 8622 | AFG99877 | 8622 | 39126 | 69630, 100134, 130638, 161142, 191646 |
| 1607 | AB038230 | 1607 | 32111 | 62615, 93119, 123623, 154127, 184631 | 8623 | AFG99888 | 8623 | 39127 | 69631, 100135, 130639, 161143, 191647 |
| 1608 | AB038241 | 1608 | 32112 | 62616, 93120, 123624, 154128, 184632 | 8624 | AFG99899 | 8624 | 39128 | 69632, 100136, 130640, 161144, 191648 |
| 1609 | AB038252 | 1609 | 32113 | 62617, 93121, 123625, 154129, 184633 | 8625 | AFG99910 | 8625 | 39129 | 69633, 100137, 130641, 161145, 191649 |
| 1610 | AB038296 | 1610 | 32114 | 62618, 93122, 123626, 154130, 184634 | 8626 | AFG99921 | 8626 | 39130 | 69634, 100138, 130642, 161146, 191650 |
| 1611 | AB038318 | 1611 | 32115 | 62619, 93123, 123627, 154131, 184635 | 8627 | AFG99932 | 8627 | 39131 | 69635, 100139, 130643, 161147, 191651 |
| 1612 | AB038329 | 1612 | 32116 | 62620, 93124, 123628, 154132, 184636 | 8628 | AFG99943 | 8628 | 39132 | 69636, 100140, 130644, 161148, 191652 |
| 1613 | AB038351 | 1613 | 32117 | 62621, 93125, 123629, 154133, 184637 | 8629 | AFG99954 | 8629 | 39133 | 69637, 100141, 130645, 161149, 191653 |

FIG. 1 continued

| | | | | | | | | | |
|---|---|---|---|---|---|---|---|---|---|
| 1614 | AB038362 | 1614 | 32118 | 62622, 93126, 123630, 154134, 184638 | 8630 | AFG99965 | 8630 | 39134 | 69638, 100142, 130646, 161150, 191654 |
| 1615 | AB038373 | 1615 | 32119 | 62623, 93127, 123631, 154135, 184639 | 8631 | AFG99976 | 8631 | 39135 | 69639, 100143, 130647, 161151, 191655 |
| 1616 | AB038384 | 1616 | 32120 | 62624, 93128, 123632, 154136, 184640 | 8632 | AFG99987 | 8632 | 39136 | 69640, 100144, 130648, 161152, 191656 |
| 1617 | AB038395 | 1617 | 32121 | 62625, 93129, 123633, 154137, 184641 | 8633 | AFG99998 | 8633 | 39137 | 69641, 100145, 130649, 161153, 191657 |
| 1618 | AB038406 | 1618 | 32122 | 62626, 93130, 123634, 154138, 184642 | 8634 | AFH00021 | 8634 | 39138 | 69642, 100146, 130650, 161154, 191658 |
| 1619 | AB038417 | 1619 | 32123 | 62627, 93131, 123635, 154139, 184643 | 8635 | AFH00032 | 8635 | 39139 | 69643, 100147, 130651, 161155, 191659 |
| 1620 | AB038712 | 1620 | 32124 | 62628, 93132, 123636, 154140, 184644 | 8636 | AFH00043 | 8636 | 39140 | 69644, 100148, 130652, 161156, 191660 |
| 1621 | AB038723 | 1621 | 32125 | 62629, 93133, 123637, 154141, 184645 | 8637 | AFH00054 | 8637 | 39141 | 69645, 100149, 130653, 161157, 191661 |
| 1622 | AB044046 | 1622 | 32126 | 62630, 93134, 123638, 154142, 184646 | 8638 | AFH00065 | 8638 | 39142 | 69646, 100150, 130654, 161158, 191662 |
| 1623 | AB044057 | 1623 | 32127 | 62631, 93135, 123639, 154143, 184647 | 8639 | AFH00076 | 8639 | 39143 | 69647, 100151, 130655, 161159, 191663 |
| 1624 | AB044079 | 1624 | 32128 | 62632, 93136, 123640, 154144, 184648 | 8640 | AFH00087 | 8640 | 39144 | 69648, 100152, 130656, 161160, 191664 |
| 1625 | AB044090 | 1625 | 32129 | 62633, 93137, 123641, 154145, 184649 | 8641 | AFH00098 | 8641 | 39145 | 69649, 100153, 130657, 161161, 191665 |
| 1626 | AB044101 | 1626 | 32130 | 62634, 93138, 123642, 154146, 184650 | 8642 | AFH00109 | 8642 | 39146 | 69650, 100154, 130658, 161162, 191666 |
| 1627 | AB044123 | 1627 | 32131 | 62635, 93139, 123643, 154147, 184651 | 8643 | AFH00120 | 8643 | 39147 | 69651, 100155, 130659, 161163, 191667 |
| 1628 | AB044134 | 1628 | 32132 | 62636, 93140, 123644, 154148, 184652 | 8644 | AFH00131 | 8644 | 39148 | 69652, 100156, 130660, 161164, 191668 |
| 1629 | AB052071 | 1629 | 32133 | 62637, 93141, 123645, 154149, 184653 | 8645 | AFH00153 | 8645 | 39149 | 69653, 100157, 130661, 161165, 191669 |
| 1630 | AB052225 | 1630 | 32134 | 62638, 93142, 123646, 154150, 184654 | 8646 | AFH00164 | 8646 | 39150 | 69654, 100158, 130662, 161166, 191670 |
| 1631 | AB052236 | 1631 | 32135 | 62639, 93143, 123647, 154151, 184655 | 8647 | AFH00175 | 8647 | 39151 | 69655, 100159, 130663, 161167, 191671 |

FIG. 1 continued

| | | | | | | | | | |
|---|---|---|---|---|---|---|---|---|---|
| 1632 | AB052247 | 1632 | 32136 | 62640, 93144, 123648, 154152, 184656 | 8648 | AFH00186 | 8648 | 39152 | 69656, 100160, 130664, 161168, 191672 |
| 1633 | AB052258 | 1633 | 32137 | 62641, 93145, 123649, 154153, 184657 | 8649 | AFH00197 | 8649 | 39153 | 69657, 100161, 130665, 161169, 191673 |
| 1634 | AB052280 | 1634 | 32138 | 62642, 93146, 123650, 154154, 184658 | 8650 | AFH00208 | 8650 | 39154 | 69658, 100162, 130666, 161170, 191674 |
| 1635 | AB052302 | 1635 | 32139 | 62643, 93147, 123651, 154155, 184659 | 8651 | AFH00219 | 8651 | 39155 | 69659, 100163, 130667, 161171, 191675 |
| 1636 | AB052313 | 1636 | 32140 | 62644, 93148, 123652, 154156, 184660 | 8652 | AFH00230 | 8652 | 39156 | 69660, 100164, 130668, 161172, 191676 |
| 1637 | AB052335 | 1637 | 32141 | 62645, 93149, 123653, 154157, 184661 | 8653 | AFH00241 | 8653 | 39157 | 69661, 100165, 130669, 161173, 191677 |
| 1638 | AB052346 | 1638 | 32142 | 62646, 93150, 123654, 154158, 184662 | 8654 | AFH00252 | 8654 | 39158 | 69662, 100166, 130670, 161174, 191678 |
| 1639 | AB052357 | 1639 | 32143 | 62647, 93151, 123655, 154159, 184663 | 8655 | AFH00263 | 8655 | 39159 | 69663, 100167, 130671, 161175, 191679 |
| 1640 | AB052368 | 1640 | 32144 | 62648, 93152, 123656, 154160, 184664 | 8656 | AFH00274 | 8656 | 39160 | 69664, 100168, 130672, 161176, 191680 |
| 1641 | AB052797 | 1641 | 32145 | 62649, 93153, 123657, 154161, 184665 | 8657 | AFH00285 | 8657 | 39161 | 69665, 100169, 130673, 161177, 191681 |
| 1642 | ABP49217 | 1642 | 32146 | 62650, 93154, 123658, 154162, 184666 | 8658 | AFH00296 | 8658 | 39162 | 69666, 100170, 130674, 161178, 191682 |
| 1643 | ABP49305 | 1643 | 32147 | 62651, 93155, 123659, 154163, 184667 | 8659 | AFH00307 | 8659 | 39163 | 69667, 100171, 130675, 161179, 191683 |
| 1644 | ABP49316 | 1644 | 32148 | 62652, 93156, 123660, 154164, 184668 | 8660 | AFH00318 | 8660 | 39164 | 69668, 100172, 130676, 161180, 191684 |
| 1645 | ABP49327 | 1645 | 32149 | 62653, 93157, 123661, 154165, 184669 | 8661 | AFH00329 | 8661 | 39165 | 69669, 100173, 130677, 161181, 191685 |
| 1646 | ABP49338 | 1646 | 32150 | 62654, 93158, 123662, 154166, 184670 | 8662 | AFH00340 | 8662 | 39166 | 69670, 100174, 130678, 161182, 191686 |
| 1647 | ABP49349 | 1647 | 32151 | 62655, 93159, 123663, 154167, 184671 | 8663 | AFH00351 | 8663 | 39167 | 69671, 100175, 130679, 161183, 191687 |
| 1648 | ABP49360 | 1648 | 32152 | 62656, 93160, 123664, 154168, 184672 | 8664 | AFH00362 | 8664 | 39168 | 69672, 100176, 130680, 161184, 191688 |
| 1649 | ABP49371 | 1649 | 32153 | 62657, 93161, 123665, 154169, 184673 | 8665 | AFH00384 | 8665 | 39169 | 69673, 100177, 130681, 161185, 191689 |

FIG. 1 continued

| | | | | | | | | | |
|---|---|---|---|---|---|---|---|---|---|
| 1650 | ABP49382 | 1650 | 32154 | 62658, 93162, 123666, 154170, 184674 | 8666 | AFH00395 | 8666 | 39170 | 69674, 100178, 130682, 161186, 191690 |
| 1651 | ABP49393 | 1651 | 32155 | 62659, 93163, 123667, 154171, 184675 | 8667 | AFH00417 | 8667 | 39171 | 69675, 100179, 130683, 161187, 191691 |
| 1652 | ABP49404 | 1652 | 32156 | 62660, 93164, 123668, 154172, 184676 | 8668 | AFH00428 | 8668 | 39172 | 69676, 100180, 130684, 161188, 191692 |
| 1653 | ABP49415 | 1653 | 32157 | 62661, 93165, 123669, 154173, 184677 | 8669 | AFH00439 | 8669 | 39173 | 69677, 100181, 130685, 161189, 191693 |
| 1654 | ABP49426 | 1654 | 32158 | 62662, 93166, 123670, 154174, 184678 | 8670 | AFH00450 | 8670 | 39174 | 69678, 100182, 130686, 161190, 191694 |
| 1655 | ABP49437 | 1655 | 32159 | 62663, 93167, 123671, 154175, 184679 | 8671 | AFH00461 | 8671 | 39175 | 69679, 100183, 130687, 161191, 191695 |
| 1656 | ABP49448 | 1656 | 32160 | 62664, 93168, 123672, 154176, 184680 | 8672 | AFH00472 | 8672 | 39176 | 69680, 100184, 130688, 161192, 191696 |
| 1657 | ABP49459 | 1657 | 32161 | 62665, 93169, 123673, 154177, 184681 | 8673 | AFH00483 | 8673 | 39177 | 69681, 100185, 130689, 161193, 191697 |
| 1658 | ABP49470 | 1658 | 32162 | 62666, 93170, 123674, 154178, 184682 | 8674 | AFH00494 | 8674 | 39178 | 69682, 100186, 130690, 161194, 191698 |
| 1659 | ABP49492 | 1659 | 32163 | 62667, 93171, 123675, 154179, 184683 | 8675 | AFH00505 | 8675 | 39179 | 69683, 100187, 130691, 161195, 191699 |
| 1660 | ABP49503 | 1660 | 32164 | 62668, 93172, 123676, 154180, 184684 | 8676 | AFH00516 | 8676 | 39180 | 69684, 100188, 130692, 161196, 191700 |
| 1661 | ABP49514 | 1661 | 32165 | 62669, 93173, 123677, 154181, 184685 | 8677 | AFH00527 | 8677 | 39181 | 69685, 100189, 130693, 161197, 191701 |
| 1662 | ABQ01311 | 1662 | 32166 | 62670, 93174, 123678, 154182, 184686 | 8678 | AFH00538 | 8678 | 39182 | 69686, 100190, 130694, 161198, 191702 |
| 1663 | ABQ01322 | 1663 | 32167 | 62671, 93175, 123679, 154183, 184687 | 8679 | AFH00549 | 8679 | 39183 | 69687, 100191, 130695, 161199, 191703 |
| 1664 | ABQ01333 | 1664 | 32168 | 62672, 93176, 123680, 154184, 184688 | 8680 | AFH00560 | 8680 | 39184 | 69688, 100192, 130696, 161200, 191704 |
| 1665 | ABQ01344 | 1665 | 32169 | 62673, 93177, 123681, 154185, 184689 | 8681 | AFH00571 | 8681 | 39185 | 69689, 100193, 130697, 161201, 191705 |
| 1666 | ABQ01355 | 1666 | 32170 | 62674, 93178, 123682, 154186, 184690 | 8682 | AFH00582 | 8682 | 39186 | 69690, 100194, 130698, 161202, 191706 |
| 1667 | ABQ01366 | 1667 | 32171 | 62675, 93179, 123683, 154187, 184691 | 8683 | AFH00593 | 8683 | 39187 | 69691, 100195, 130699, 161203, 191707 |

FIG. 1 continued

| | | | | | | | | | |
|---|---|---|---|---|---|---|---|---|---|
| 1668 | ABQ44383 | 1668 | 32172 | 62676, 93180, 123684, 154188, 184692 | 8684 | AFH00604 | 8684 | 39188 | 69692, 100196, 130700, 161204, 191708 |
| 1669 | ABQ44405 | 1669 | 32173 | 62677, 93181, 123685, 154189, 184693 | 8685 | AFH00615 | 8685 | 39189 | 69693, 100197, 130701, 161205, 191709 |
| 1670 | ABQ44416 | 1670 | 32174 | 62678, 93182, 123686, 154190, 184694 | 8686 | AFH00626 | 8686 | 39190 | 69694, 100198, 130702, 161206, 191710 |
| 1671 | ABQ44427 | 1671 | 32175 | 62679, 93183, 123687, 154191, 184695 | 8687 | AFH00637 | 8687 | 39191 | 69695, 100199, 130703, 161207, 191711 |
| 1672 | ABQ44438 | 1672 | 32176 | 62680, 93184, 123688, 154192, 184696 | 8688 | AFH00648 | 8688 | 39192 | 69696, 100200, 130704, 161208, 191712 |
| 1673 | ABQ44460 | 1673 | 32177 | 62681, 93185, 123689, 154193, 184697 | 8689 | AFH00659 | 8689 | 39193 | 69697, 100201, 130705, 161209, 191713 |
| 1674 | ABQ44471 | 1674 | 32178 | 62682, 93186, 123690, 154194, 184698 | 8690 | AFH00670 | 8690 | 39194 | 69698, 100202, 130706, 161210, 191714 |
| 1675 | ABR15797 | 1675 | 32179 | 62683, 93187, 123691, 154195, 184699 | 8691 | AFH00681 | 8691 | 39195 | 69699, 100203, 130707, 161211, 191715 |
| 1676 | ABR15808 | 1676 | 32180 | 62684, 93188, 123692, 154196, 184700 | 8692 | AFH00692 | 8692 | 39196 | 69700, 100204, 130708, 161212, 191716 |
| 1677 | ABR15885 | 1677 | 32181 | 62685, 93189, 123693, 154197, 184701 | 8693 | AFH00703 | 8693 | 39197 | 69701, 100205, 130709, 161213, 191717 |
| 1678 | ABR15896 | 1678 | 32182 | 62686, 93190, 123694, 154198, 184702 | 8694 | AFH00714 | 8694 | 39198 | 69702, 100206, 130710, 161214, 191718 |
| 1679 | ABR15907 | 1679 | 32183 | 62687, 93191, 123695, 154199, 184703 | 8695 | AFH00725 | 8695 | 39199 | 69703, 100207, 130711, 161215, 191719 |
| 1680 | ABR15918 | 1680 | 32184 | 62688, 93192, 123696, 154200, 184704 | 8696 | AFH00736 | 8696 | 39200 | 69704, 100208, 130712, 161216, 191720 |
| 1681 | ABR15929 | 1681 | 32185 | 62689, 93193, 123697, 154201, 184705 | 8697 | AFH00747 | 8697 | 39201 | 69705, 100209, 130713, 161217, 191721 |
| 1682 | ABR15940 | 1682 | 32186 | 62690, 93194, 123698, 154202, 184706 | 8698 | AFH00758 | 8698 | 39202 | 69706, 100210, 130714, 161218, 191722 |
| 1683 | ABR15951 | 1683 | 32187 | 62691, 93195, 123699, 154203, 184707 | 8699 | AFH00769 | 8699 | 39203 | 69707, 100211, 130715, 161219, 191723 |
| 1684 | ABR15962 | 1684 | 32188 | 62692, 93196, 123700, 154204, 184708 | 8700 | AFH00780 | 8700 | 39204 | 69708, 100212, 130716, 161220, 191724 |
| 1685 | ABR22241 | 1685 | 32189 | 62693, 93197, 123701, 154205, 184709 | 8701 | AFH00791 | 8701 | 39205 | 69709, 100213, 130717, 161221, 191725 |

FIG. 1 continued

| | | | | | | | | | |
|---|---|---|---|---|---|---|---|---|---|
| 1686 | ABR28515 | 1686 | 32190 | 62694, 93198, 123702, 154206, 184710 | 8702 | AFH00802 | 8702 | 39206 | 69710, 100214, 130718, 161222, 191726 |
| 1687 | ABR28592 | 1687 | 32191 | 62695, 93199, 123703, 154207, 184711 | 8703 | AFH00813 | 8703 | 39207 | 69711, 100215, 130719, 161223, 191727 |
| 1688 | ABR28768 | 1688 | 32192 | 62696, 93200, 123704, 154208, 184712 | 8704 | AFH00824 | 8704 | 39208 | 69712, 100216, 130720, 161224, 191728 |
| 1689 | ABR28779 | 1689 | 32193 | 62697, 93201, 123705, 154209, 184713 | 8705 | AFH01407 | 8705 | 39209 | 69713, 100217, 130721, 161225, 191729 |
| 1690 | ABR28790 | 1690 | 32194 | 62698, 93202, 123706, 154210, 184714 | 8706 | AFH34940 | 8706 | 39210 | 69714, 100218, 130722, 161226, 191730 |
| 1691 | ABR28801 | 1691 | 32195 | 62699, 93203, 123707, 154211, 184715 | 8707 | AFH34961 | 8707 | 39211 | 69715, 100219, 130723, 161227, 191731 |
| 1692 | ABR28812 | 1692 | 32196 | 62700, 93204, 123708, 154212, 184716 | 8708 | AFH34968 | 8708 | 39212 | 69716, 100220, 130724, 161228, 191732 |
| 1693 | ABR28823 | 1693 | 32197 | 62701, 93205, 123709, 154213, 184717 | 8709 | AFH34975 | 8709 | 39213 | 69717, 100221, 130725, 161229, 191733 |
| 1694 | ABR28834 | 1694 | 32198 | 62702, 93206, 123710, 154214, 184718 | 8710 | AFH74464 | 8710 | 39214 | 69718, 100222, 130726, 161230, 191734 |
| 1695 | ABR28845 | 1695 | 32199 | 62703, 93207, 123711, 154215, 184719 | 8711 | AFH74465 | 8711 | 39215 | 69719, 100223, 130727, 161231, 191735 |
| 1696 | ABR28856 | 1696 | 32200 | 62704, 93208, 123712, 154216, 184720 | 8712 | AFH74477 | 8712 | 39216 | 69720, 100224, 130728, 161232, 191736 |
| 1697 | ABR28867 | 1697 | 32201 | 62705, 93209, 123713, 154217, 184721 | 8713 | AFH74488 | 8713 | 39217 | 69721, 100225, 130729, 161233, 191737 |
| 1698 | ABR28878 | 1698 | 32202 | 62706, 93210, 123714, 154218, 184722 | 8714 | AFH74499 | 8714 | 39218 | 69722, 100226, 130730, 161234, 191738 |
| 1699 | ABR28900 | 1699 | 32203 | 62707, 93211, 123715, 154219, 184723 | 8715 | AFH74510 | 8715 | 39219 | 69723, 100227, 130731, 161235, 191739 |
| 1700 | ABR28922 | 1700 | 32204 | 62708, 93212, 123716, 154220, 184724 | 8716 | AFH74521 | 8716 | 39220 | 69724, 100228, 130732, 161236, 191740 |
| 1701 | ABR88080 | 1701 | 32205 | 62709, 93213, 123717, 154221, 184725 | 8717 | AFH74532 | 8717 | 39221 | 69725, 100229, 130733, 161237, 191741 |
| 1702 | ABS00315 | 1702 | 32206 | 62710, 93214, 123718, 154222, 184726 | 8718 | AFH74543 | 8718 | 39222 | 69726, 100230, 130734, 161238, 191742 |
| 1703 | ABS00326 | 1703 | 32207 | 62711, 93215, 123719, 154223, 184727 | 8719 | AFH74554 | 8719 | 39223 | 69727, 100231, 130735, 161239, 191743 |

FIG. 1 continued

| | | | | | | | | | |
|---|---|---|---|---|---|---|---|---|---|
| 1704 | ABS49899 | 1704 | 32208 | 62712, 93216, 123720, 154224, 184728 | 8720 | AFH74565 | 8720 | 39224 | 69728, 100232, 130736, 161240, 191744 |
| 1705 | ABS49910 | 1705 | 32209 | 62713, 93217, 123721, 154225, 184729 | 8721 | AFH74576 | 8721 | 39225 | 69729, 100233, 130737, 161241, 191745 |
| 1706 | ABS49965 | 1706 | 32210 | 62714, 93218, 123722, 154226, 184730 | 8722 | AFH74587 | 8722 | 39226 | 69730, 100234, 130738, 161242, 191746 |
| 1707 | ABS49976 | 1707 | 32211 | 62715, 93219, 123723, 154227, 184731 | 8723 | AFH74598 | 8723 | 39227 | 69731, 100235, 130739, 161243, 191747 |
| 1708 | ABS49987 | 1708 | 32212 | 62716, 93220, 123724, 154228, 184732 | 8724 | AFH74609 | 8724 | 39228 | 69732, 100236, 130740, 161244, 191748 |
| 1709 | ABS49998 | 1709 | 32213 | 62717, 93221, 123725, 154229, 184733 | 8725 | AFH74620 | 8725 | 39229 | 69733, 100237, 130741, 161245, 191749 |
| 1710 | ABS50009 | 1710 | 32214 | 62718, 93222, 123726, 154230, 184734 | 8726 | AFH74631 | 8726 | 39230 | 69734, 100238, 130742, 161246, 191750 |
| 1711 | ABS50020 | 1711 | 32215 | 62719, 93223, 123727, 154231, 184735 | 8727 | AFH74642 | 8727 | 39231 | 69735, 100239, 130743, 161247, 191751 |
| 1712 | ABS50031 | 1712 | 32216 | 62720, 93224, 123728, 154232, 184736 | 8728 | AFH74653 | 8728 | 39232 | 69736, 100240, 130744, 161248, 191752 |
| 1713 | ABS50042 | 1713 | 32217 | 62721, 93225, 123729, 154233, 184737 | 8729 | AFH74664 | 8729 | 39233 | 69737, 100241, 130745, 161249, 191753 |
| 1714 | ABS50053 | 1714 | 32218 | 62722, 93226, 123730, 154234, 184738 | 8730 | AFH74675 | 8730 | 39234 | 69738, 100242, 130746, 161250, 191754 |
| 1715 | ABS50064 | 1715 | 32219 | 62723, 93227, 123731, 154235, 184739 | 8731 | AFH74686 | 8731 | 39235 | 69739, 100243, 130747, 161251, 191755 |
| 1716 | ABS50075 | 1716 | 32220 | 62724, 93228, 123732, 154236, 184740 | 8732 | AFH74697 | 8732 | 39236 | 69740, 100244, 130748, 161252, 191756 |
| 1717 | ABS71665 | 1717 | 32221 | 62725, 93229, 123733, 154237, 184741 | 8733 | AFH74708 | 8733 | 39237 | 69741, 100245, 130749, 161253, 191757 |
| 1718 | ABS71666 | 1718 | 32222 | 62726, 93230, 123734, 154238, 184742 | 8734 | AFH74719 | 8734 | 39238 | 69742, 100246, 130750, 161254, 191758 |
| 1719 | ABS71667 | 1719 | 32223 | 62727, 93231, 123735, 154239, 184743 | 8735 | AFH74730 | 8735 | 39239 | 69743, 100247, 130751, 161255, 191759 |
| 1720 | ABS71668 | 1720 | 32224 | 62728, 93232, 123736, 154240, 184744 | 8736 | AFH74741 | 8736 | 39240 | 69744, 100248, 130752, 161256, 191760 |
| 1721 | ABS71669 | 1721 | 32225 | 62729, 93233, 123737, 154241, 184745 | 8737 | AFH74752 | 8737 | 39241 | 69745, 100249, 130753, 161257, 191761 |

FIG. 1 continued

| | | | | | | | | | |
|---|---|---|---|---|---|---|---|---|---|
| 1722 | ABS71671 | 1722 | 32226 | 62730, 93234, 123738, 154242, 184746 | 8738 | AFH74763 | 8738 | 39242 | 69746, 100250, 130754, 161258, 191762 |
| 1723 | ABS71672 | 1723 | 32227 | 62731, 93235, 123739, 154243, 184747 | 8739 | AFH74774 | 8739 | 39243 | 69747, 100251, 130755, 161259, 191763 |
| 1724 | ABS71673 | 1724 | 32228 | 62732, 93236, 123740, 154244, 184748 | 8740 | AFH74785 | 8740 | 39244 | 69748, 100252, 130756, 161260, 191764 |
| 1725 | ABS71674 | 1725 | 32229 | 62733, 93237, 123741, 154245, 184749 | 8741 | AFH74796 | 8741 | 39245 | 69749, 100253, 130757, 161261, 191765 |
| 1726 | ABS71675 | 1726 | 32230 | 62734, 93238, 123742, 154246, 184750 | 8742 | AFH74807 | 8742 | 39246 | 69750, 100254, 130758, 161262, 191766 |
| 1727 | ABS71676 | 1727 | 32231 | 62735, 93239, 123743, 154247, 184751 | 8743 | AFH74818 | 8743 | 39247 | 69751, 100255, 130759, 161263, 191767 |
| 1728 | ABS71677 | 1728 | 32232 | 62736, 93240, 123744, 154248, 184752 | 8744 | AFH74829 | 8744 | 39248 | 69752, 100256, 130760, 161264, 191768 |
| 1729 | ABS71679 | 1729 | 32233 | 62737, 93241, 123745, 154249, 184753 | 8745 | AFH74840 | 8745 | 39249 | 69753, 100257, 130761, 161265, 191769 |
| 1730 | ABS71680 | 1730 | 32234 | 62738, 93242, 123746, 154250, 184754 | 8746 | AFH74851 | 8746 | 39250 | 69754, 100258, 130762, 161266, 191770 |
| 1731 | ABS71682 | 1731 | 32235 | 62739, 93243, 123747, 154251, 184755 | 8747 | AFH74862 | 8747 | 39251 | 69755, 100259, 130763, 161267, 191771 |
| 1732 | ABU80177 | 1732 | 32236 | 62740, 93244, 123748, 154252, 184756 | 8748 | AFH74873 | 8748 | 39252 | 69756, 100260, 130764, 161268, 191772 |
| 1733 | ABU80298 | 1733 | 32237 | 62741, 93245, 123749, 154253, 184757 | 8749 | AFH74884 | 8749 | 39253 | 69757, 100261, 130765, 161269, 191773 |
| 1734 | ABU80320 | 1734 | 32238 | 62742, 93246, 123750, 154254, 184758 | 8750 | AFH74895 | 8750 | 39254 | 69758, 100262, 130766, 161270, 191774 |
| 1735 | ABU80331 | 1735 | 32239 | 62743, 93247, 123751, 154255, 184759 | 8751 | AFH74906 | 8751 | 39255 | 69759, 100263, 130767, 161271, 191775 |
| 1736 | ABU80400 | 1736 | 32240 | 62744, 93248, 123752, 154256, 184760 | 8752 | AFH74917 | 8752 | 39256 | 69760, 100264, 130768, 161272, 191776 |
| 1737 | ABU92572 | 1737 | 32241 | 62745, 93249, 123753, 154257, 184761 | 8753 | AFH74928 | 8753 | 39257 | 69761, 100265, 130769, 161273, 191777 |
| 1738 | ABU92573 | 1738 | 32242 | 62746, 93250, 123754, 154258, 184762 | 8754 | AFH74939 | 8754 | 39258 | 69762, 100266, 130770, 161274, 191778 |
| 1739 | ABU92575 | 1739 | 32243 | 62747, 93251, 123755, 154259, 184763 | 8755 | AFH74950 | 8755 | 39259 | 69763, 100267, 130771, 161275, 191779 |

FIG. 1 continued

| | | | | | | | | | |
|---|---|---|---|---|---|---|---|---|---|
| 1740 | ABU92576 | 1740 | 32244 | 62748, 93252, 123756, 154260, 184764 | 8756 | AFH74961 | 8756 | 39260 | 69764, 100268, 130772, 161276, 191780 |
| 1741 | ABU92577 | 1741 | 32245 | 62749, 93253, 123757, 154261, 184765 | 8757 | AFH75388 | 8757 | 39261 | 69765, 100269, 130773, 161277, 191781 |
| 1742 | ABU92578 | 1742 | 32246 | 62750, 93254, 123758, 154262, 184766 | 8758 | AFH97140 | 8758 | 39262 | 69766, 100270, 130774, 161278, 191782 |
| 1743 | ABU92579 | 1743 | 32247 | 62751, 93255, 123759, 154263, 184767 | 8759 | AFJ05142 | 8759 | 39263 | 69767, 100271, 130775, 161279, 191783 |
| 1744 | ABU92580 | 1744 | 32248 | 62752, 93256, 123760, 154264, 184768 | 8760 | AFJ05144 | 8760 | 39264 | 69768, 100272, 130776, 161280, 191784 |
| 1745 | ABU92581 | 1745 | 32249 | 62753, 93257, 123761, 154265, 184769 | 8761 | AFJ11706 | 8761 | 39265 | 69769, 100273, 130777, 161281, 191785 |
| 1746 | ABU92582 | 1746 | 32250 | 62754, 93258, 123762, 154266, 184770 | 8762 | AFJ11728 | 8762 | 39266 | 69770, 100274, 130778, 161282, 191786 |
| 1747 | ABU92583 | 1747 | 32251 | 62755, 93259, 123763, 154267, 184771 | 8763 | AFJ19842 | 8763 | 39267 | 69771, 100275, 130779, 161283, 191787 |
| 1748 | ABU92584 | 1748 | 32252 | 62756, 93260, 123764, 154268, 184772 | 8764 | AFJ20171 | 8764 | 39268 | 69772, 100276, 130780, 161284, 191788 |
| 1749 | ABU92586 | 1749 | 32253 | 62757, 93261, 123765, 154269, 184773 | 8765 | AFJ20182 | 8765 | 39269 | 69773, 100277, 130781, 161285, 191789 |
| 1750 | ABU92587 | 1750 | 32254 | 62758, 93262, 123766, 154270, 184774 | 8766 | AFJ74386 | 8766 | 39270 | 69774, 100278, 130782, 161286, 191790 |
| 1751 | ABU92588 | 1751 | 32255 | 62759, 93263, 123767, 154271, 184775 | 8767 | AFJ74407 | 8767 | 39271 | 69775, 100279, 130783, 161287, 191791 |
| 1752 | ABU92590 | 1752 | 32256 | 62760, 93264, 123768, 154272, 184776 | 8768 | AFJ74418 | 8768 | 39272 | 69776, 100280, 130784, 161288, 191792 |
| 1753 | ABU92591 | 1753 | 32257 | 62761, 93265, 123769, 154273, 184777 | 8769 | AFJ74437 | 8769 | 39273 | 69777, 100281, 130785, 161289, 191793 |
| 1754 | ABU92592 | 1754 | 32258 | 62762, 93266, 123770, 154274, 184778 | 8770 | AFJ74448 | 8770 | 39274 | 69778, 100282, 130786, 161290, 191794 |
| 1755 | ABU92593 | 1755 | 32259 | 62763, 93267, 123771, 154275, 184779 | 8771 | AFJ74459 | 8771 | 39275 | 69779, 100283, 130787, 161291, 191795 |
| 1756 | ABU92594 | 1756 | 32260 | 62764, 93268, 123772, 154276, 184780 | 8772 | AFJ74470 | 8772 | 39276 | 69780, 100284, 130788, 161292, 191796 |
| 1757 | ABU92595 | 1757 | 32261 | 62765, 93269, 123773, 154277, 184781 | 8773 | AFJ74492 | 8773 | 39277 | 69781, 100285, 130789, 161293, 191797 |

FIG. 1 continued

| | | | | | | | | | |
|---|---|---|---|---|---|---|---|---|---|
| 1758 | ABU92596 | 1758 | 32262 | 62766, 93270, 123774, 154278, 184782 | 8774 | AFJ74525 | 8774 | 39278 | 69782, 100286, 130790, 161294, 191798 |
| 1759 | ABU92597 | 1759 | 32263 | 62767, 93271, 123775, 154279, 184783 | 8775 | AFJ74535 | 8775 | 39279 | 69783, 100287, 130791, 161295, 191799 |
| 1760 | ABU92601 | 1760 | 32264 | 62768, 93272, 123776, 154280, 184784 | 8776 | AFJ74560 | 8776 | 39280 | 69784, 100288, 130792, 161296, 191800 |
| 1761 | ABU92602 | 1761 | 32265 | 62769, 93273, 123777, 154281, 184785 | 8777 | AFJ74634 | 8777 | 39281 | 69785, 100289, 130793, 161297, 191801 |
| 1762 | ABU92603 | 1762 | 32266 | 62770, 93274, 123778, 154282, 184786 | 8778 | AFJ74653 | 8778 | 39282 | 69786, 100290, 130794, 161298, 191802 |
| 1763 | ABU92604 | 1763 | 32267 | 62771, 93275, 123779, 154283, 184787 | 8779 | AFJ74673 | 8779 | 39283 | 69787, 100291, 130795, 161299, 191803 |
| 1764 | ABU92605 | 1764 | 32268 | 62772, 93276, 123780, 154284, 184788 | 8780 | AFJ74674 | 8780 | 39284 | 69788, 100292, 130796, 161300, 191804 |
| 1765 | ABU92606 | 1765 | 32269 | 62773, 93277, 123781, 154285, 184789 | 8781 | AFJ74694 | 8781 | 39285 | 69789, 100293, 130797, 161301, 191805 |
| 1766 | ABU92608 | 1766 | 32270 | 62774, 93278, 123782, 154286, 184790 | 8782 | AFJ74695 | 8782 | 39286 | 69790, 100294, 130798, 161302, 191806 |
| 1767 | ABU92609 | 1767 | 32271 | 62775, 93279, 123783, 154287, 184791 | 8783 | AFJ74727 | 8783 | 39287 | 69791, 100295, 130799, 161303, 191807 |
| 1768 | ABU92610 | 1768 | 32272 | 62776, 93280, 123784, 154288, 184792 | 8784 | AFJ74743 | 8784 | 39288 | 69792, 100296, 130800, 161304, 191808 |
| 1769 | ABU92611 | 1769 | 32273 | 62777, 93281, 123785, 154289, 184793 | 8785 | AFJ74744 | 8785 | 39289 | 69793, 100297, 130801, 161305, 191809 |
| 1770 | ABU92612 | 1770 | 32274 | 62778, 93282, 123786, 154290, 184794 | 8786 | AFJ74760 | 8786 | 39290 | 69794, 100298, 130802, 161306, 191810 |
| 1771 | ABU92613 | 1771 | 32275 | 62779, 93283, 123787, 154291, 184795 | 8787 | AFJ74761 | 8787 | 39291 | 69795, 100299, 130803, 161307, 191811 |
| 1772 | ABU92614 | 1772 | 32276 | 62780, 93284, 123788, 154292, 184796 | 8788 | AFJ74779 | 8788 | 39292 | 69796, 100300, 130804, 161308, 191812 |
| 1773 | ABU92615 | 1773 | 32277 | 62781, 93285, 123789, 154293, 184797 | 8789 | AFJ74780 | 8789 | 39293 | 69797, 100301, 130805, 161309, 191813 |
| 1774 | ABU92617 | 1774 | 32278 | 62782, 93286, 123790, 154294, 184798 | 8790 | AFJ74804 | 8790 | 39294 | 69798, 100302, 130806, 161310, 191814 |
| 1775 | ABU92619 | 1775 | 32279 | 62783, 93287, 123791, 154295, 184799 | 8791 | AFJ74819 | 8791 | 39295 | 69799, 100303, 130807, 161311, 191815 |

FIG. 1 continued

| | | | | | | | | | |
|---|---|---|---|---|---|---|---|---|---|
| 1776 | ABU92620 | 1776 | 32280 | 62784, 93288, 123792, 154296, 184800 | 8792 | AFJ74842 | 8792 | 39296 | 69800, 100304, 130808, 161312, 191816 |
| 1777 | ABU92622 | 1777 | 32281 | 62785, 93289, 123793, 154297, 184801 | 8793 | AFJ75036 | 8793 | 39297 | 69801, 100305, 130809, 161313, 191817 |
| 1778 | ABU92623 | 1778 | 32282 | 62786, 93290, 123794, 154298, 184802 | 8794 | AFJ75047 | 8794 | 39298 | 69802, 100306, 130810, 161314, 191818 |
| 1779 | ABU92624 | 1779 | 32283 | 62787, 93291, 123795, 154299, 184803 | 8795 | AFJ75058 | 8795 | 39299 | 69803, 100307, 130811, 161315, 191819 |
| 1780 | ABU92625 | 1780 | 32284 | 62788, 93292, 123796, 154300, 184804 | 8796 | AFJ75069 | 8796 | 39300 | 69804, 100308, 130812, 161316, 191820 |
| 1781 | ABU92626 | 1781 | 32285 | 62789, 93293, 123797, 154301, 184805 | 8797 | AFJ75091 | 8797 | 39301 | 69805, 100309, 130813, 161317, 191821 |
| 1782 | ABU92627 | 1782 | 32286 | 62790, 93294, 123798, 154302, 184806 | 8798 | AFJ75449 | 8798 | 39302 | 69806, 100310, 130814, 161318, 191822 |
| 1783 | ABU92628 | 1783 | 32287 | 62791, 93295, 123799, 154303, 184807 | 8799 | AFJ75460 | 8799 | 39303 | 69807, 100311, 130815, 161319, 191823 |
| 1784 | ABU92631 | 1784 | 32288 | 62792, 93296, 123800, 154304, 184808 | 8800 | AFJ75517 | 8800 | 39304 | 69808, 100312, 130816, 161320, 191824 |
| 1785 | ABU92632 | 1785 | 32289 | 62793, 93297, 123801, 154305, 184809 | 8801 | AFJ75560 | 8801 | 39305 | 69809, 100313, 130817, 161321, 191825 |
| 1786 | ABU92635 | 1786 | 32290 | 62794, 93298, 123802, 154306, 184810 | 8802 | AFJ75571 | 8802 | 39306 | 69810, 100314, 130818, 161322, 191826 |
| 1787 | ABU92636 | 1787 | 32291 | 62795, 93299, 123803, 154307, 184811 | 8803 | AFJ75593 | 8803 | 39307 | 69811, 100315, 130819, 161323, 191827 |
| 1788 | ABU92637 | 1788 | 32292 | 62796, 93300, 123804, 154308, 184812 | 8804 | AFJ75615 | 8804 | 39308 | 69812, 100316, 130820, 161324, 191828 |
| 1789 | ABU92639 | 1789 | 32293 | 62797, 93301, 123805, 154309, 184813 | 8805 | AFJ75630 | 8805 | 39309 | 69813, 100317, 130821, 161325, 191829 |
| 1790 | ABU92640 | 1790 | 32294 | 62798, 93302, 123806, 154310, 184814 | 8806 | AFJ75641 | 8806 | 39310 | 69814, 100318, 130822, 161326, 191830 |
| 1791 | ABU92641 | 1791 | 32295 | 62799, 93303, 123807, 154311, 184815 | 8807 | AFJ75651 | 8807 | 39311 | 69815, 100319, 130823, 161327, 191831 |
| 1792 | ABU92642 | 1792 | 32296 | 62800, 93304, 123808, 154312, 184816 | 8808 | AFJ75662 | 8808 | 39312 | 69816, 100320, 130824, 161328, 191832 |
| 1793 | ABU92643 | 1793 | 32297 | 62801, 93305, 123809, 154313, 184817 | 8809 | AFJ75673 | 8809 | 39313 | 69817, 100321, 130825, 161329, 191833 |

FIG. 1 continued

| | | | | | | | | | |
|---|---|---|---|---|---|---|---|---|---|
| 1794 | ABU92645 | 1794 | 32298 | 62802, 93306, 123810, 154314, 184818 | 8810 | AFJ76119 | 8810 | 39314 | 69818, 100322, 130826, 161330, 191834 |
| 1795 | ABU92646 | 1795 | 32299 | 62803, 93307, 123811, 154315, 184819 | 8811 | AFJ76131 | 8811 | 39315 | 69819, 100323, 130827, 161331, 191835 |
| 1796 | ABU92647 | 1796 | 32300 | 62804, 93308, 123812, 154316, 184820 | 8812 | AFJ76155 | 8812 | 39316 | 69820, 100324, 130828, 161332, 191836 |
| 1797 | ABU92648 | 1797 | 32301 | 62805, 93309, 123813, 154317, 184821 | 8813 | AFJ76186 | 8813 | 39317 | 69821, 100325, 130829, 161333, 191837 |
| 1798 | ABU92649 | 1798 | 32302 | 62806, 93310, 123814, 154318, 184822 | 8814 | AFJ76203 | 8814 | 39318 | 69822, 100326, 130830, 161334, 191838 |
| 1799 | ABU92650 | 1799 | 32303 | 62807, 93311, 123815, 154319, 184823 | 8815 | AFJ76213 | 8815 | 39319 | 69823, 100327, 130831, 161335, 191839 |
| 1800 | ABU92651 | 1800 | 32304 | 62808, 93312, 123816, 154320, 184824 | 8816 | AFJ77408 | 8816 | 39320 | 69824, 100328, 130832, 161336, 191840 |
| 1801 | ABU92652 | 1801 | 32305 | 62809, 93313, 123817, 154321, 184825 | 8817 | AFJ77430 | 8817 | 39321 | 69825, 100329, 130833, 161337, 191841 |
| 1802 | ABU92653 | 1802 | 32306 | 62810, 93314, 123818, 154322, 184826 | 8818 | AFJ77440 | 8818 | 39322 | 69826, 100330, 130834, 161338, 191842 |
| 1803 | ABU92654 | 1803 | 32307 | 62811, 93315, 123819, 154323, 184827 | 8819 | AFJ77451 | 8819 | 39323 | 69827, 100331, 130835, 161339, 191843 |
| 1804 | ABU92655 | 1804 | 32308 | 62812, 93316, 123820, 154324, 184828 | 8820 | AFJ77462 | 8820 | 39324 | 69828, 100332, 130836, 161340, 191844 |
| 1805 | ABU92656 | 1805 | 32309 | 62813, 93317, 123821, 154325, 184829 | 8821 | AFJ77473 | 8821 | 39325 | 69829, 100333, 130837, 161341, 191845 |
| 1806 | ABU92657 | 1806 | 32310 | 62814, 93318, 123822, 154326, 184830 | 8822 | AFJ77484 | 8822 | 39326 | 69830, 100334, 130838, 161342, 191846 |
| 1807 | ABU92658 | 1807 | 32311 | 62815, 93319, 123823, 154327, 184831 | 8823 | AFJ77495 | 8823 | 39327 | 69831, 100335, 130839, 161343, 191847 |
| 1808 | ABU92659 | 1808 | 32312 | 62816, 93320, 123824, 154328, 184832 | 8824 | AFJ77506 | 8824 | 39328 | 69832, 100336, 130840, 161344, 191848 |
| 1809 | ABU92660 | 1809 | 32313 | 62817, 93321, 123825, 154329, 184833 | 8825 | AFJ77517 | 8825 | 39329 | 69833, 100337, 130841, 161345, 191849 |
| 1810 | ABU92661 | 1810 | 32314 | 62818, 93322, 123826, 154330, 184834 | 8826 | AFJ77528 | 8826 | 39330 | 69834, 100338, 130842, 161346, 191850 |
| 1811 | ABU92662 | 1811 | 32315 | 62819, 93323, 123827, 154331, 184835 | 8827 | AFJ77550 | 8827 | 39331 | 69835, 100339, 130843, 161347, 191851 |

FIG. 1 continued

| | | | | | | | | | |
|---|---|---|---|---|---|---|---|---|---|
| 1812 | ABU92663 | 1812 | 32316 | 62820, 93324, 123828, 154332, 184836 | 8828 | AFJ77561 | 8828 | 39332 | 69836, 100340, 130844, 161348, 191852 |
| 1813 | ABU92664 | 1813 | 32317 | 62821, 93325, 123829, 154333, 184837 | 8829 | AFJ77572 | 8829 | 39333 | 69837, 100341, 130845, 161349, 191853 |
| 1814 | ABU92665 | 1814 | 32318 | 62822, 93326, 123830, 154334, 184838 | 8830 | AFJ77583 | 8830 | 39334 | 69838, 100342, 130846, 161350, 191854 |
| 1815 | ABU92666 | 1815 | 32319 | 62823, 93327, 123831, 154335, 184839 | 8831 | AFJ77594 | 8831 | 39335 | 69839, 100343, 130847, 161351, 191855 |
| 1816 | ABU92667 | 1816 | 32320 | 62824, 93328, 123832, 154336, 184840 | 8832 | AFJ77605 | 8832 | 39336 | 69840, 100344, 130848, 161352, 191856 |
| 1817 | ABU92668 | 1817 | 32321 | 62825, 93329, 123833, 154337, 184841 | 8833 | AFJ77616 | 8833 | 39337 | 69841, 100345, 130849, 161353, 191857 |
| 1818 | ABU92669 | 1818 | 32322 | 62826, 93330, 123834, 154338, 184842 | 8834 | AFJ77627 | 8834 | 39338 | 69842, 100346, 130850, 161354, 191858 |
| 1819 | ABU92670 | 1819 | 32323 | 62827, 93331, 123835, 154339, 184843 | 8835 | AFJ77638 | 8835 | 39339 | 69843, 100347, 130851, 161355, 191859 |
| 1820 | ABU92671 | 1820 | 32324 | 62828, 93332, 123836, 154340, 184844 | 8836 | AFJ77649 | 8836 | 39340 | 69844, 100348, 130852, 161356, 191860 |
| 1821 | ABU92672 | 1821 | 32325 | 62829, 93333, 123837, 154341, 184845 | 8837 | AFJ77660 | 8837 | 39341 | 69845, 100349, 130853, 161357, 191861 |
| 1822 | ABU92673 | 1822 | 32326 | 62830, 93334, 123838, 154342, 184846 | 8838 | AFJ77671 | 8838 | 39342 | 69846, 100350, 130854, 161358, 191862 |
| 1823 | ABU92674 | 1823 | 32327 | 62831, 93335, 123839, 154343, 184847 | 8839 | AFJ77682 | 8839 | 39343 | 69847, 100351, 130855, 161359, 191863 |
| 1824 | ABU92675 | 1824 | 32328 | 62832, 93336, 123840, 154344, 184848 | 8840 | AFJ77693 | 8840 | 39344 | 69848, 100352, 130856, 161360, 191864 |
| 1825 | ABU92676 | 1825 | 32329 | 62833, 93337, 123841, 154345, 184849 | 8841 | AFJ77704 | 8841 | 39345 | 69849, 100353, 130857, 161361, 191865 |
| 1826 | ABU92677 | 1826 | 32330 | 62834, 93338, 123842, 154346, 184850 | 8842 | AFJ77715 | 8842 | 39346 | 69850, 100354, 130858, 161362, 191866 |
| 1827 | ABU92678 | 1827 | 32331 | 62835, 93339, 123843, 154347, 184851 | 8843 | AFJ77726 | 8843 | 39347 | 69851, 100355, 130859, 161363, 191867 |
| 1828 | ABU92680 | 1828 | 32332 | 62836, 93340, 123844, 154348, 184852 | 8844 | AFJ77737 | 8844 | 39348 | 69852, 100356, 130860, 161364, 191868 |
| 1829 | ABU92681 | 1829 | 32333 | 62837, 93341, 123845, 154349, 184853 | 8845 | AFJ77748 | 8845 | 39349 | 69853, 100357, 130861, 161365, 191869 |

FIG. 1 continued

| | | | | | | | | | |
|---|---|---|---|---|---|---|---|---|---|
| 1830 | ABU92682 | 1830 | 32334 | 62838, 93342, 123846, 154350, 184854 | 8846 | AFJ77759 | 8846 | 39350 | 69854, 100358, 130862, 161366, 191870 |
| 1831 | ABU92683 | 1831 | 32335 | 62839, 93343, 123847, 154351, 184855 | 8847 | AFJ77781 | 8847 | 39351 | 69855, 100359, 130863, 161367, 191871 |
| 1832 | ABU92684 | 1832 | 32336 | 62840, 93344, 123848, 154352, 184856 | 8848 | AFJ77792 | 8848 | 39352 | 69856, 100360, 130864, 161368, 191872 |
| 1833 | ABU92685 | 1833 | 32337 | 62841, 93345, 123849, 154353, 184857 | 8849 | AFJ77803 | 8849 | 39353 | 69857, 100361, 130865, 161369, 191873 |
| 1834 | ABU92686 | 1834 | 32338 | 62842, 93346, 123850, 154354, 184858 | 8850 | AFJ77814 | 8850 | 39354 | 69858, 100362, 130866, 161370, 191874 |
| 1835 | ABU92687 | 1835 | 32339 | 62843, 93347, 123851, 154355, 184859 | 8851 | AFJ77825 | 8851 | 39355 | 69859, 100363, 130867, 161371, 191875 |
| 1836 | ABU92688 | 1836 | 32340 | 62844, 93348, 123852, 154356, 184860 | 8852 | AFJ77836 | 8852 | 39356 | 69860, 100364, 130868, 161372, 191876 |
| 1837 | ABU92689 | 1837 | 32341 | 62845, 93349, 123853, 154357, 184861 | 8853 | AFJ77847 | 8853 | 39357 | 69861, 100365, 130869, 161373, 191877 |
| 1838 | ABU92691 | 1838 | 32342 | 62846, 93350, 123854, 154358, 184862 | 8854 | AFJ77858 | 8854 | 39358 | 69862, 100366, 130870, 161374, 191878 |
| 1839 | ABU92692 | 1839 | 32343 | 62847, 93351, 123855, 154359, 184863 | 8855 | AFJ77869 | 8855 | 39359 | 69863, 100367, 130871, 161375, 191879 |
| 1840 | ABU92693 | 1840 | 32344 | 62848, 93352, 123856, 154360, 184864 | 8856 | AFJ77880 | 8856 | 39360 | 69864, 100368, 130872, 161376, 191880 |
| 1841 | ABU92694 | 1841 | 32345 | 62849, 93353, 123857, 154361, 184865 | 8857 | AFJ77902 | 8857 | 39361 | 69865, 100369, 130873, 161377, 191881 |
| 1842 | ABU92695 | 1842 | 32346 | 62850, 93354, 123858, 154362, 184866 | 8858 | AFJ77913 | 8858 | 39362 | 69866, 100370, 130874, 161378, 191882 |
| 1843 | ABU92696 | 1843 | 32347 | 62851, 93355, 123859, 154363, 184867 | 8859 | AFJ77924 | 8859 | 39363 | 69867, 100371, 130875, 161379, 191883 |
| 1844 | ABU92697 | 1844 | 32348 | 62852, 93356, 123860, 154364, 184868 | 8860 | AFJ77935 | 8860 | 39364 | 69868, 100372, 130876, 161380, 191884 |
| 1845 | ABU92698 | 1845 | 32349 | 62853, 93357, 123861, 154365, 184869 | 8861 | AFJ77946 | 8861 | 39365 | 69869, 100373, 130877, 161381, 191885 |
| 1846 | ABU92699 | 1846 | 32350 | 62854, 93358, 123862, 154366, 184870 | 8862 | AFJ77957 | 8862 | 39366 | 69870, 100374, 130878, 161382, 191886 |
| 1847 | ABU92700 | 1847 | 32351 | 62855, 93359, 123863, 154367, 184871 | 8863 | AFJ77968 | 8863 | 39367 | 69871, 100375, 130879, 161383, 191887 |

FIG. 1 continued

| | | | | | | | | | |
|---|---|---|---|---|---|---|---|---|---|
| 1848 | ABU92701 | 1848 | 32352 | 62856, 93360, 123864, 154368, 184872 | 8864 | AFJ77979 | 8864 | 39368 | 69872, 100376, 130880, 161384, 191888 |
| 1849 | ABU92702 | 1849 | 32353 | 62857, 93361, 123865, 154369, 184873 | 8865 | AFJ77990 | 8865 | 39369 | 69873, 100377, 130881, 161385, 191889 |
| 1850 | ABU92703 | 1850 | 32354 | 62858, 93362, 123866, 154370, 184874 | 8866 | AFJ78001 | 8866 | 39370 | 69874, 100378, 130882, 161386, 191890 |
| 1851 | ABU92704 | 1851 | 32355 | 62859, 93363, 123867, 154371, 184875 | 8867 | AFJ78012 | 8867 | 39371 | 69875, 100379, 130883, 161387, 191891 |
| 1852 | ABU92705 | 1852 | 32356 | 62860, 93364, 123868, 154372, 184876 | 8868 | AFJ78023 | 8868 | 39372 | 69876, 100380, 130884, 161388, 191892 |
| 1853 | ABU92706 | 1853 | 32357 | 62861, 93365, 123869, 154373, 184877 | 8869 | AFJ78034 | 8869 | 39373 | 69877, 100381, 130885, 161389, 191893 |
| 1854 | ABU92707 | 1854 | 32358 | 62862, 93366, 123870, 154374, 184878 | 8870 | AFJ78045 | 8870 | 39374 | 69878, 100382, 130886, 161390, 191894 |
| 1855 | ABU92708 | 1855 | 32359 | 62863, 93367, 123871, 154375, 184879 | 8871 | AFJ78056 | 8871 | 39375 | 69879, 100383, 130887, 161391, 191895 |
| 1856 | ABU92709 | 1856 | 32360 | 62864, 93368, 123872, 154376, 184880 | 8872 | AFJ78067 | 8872 | 39376 | 69880, 100384, 130888, 161392, 191896 |
| 1857 | ABU92710 | 1857 | 32361 | 62865, 93369, 123873, 154377, 184881 | 8873 | AFJ78078 | 8873 | 39377 | 69881, 100385, 130889, 161393, 191897 |
| 1858 | ABU92711 | 1858 | 32362 | 62866, 93370, 123874, 154378, 184882 | 8874 | AFJ78089 | 8874 | 39378 | 69882, 100386, 130890, 161394, 191898 |
| 1859 | ABU92712 | 1859 | 32363 | 62867, 93371, 123875, 154379, 184883 | 8875 | AFJ78100 | 8875 | 39379 | 69883, 100387, 130891, 161395, 191899 |
| 1860 | ABU92713 | 1860 | 32364 | 62868, 93372, 123876, 154380, 184884 | 8876 | AFJ78111 | 8876 | 39380 | 69884, 100388, 130892, 161396, 191900 |
| 1861 | ABU92714 | 1861 | 32365 | 62869, 93373, 123877, 154381, 184885 | 8877 | AFJ78122 | 8877 | 39381 | 69885, 100389, 130893, 161397, 191901 |
| 1862 | ABU92715 | 1862 | 32366 | 62870, 93374, 123878, 154382, 184886 | 8878 | AFJ78144 | 8878 | 39382 | 69886, 100390, 130894, 161398, 191902 |
| 1863 | ABU92716 | 1863 | 32367 | 62871, 93375, 123879, 154383, 184887 | 8879 | AFJ78155 | 8879 | 39383 | 69887, 100391, 130895, 161399, 191903 |
| 1864 | ABU92717 | 1864 | 32368 | 62872, 93376, 123880, 154384, 184888 | 8880 | AFJ78166 | 8880 | 39384 | 69888, 100392, 130896, 161400, 191904 |
| 1865 | ABU92718 | 1865 | 32369 | 62873, 93377, 123881, 154385, 184889 | 8881 | AFJ78177 | 8881 | 39385 | 69889, 100393, 130897, 161401, 191905 |

FIG. 1 continued

| | | | | | | | | | |
|---|---|---|---|---|---|---|---|---|---|
| 1866 | ABU92719 | 1866 | 32370 | 62874, 93378, 123882, 154386, 184890 | 8882 | AFJ78188 | 8882 | 39386 | 69890, 100394, 130898, 161402, 191906 |
| 1867 | ABU92720 | 1867 | 32371 | 62875, 93379, 123883, 154387, 184891 | 8883 | AFJ78210 | 8883 | 39387 | 69891, 100395, 130899, 161403, 191907 |
| 1868 | ABU92721 | 1868 | 32372 | 62876, 93380, 123884, 154388, 184892 | 8884 | AFJ78221 | 8884 | 39388 | 69892, 100396, 130900, 161404, 191908 |
| 1869 | ABU92722 | 1869 | 32373 | 62877, 93381, 123885, 154389, 184893 | 8885 | AFJ78232 | 8885 | 39389 | 69893, 100397, 130901, 161405, 191909 |
| 1870 | ABU92723 | 1870 | 32374 | 62878, 93382, 123886, 154390, 184894 | 8886 | AFJ78243 | 8886 | 39390 | 69894, 100398, 130902, 161406, 191910 |
| 1871 | ABU92724 | 1871 | 32375 | 62879, 93383, 123887, 154391, 184895 | 8887 | AFJ78254 | 8887 | 39391 | 69895, 100399, 130903, 161407, 191911 |
| 1872 | ABU92725 | 1872 | 32376 | 62880, 93384, 123888, 154392, 184896 | 8888 | AFJ78265 | 8888 | 39392 | 69896, 100400, 130904, 161408, 191912 |
| 1873 | ABU92726 | 1873 | 32377 | 62881, 93385, 123889, 154393, 184897 | 8889 | AFJ78276 | 8889 | 39393 | 69897, 100401, 130905, 161409, 191913 |
| 1874 | ABU92727 | 1874 | 32378 | 62882, 93386, 123890, 154394, 184898 | 8890 | AFJ78287 | 8890 | 39394 | 69898, 100402, 130906, 161410, 191914 |
| 1875 | ABU92728 | 1875 | 32379 | 62883, 93387, 123891, 154395, 184899 | 8891 | AFJ78309 | 8891 | 39395 | 69899, 100403, 130907, 161411, 191915 |
| 1876 | ABU92729 | 1876 | 32380 | 62884, 93388, 123892, 154396, 184900 | 8892 | AFJ78320 | 8892 | 39396 | 69900, 100404, 130908, 161412, 191916 |
| 1877 | ABU92730 | 1877 | 32381 | 62885, 93389, 123893, 154397, 184901 | 8893 | AFJ78331 | 8893 | 39397 | 69901, 100405, 130909, 161413, 191917 |
| 1878 | ABU92731 | 1878 | 32382 | 62886, 93390, 123894, 154398, 184902 | 8894 | AFJ78342 | 8894 | 39398 | 69902, 100406, 130910, 161414, 191918 |
| 1879 | ABU92732 | 1879 | 32383 | 62887, 93391, 123895, 154399, 184903 | 8895 | AFJ78353 | 8895 | 39399 | 69903, 100407, 130911, 161415, 191919 |
| 1880 | ABU92733 | 1880 | 32384 | 62888, 93392, 123896, 154400, 184904 | 8896 | AFJ78364 | 8896 | 39400 | 69904, 100408, 130912, 161416, 191920 |
| 1881 | ABU92734 | 1881 | 32385 | 62889, 93393, 123897, 154401, 184905 | 8897 | AFJ78375 | 8897 | 39401 | 69905, 100409, 130913, 161417, 191921 |
| 1882 | ABU92735 | 1882 | 32386 | 62890, 93394, 123898, 154402, 184906 | 8898 | AFJ78386 | 8898 | 39402 | 69906, 100410, 130914, 161418, 191922 |
| 1883 | ABU92737 | 1883 | 32387 | 62891, 93395, 123899, 154403, 184907 | 8899 | AFJ78397 | 8899 | 39403 | 69907, 100411, 130915, 161419, 191923 |

FIG. 1 continued

| | | | | | | | | | |
|---|---|---|---|---|---|---|---|---|---|
| 1884 | ABU92738 | 1884 | 32388 | 62892, 93396, 123900, 154404, 184908 | 8900 | AFJ78408 | 8900 | 39404 | 69908, 100412, 130916, 161420, 191924 |
| 1885 | ABU92739 | 1885 | 32389 | 62893, 93397, 123901, 154405, 184909 | 8901 | AFJ78419 | 8901 | 39405 | 69909, 100413, 130917, 161421, 191925 |
| 1886 | ABU92740 | 1886 | 32390 | 62894, 93398, 123902, 154406, 184910 | 8902 | AFJ78430 | 8902 | 39406 | 69910, 100414, 130918, 161422, 191926 |
| 1887 | ABU92741 | 1887 | 32391 | 62895, 93399, 123903, 154407, 184911 | 8903 | AFJ78441 | 8903 | 39407 | 69911, 100415, 130919, 161423, 191927 |
| 1888 | ABU92742 | 1888 | 32392 | 62896, 93400, 123904, 154408, 184912 | 8904 | AFJ78452 | 8904 | 39408 | 69912, 100416, 130920, 161424, 191928 |
| 1889 | ABU92743 | 1889 | 32393 | 62897, 93401, 123905, 154409, 184913 | 8905 | AFJ78463 | 8905 | 39409 | 69913, 100417, 130921, 161425, 191929 |
| 1890 | ABU92744 | 1890 | 32394 | 62898, 93402, 123906, 154410, 184914 | 8906 | AFJ78474 | 8906 | 39410 | 69914, 100418, 130922, 161426, 191930 |
| 1891 | ABU92745 | 1891 | 32395 | 62899, 93403, 123907, 154411, 184915 | 8907 | AFJ78485 | 8907 | 39411 | 69915, 100419, 130923, 161427, 191931 |
| 1892 | ABU92746 | 1892 | 32396 | 62900, 93404, 123908, 154412, 184916 | 8908 | AFJ78496 | 8908 | 39412 | 69916, 100420, 130924, 161428, 191932 |
| 1893 | ABU92747 | 1893 | 32397 | 62901, 93405, 123909, 154413, 184917 | 8909 | AFJ78518 | 8909 | 39413 | 69917, 100421, 130925, 161429, 191933 |
| 1894 | ABU92748 | 1894 | 32398 | 62902, 93406, 123910, 154414, 184918 | 8910 | AFJ78529 | 8910 | 39414 | 69918, 100422, 130926, 161430, 191934 |
| 1895 | ABU92749 | 1895 | 32399 | 62903, 93407, 123911, 154415, 184919 | 8911 | AFJ78540 | 8911 | 39415 | 69919, 100423, 130927, 161431, 191935 |
| 1896 | ABU92750 | 1896 | 32400 | 62904, 93408, 123912, 154416, 184920 | 8912 | AFJ78551 | 8912 | 39416 | 69920, 100424, 130928, 161432, 191936 |
| 1897 | ABU92751 | 1897 | 32401 | 62905, 93409, 123913, 154417, 184921 | 8913 | AFJ78562 | 8913 | 39417 | 69921, 100425, 130929, 161433, 191937 |
| 1898 | ABU92752 | 1898 | 32402 | 62906, 93410, 123914, 154418, 184922 | 8914 | AFJ78573 | 8914 | 39418 | 69922, 100426, 130930, 161434, 191938 |
| 1899 | ABU92753 | 1899 | 32403 | 62907, 93411, 123915, 154419, 184923 | 8915 | AFJ78584 | 8915 | 39419 | 69923, 100427, 130931, 161435, 191939 |
| 1900 | ABU92754 | 1900 | 32404 | 62908, 93412, 123916, 154420, 184924 | 8916 | AFJ78595 | 8916 | 39420 | 69924, 100428, 130932, 161436, 191940 |
| 1901 | ABU92755 | 1901 | 32405 | 62909, 93413, 123917, 154421, 184925 | 8917 | AFJ78617 | 8917 | 39421 | 69925, 100429, 130933, 161437, 191941 |

FIG. 1 continued

| | | | | | | | | | |
|---|---|---|---|---|---|---|---|---|---|
| 1902 | ABU92756 | 1902 | 32406 | 62910, 93414, 123918, 154422, 184926 | 8918 | AFJ78628 | 8918 | 39422 | 69926, 100430, 130934, 161438, 191942 |
| 1903 | ABU92757 | 1903 | 32407 | 62911, 93415, 123919, 154423, 184927 | 8919 | AFJ78639 | 8919 | 39423 | 69927, 100431, 130935, 161439, 191943 |
| 1904 | ABU92758 | 1904 | 32408 | 62912, 93416, 123920, 154424, 184928 | 8920 | AFJ78650 | 8920 | 39424 | 69928, 100432, 130936, 161440, 191944 |
| 1905 | ABU92759 | 1905 | 32409 | 62913, 93417, 123921, 154425, 184929 | 8921 | AFJ78661 | 8921 | 39425 | 69929, 100433, 130937, 161441, 191945 |
| 1906 | ABU92760 | 1906 | 32410 | 62914, 93418, 123922, 154426, 184930 | 8922 | AFJ78681 | 8922 | 39426 | 69930, 100434, 130938, 161442, 191946 |
| 1907 | ABV29579 | 1907 | 32411 | 62915, 93419, 123923, 154427, 184931 | 8923 | AFJ78691 | 8923 | 39427 | 69931, 100435, 130939, 161443, 191947 |
| 1908 | ABV29612 | 1908 | 32412 | 62916, 93420, 123924, 154428, 184932 | 8924 | AFJ78701 | 8924 | 39428 | 69932, 100436, 130940, 161444, 191948 |
| 1909 | ABV29634 | 1909 | 32413 | 62917, 93421, 123925, 154429, 184933 | 8925 | AFJ78711 | 8925 | 39429 | 69933, 100437, 130941, 161445, 191949 |
| 1910 | ABV29645 | 1910 | 32414 | 62918, 93422, 123926, 154430, 184934 | 8926 | AFJ78721 | 8926 | 39430 | 69934, 100438, 130942, 161446, 191950 |
| 1911 | ABV29667 | 1911 | 32415 | 62919, 93423, 123927, 154431, 184935 | 8927 | AFJ78731 | 8927 | 39431 | 69935, 100439, 130943, 161447, 191951 |
| 1912 | ABV29678 | 1912 | 32416 | 62920, 93424, 123928, 154432, 184936 | 8928 | AFJ78741 | 8928 | 39432 | 69936, 100440, 130944, 161448, 191952 |
| 1913 | ABV29689 | 1913 | 32417 | 62921, 93425, 123929, 154433, 184937 | 8929 | AFJ78751 | 8929 | 39433 | 69937, 100441, 130945, 161449, 191953 |
| 1914 | ABV29700 | 1914 | 32418 | 62922, 93426, 123930, 154434, 184938 | 8930 | AFJ78761 | 8930 | 39434 | 69938, 100442, 130946, 161450, 191954 |
| 1915 | ABV29711 | 1915 | 32419 | 62923, 93427, 123931, 154435, 184939 | 8931 | AFJ78771 | 8931 | 39435 | 69939, 100443, 130947, 161451, 191955 |
| 1916 | ABV29722 | 1916 | 32420 | 62924, 93428, 123932, 154436, 184940 | 8932 | AFJ78781 | 8932 | 39436 | 69940, 100444, 130948, 161452, 191956 |
| 1917 | ABV29733 | 1917 | 32421 | 62925, 93429, 123933, 154437, 184941 | 8933 | AFJ78791 | 8933 | 39437 | 69941, 100445, 130949, 161453, 191957 |
| 1918 | ABV29744 | 1918 | 32422 | 62926, 93430, 123934, 154438, 184942 | 8934 | AFJ78801 | 8934 | 39438 | 69942, 100446, 130950, 161454, 191958 |
| 1919 | ABV29755 | 1919 | 32423 | 62927, 93431, 123935, 154439, 184943 | 8935 | AFJ78811 | 8935 | 39439 | 69943, 100447, 130951, 161455, 191959 |

FIG. 1 continued

| | | | | | | | | | |
|---|---|---|---|---|---|---|---|---|---|
| 1920 | ABV29766 | 1920 | 32424 | 62928, 93432, 123936, 154440, 184944 | 8936 | AFJ78821 | 8936 | 39440 | 69944, 100448, 130952, 161456, 191960 |
| 1921 | ABV29777 | 1921 | 32425 | 62929, 93433, 123937, 154441, 184945 | 8937 | AFJ78831 | 8937 | 39441 | 69945, 100449, 130953, 161457, 191961 |
| 1922 | ABV29788 | 1922 | 32426 | 62930, 93434, 123938, 154442, 184946 | 8938 | AFJ78841 | 8938 | 39442 | 69946, 100450, 130954, 161458, 191962 |
| 1923 | ABV29799 | 1923 | 32427 | 62931, 93435, 123939, 154443, 184947 | 8939 | AFJ78851 | 8939 | 39443 | 69947, 100451, 130955, 161459, 191963 |
| 1924 | ABV29821 | 1924 | 32428 | 62932, 93436, 123940, 154444, 184948 | 8940 | AFJ78861 | 8940 | 39444 | 69948, 100452, 130956, 161460, 191964 |
| 1925 | ABV29832 | 1925 | 32429 | 62933, 93437, 123941, 154445, 184949 | 8941 | AFJ78881 | 8941 | 39445 | 69949, 100453, 130957, 161461, 191965 |
| 1926 | ABV29865 | 1926 | 32430 | 62934, 93438, 123942, 154446, 184950 | 8942 | AFJ78891 | 8942 | 39446 | 69950, 100454, 130958, 161462, 191966 |
| 1927 | ABV29876 | 1927 | 32431 | 62935, 93439, 123943, 154447, 184951 | 8943 | AFJ78901 | 8943 | 39447 | 69951, 100455, 130959, 161463, 191967 |
| 1928 | ABV29898 | 1928 | 32432 | 62936, 93440, 123944, 154448, 184952 | 8944 | AFJ78911 | 8944 | 39448 | 69952, 100456, 130960, 161464, 191968 |
| 1929 | ABV29909 | 1929 | 32433 | 62937, 93441, 123945, 154449, 184953 | 8945 | AFJ78921 | 8945 | 39449 | 69953, 100457, 130961, 161465, 191969 |
| 1930 | ABV29920 | 1930 | 32434 | 62938, 93442, 123946, 154450, 184954 | 8946 | AFJ97567 | 8946 | 39450 | 69954, 100458, 130962, 161466, 191970 |
| 1931 | ABV29942 | 1931 | 32435 | 62939, 93443, 123947, 154451, 184955 | 8947 | AFK14115 | 8947 | 39451 | 69955, 100459, 130963, 161467, 191971 |
| 1932 | ABV29953 | 1932 | 32436 | 62940, 93444, 123948, 154452, 184956 | 8948 | AFK14131 | 8948 | 39452 | 69956, 100460, 130964, 161468, 191972 |
| 1933 | ABV29964 | 1933 | 32437 | 62941, 93445, 123949, 154453, 184957 | 8949 | AFK14139 | 8949 | 39453 | 69957, 100461, 130965, 161469, 191973 |
| 1934 | ABV29986 | 1934 | 32438 | 62942, 93446, 123950, 154454, 184958 | 8950 | AFK14148 | 8950 | 39454 | 69958, 100462, 130966, 161470, 191974 |
| 1935 | ABV29997 | 1935 | 32439 | 62943, 93447, 123951, 154455, 184959 | 8951 | AFK14157 | 8951 | 39455 | 69959, 100463, 130967, 161471, 191975 |
| 1936 | ABV30008 | 1936 | 32440 | 62944, 93448, 123952, 154456, 184960 | 8952 | AFK14166 | 8952 | 39456 | 69960, 100464, 130968, 161472, 191976 |
| 1937 | ABV30019 | 1937 | 32441 | 62945, 93449, 123953, 154457, 184961 | 8953 | AFK14175 | 8953 | 39457 | 69961, 100465, 130969, 161473, 191977 |

FIG. 1 continued

| | | | | | | | | | |
|---|---|---|---|---|---|---|---|---|---|
| 1938 | ABV30030 | 1938 | 32442 | 62946, 93450, 123954, 154458, 184962 | 8954 | AFK14184 | 8954 | 39458 | 69962, 100466, 130970, 161474, 191978 |
| 1939 | ABV30041 | 1939 | 32443 | 62947, 93451, 123955, 154459, 184963 | 8955 | AFK14193 | 8955 | 39459 | 69963, 100467, 130971, 161475, 191979 |
| 1940 | ABV30063 | 1940 | 32444 | 62948, 93452, 123956, 154460, 184964 | 8956 | AFK14202 | 8956 | 39460 | 69964, 100468, 130972, 161476, 191980 |
| 1941 | ABV30074 | 1941 | 32445 | 62949, 93453, 123957, 154461, 184965 | 8957 | AFK14211 | 8957 | 39461 | 69965, 100469, 130973, 161477, 191981 |
| 1942 | ABV30085 | 1942 | 32446 | 62950, 93454, 123958, 154462, 184966 | 8958 | AFK14220 | 8958 | 39462 | 69966, 100470, 130974, 161478, 191982 |
| 1943 | ABV30096 | 1943 | 32447 | 62951, 93455, 123959, 154463, 184967 | 8959 | AFK14229 | 8959 | 39463 | 69967, 100471, 130975, 161479, 191983 |
| 1944 | ABV30107 | 1944 | 32448 | 62952, 93456, 123960, 154464, 184968 | 8960 | AFK14238 | 8960 | 39464 | 69968, 100472, 130976, 161480, 191984 |
| 1945 | ABV30129 | 1945 | 32449 | 62953, 93457, 123961, 154465, 184969 | 8961 | AFK14247 | 8961 | 39465 | 69969, 100473, 130977, 161481, 191985 |
| 1946 | ABV30140 | 1946 | 32450 | 62954, 93458, 123962, 154466, 184970 | 8962 | AFK14272 | 8962 | 39466 | 69970, 100474, 130978, 161482, 191986 |
| 1947 | ABV30151 | 1947 | 32451 | 62955, 93459, 123963, 154467, 184971 | 8963 | AFK14314 | 8963 | 39467 | 69971, 100475, 130979, 161483, 191987 |
| 1948 | ABV30162 | 1948 | 32452 | 62956, 93460, 123964, 154468, 184972 | 8964 | AFK14323 | 8964 | 39468 | 69972, 100476, 130980, 161484, 191988 |
| 1949 | ABV30173 | 1949 | 32453 | 62957, 93461, 123965, 154469, 184973 | 8965 | AFK14332 | 8965 | 39469 | 69973, 100477, 130981, 161485, 191989 |
| 1950 | ABV30184 | 1950 | 32454 | 62958, 93462, 123966, 154470, 184974 | 8966 | AFK14341 | 8966 | 39470 | 69974, 100478, 130982, 161486, 191990 |
| 1951 | ABV30217 | 1951 | 32455 | 62959, 93463, 123967, 154471, 184975 | 8967 | AFK14350 | 8967 | 39471 | 69975, 100479, 130983, 161487, 191991 |
| 1952 | ABV30228 | 1952 | 32456 | 62960, 93464, 123968, 154472, 184976 | 8968 | AFK14358 | 8968 | 39472 | 69976, 100480, 130984, 161488, 191992 |
| 1953 | ABV30261 | 1953 | 32457 | 62961, 93465, 123969, 154473, 184977 | 8969 | AFK14395 | 8969 | 39473 | 69977, 100481, 130985, 161489, 191993 |
| 1954 | ABV30272 | 1954 | 32458 | 62962, 93466, 123970, 154474, 184978 | 8970 | AFK14431 | 8970 | 39474 | 69978, 100482, 130986, 161490, 191994 |
| 1955 | ABV30283 | 1955 | 32459 | 62963, 93467, 123971, 154475, 184979 | 8971 | AFK14456 | 8971 | 39475 | 69979, 100483, 130987, 161491, 191995 |

FIG. 1 continued

| | | | | | | | | | |
|---|---|---|---|---|---|---|---|---|---|
| 1956 | ABV30294 | 1956 | 32460 | 62964, 93468, 123972, 154476, 184980 | 8972 | AFK14465 | 8972 | 39476 | 69980, 100484, 130988, 161492, 191996 |
| 1957 | ABV30305 | 1957 | 32461 | 62965, 93469, 123973, 154477, 184981 | 8973 | AFK14536 | 8973 | 39477 | 69981, 100485, 130989, 161493, 191997 |
| 1958 | ABV30316 | 1958 | 32462 | 62966, 93470, 123974, 154478, 184982 | 8974 | AFK14571 | 8974 | 39478 | 69982, 100486, 130990, 161494, 191998 |
| 1959 | ABV30327 | 1959 | 32463 | 62967, 93471, 123975, 154479, 184983 | 8975 | AFK14586 | 8975 | 39479 | 69983, 100487, 130991, 161495, 191999 |
| 1960 | ABV30338 | 1960 | 32464 | 62968, 93472, 123976, 154480, 184984 | 8976 | AFK14595 | 8976 | 39480 | 69984, 100488, 130992, 161496, 192000 |
| 1961 | ABV30349 | 1961 | 32465 | 62969, 93473, 123977, 154481, 184985 | 8977 | AFK14612 | 8977 | 39481 | 69985, 100489, 130993, 161497, 192001 |
| 1962 | ABV30360 | 1962 | 32466 | 62970, 93474, 123978, 154482, 184986 | 8978 | AFK14621 | 8978 | 39482 | 69986, 100490, 130994, 161498, 192002 |
| 1963 | ABV30371 | 1963 | 32467 | 62971, 93475, 123979, 154483, 184987 | 8979 | AFK14630 | 8979 | 39483 | 69987, 100491, 130995, 161499, 192003 |
| 1964 | ABV30382 | 1964 | 32468 | 62972, 93476, 123980, 154484, 184988 | 8980 | AFK14639 | 8980 | 39484 | 69988, 100492, 130996, 161500, 192004 |
| 1965 | ABV30393 | 1965 | 32469 | 62973, 93477, 123981, 154485, 184989 | 8981 | AFK14661 | 8981 | 39485 | 69989, 100493, 130997, 161501, 192005 |
| 1966 | ABV30404 | 1966 | 32470 | 62974, 93478, 123982, 154486, 184990 | 8982 | AFK14670 | 8982 | 39486 | 69990, 100494, 130998, 161502, 192006 |
| 1967 | ABV30415 | 1967 | 32471 | 62975, 93479, 123983, 154487, 184991 | 8983 | AFK14678 | 8983 | 39487 | 69991, 100495, 130999, 161503, 192007 |
| 1968 | ABV30426 | 1968 | 32472 | 62976, 93480, 123984, 154488, 184992 | 8984 | AFK14688 | 8984 | 39488 | 69992, 100496, 131000, 161504, 192008 |
| 1969 | ABV30437 | 1969 | 32473 | 62977, 93481, 123985, 154489, 184993 | 8985 | AFK14697 | 8985 | 39489 | 69993, 100497, 131001, 161505, 192009 |
| 1970 | ABV30448 | 1970 | 32474 | 62978, 93482, 123986, 154490, 184994 | 8986 | AFK14713 | 8986 | 39490 | 69994, 100498, 131002, 161506, 192010 |
| 1971 | ABV30459 | 1971 | 32475 | 62979, 93483, 123987, 154491, 184995 | 8987 | AFK14722 | 8987 | 39491 | 69995, 100499, 131003, 161507, 192011 |
| 1972 | ABV30470 | 1972 | 32476 | 62980, 93484, 123988, 154492, 184996 | 8988 | AFK14731 | 8988 | 39492 | 69996, 100500, 131004, 161508, 192012 |
| 1973 | ABV30492 | 1973 | 32477 | 62981, 93485, 123989, 154493, 184997 | 8989 | AFK14740 | 8989 | 39493 | 69997, 100501, 131005, 161509, 192013 |

FIG. 1 continued

| | | | | | | | | | |
|---|---|---|---|---|---|---|---|---|---|
| 1974 | ABV30503 | 1974 | 32478 | 62982, 93486, 123990, 154494, 184998 | 8990 | AFK14749 | 8990 | 39494 | 69998, 100502, 131006, 161510, 192014 |
| 1975 | ABV30514 | 1975 | 32479 | 62983, 93487, 123991, 154495, 184999 | 8991 | AFK14756 | 8991 | 39495 | 69999, 100503, 131007, 161511, 192015 |
| 1976 | ABV30525 | 1976 | 32480 | 62984, 93488, 123992, 154496, 185000 | 8992 | AFK14764 | 8992 | 39496 | 70000, 100504, 131008, 161512, 192016 |
| 1977 | ABV30536 | 1977 | 32481 | 62985, 93489, 123993, 154497, 185001 | 8993 | AFK14779 | 8993 | 39497 | 70001, 100505, 131009, 161513, 192017 |
| 1978 | ABV30547 | 1978 | 32482 | 62986, 93490, 123994, 154498, 185002 | 8994 | AFK14788 | 8994 | 39498 | 70002, 100506, 131010, 161514, 192018 |
| 1979 | ABV30558 | 1979 | 32483 | 62987, 93491, 123995, 154499, 185003 | 8995 | AFK14798 | 8995 | 39499 | 70003, 100507, 131011, 161515, 192019 |
| 1980 | ABV30569 | 1980 | 32484 | 62988, 93492, 123996, 154500, 185004 | 8996 | AFK14814 | 8996 | 39500 | 70004, 100508, 131012, 161516, 192020 |
| 1981 | ABV30580 | 1981 | 32485 | 62989, 93493, 123997, 154501, 185005 | 8997 | AFK14831 | 8997 | 39501 | 70005, 100509, 131013, 161517, 192021 |
| 1982 | ABV30591 | 1982 | 32486 | 62990, 93494, 123998, 154502, 185006 | 8998 | AFK14839 | 8998 | 39502 | 70006, 100510, 131014, 161518, 192022 |
| 1983 | ABV30602 | 1983 | 32487 | 62991, 93495, 123999, 154503, 185007 | 8999 | AFK14847 | 8999 | 39503 | 70007, 100511, 131015, 161519, 192023 |
| 1984 | ABV30613 | 1984 | 32488 | 62992, 93496, 124000, 154504, 185008 | 9000 | AFK14868 | 9000 | 39504 | 70008, 100512, 131016, 161520, 192024 |
| 1985 | ABV30624 | 1985 | 32489 | 62993, 93497, 124001, 154505, 185009 | 9001 | AFK14884 | 9001 | 39505 | 70009, 100513, 131017, 161521, 192025 |
| 1986 | ABV30646 | 1986 | 32490 | 62994, 93498, 124002, 154506, 185010 | 9002 | AFK14892 | 9002 | 39506 | 70010, 100514, 131018, 161522, 192026 |
| 1987 | ABV30657 | 1987 | 32491 | 62995, 93499, 124003, 154507, 185011 | 9003 | AFK14901 | 9003 | 39507 | 70011, 100515, 131019, 161523, 192027 |
| 1988 | ABV45860 | 1988 | 32492 | 62996, 93500, 124004, 154508, 185012 | 9004 | AFK14910 | 9004 | 39508 | 70012, 100516, 131020, 161524, 192028 |
| 1989 | ABV45871 | 1989 | 32493 | 62997, 93501, 124005, 154509, 185013 | 9005 | AFK14919 | 9005 | 39509 | 70013, 100517, 131021, 161525, 192029 |
| 1990 | ABV45882 | 1990 | 32494 | 62998, 93502, 124006, 154510, 185014 | 9006 | AFK14929 | 9006 | 39510 | 70014, 100518, 131022, 161526, 192030 |
| 1991 | ABV45893 | 1991 | 32495 | 62999, 93503, 124007, 154511, 185015 | 9007 | AFK25599 | 9007 | 39511 | 70015, 100519, 131023, 161527, 192031 |

FIG. 1 continued

| | | | | | | | | | |
|---|---|---|---|---|---|---|---|---|---|
| 1992 | ABV45904 | 1992 | 32496 | 63000, 93504, 124008, 154512, 185016 | 9008 | AFK25601 | 9008 | 39512 | 70016, 100520, 131024, 161528, 192032 |
| 1993 | ABV45926 | 1993 | 32497 | 63001, 93505, 124009, 154513, 185017 | 9009 | AFK25603 | 9009 | 39513 | 70017, 100521, 131025, 161529, 192033 |
| 1994 | ABV45937 | 1994 | 32498 | 63002, 93506, 124010, 154514, 185018 | 9010 | AFK25605 | 9010 | 39514 | 70018, 100522, 131026, 161530, 192034 |
| 1995 | ABV45948 | 1995 | 32499 | 63003, 93507, 124011, 154515, 185019 | 9011 | AFK74526 | 9011 | 39515 | 70019, 100523, 131027, 161531, 192035 |
| 1996 | ABV45959 | 1996 | 32500 | 63004, 93508, 124012, 154516, 185020 | 9012 | AFK74534 | 9012 | 39516 | 70020, 100524, 131028, 161532, 192036 |
| 1997 | ABV45970 | 1997 | 32501 | 63005, 93509, 124013, 154517, 185021 | 9013 | AFK74544 | 9013 | 39517 | 70021, 100525, 131029, 161533, 192037 |
| 1998 | ABV45981 | 1998 | 32502 | 63006, 93510, 124014, 154518, 185022 | 9014 | AFK74554 | 9014 | 39518 | 70022, 100526, 131030, 161534, 192038 |
| 1999 | ABV82551 | 1999 | 32503 | 63007, 93511, 124015, 154519, 185023 | 9015 | AFK74564 | 9015 | 39519 | 70023, 100527, 131031, 161535, 192039 |
| 2000 | ABV82562 | 2000 | 32504 | 63008, 93512, 124016, 154520, 185024 | 9016 | AFK74575 | 9016 | 39520 | 70024, 100528, 131032, 161536, 192040 |
| 2001 | ABW36168 | 2001 | 32505 | 63009, 93513, 124017, 154521, 185025 | 9017 | AFK74585 | 9017 | 39521 | 70025, 100529, 131033, 161537, 192041 |
| 2002 | ABW36179 | 2002 | 32506 | 63010, 93514, 124018, 154522, 185026 | 9018 | AFK74595 | 9018 | 39522 | 70026, 100530, 131034, 161538, 192042 |
| 2003 | ABW36190 | 2003 | 32507 | 63011, 93515, 124019, 154523, 185027 | 9019 | AFK74605 | 9019 | 39523 | 70027, 100531, 131035, 161539, 192043 |
| 2004 | ABW36201 | 2004 | 32508 | 63012, 93516, 124020, 154524, 185028 | 9020 | AFK74615 | 9020 | 39524 | 70028, 100532, 131036, 161540, 192044 |
| 2005 | ABW36212 | 2005 | 32509 | 63013, 93517, 124021, 154525, 185029 | 9021 | AFK74625 | 9021 | 39525 | 70029, 100533, 131037, 161541, 192045 |
| 2006 | ABW36223 | 2006 | 32510 | 63014, 93518, 124022, 154526, 185030 | 9022 | AFK74635 | 9022 | 39526 | 70030, 100534, 131038, 161542, 192046 |
| 2007 | ABW36245 | 2007 | 32511 | 63015, 93519, 124023, 154527, 185031 | 9023 | AFK74645 | 9023 | 39527 | 70031, 100535, 131039, 161543, 192047 |
| 2008 | ABW36267 | 2008 | 32512 | 63016, 93520, 124024, 154528, 185032 | 9024 | AFK74655 | 9024 | 39528 | 70032, 100536, 131040, 161544, 192048 |
| 2009 | ABW36278 | 2009 | 32513 | 63017, 93521, 124025, 154529, 185033 | 9025 | AFK74665 | 9025 | 39529 | 70033, 100537, 131041, 161545, 192049 |

FIG. 1 continued

| | | | | | | | | | |
|---|---|---|---|---|---|---|---|---|---|
| 2010 | ABW36289 | 2010 | 32514 | 63018, 93522, 124026, 154530, 185034 | 9026 | AFK74675 | 9026 | 39530 | 70034, 100538, 131042, 161546, 192050 |
| 2011 | ABW36300 | 2011 | 32515 | 63019, 93523, 124027, 154531, 185035 | 9027 | AFK74685 | 9027 | 39531 | 70035, 100539, 131043, 161547, 192051 |
| 2012 | ABW36311 | 2012 | 32516 | 63020, 93524, 124028, 154532, 185036 | 9028 | AFK74695 | 9028 | 39532 | 70036, 100540, 131044, 161548, 192052 |
| 2013 | ABW38363 | 2013 | 32517 | 63021, 93525, 124029, 154533, 185037 | 9029 | AFK74705 | 9029 | 39533 | 70037, 100541, 131045, 161549, 192053 |
| 2014 | ABW39777 | 2014 | 32518 | 63022, 93526, 124030, 154534, 185038 | 9030 | AFK74715 | 9030 | 39534 | 70038, 100542, 131046, 161550, 192054 |
| 2015 | ABW39806 | 2015 | 32519 | 63023, 93527, 124031, 154535, 185039 | 9031 | AFK74725 | 9031 | 39535 | 70039, 100543, 131047, 161551, 192055 |
| 2016 | ABW39817 | 2016 | 32520 | 63024, 93528, 124032, 154536, 185040 | 9032 | AFK74735 | 9032 | 39536 | 70040, 100544, 131048, 161552, 192056 |
| 2017 | ABW39828 | 2017 | 32521 | 63025, 93529, 124033, 154537, 185041 | 9033 | AFK74745 | 9033 | 39537 | 70041, 100545, 131049, 161553, 192057 |
| 2018 | ABW39839 | 2018 | 32522 | 63026, 93530, 124034, 154538, 185042 | 9034 | AFK74755 | 9034 | 39538 | 70042, 100546, 131050, 161554, 192058 |
| 2019 | ABW39850 | 2019 | 32523 | 63027, 93531, 124035, 154539, 185043 | 9035 | AFK74765 | 9035 | 39539 | 70043, 100547, 131051, 161555, 192059 |
| 2020 | ABW39861 | 2020 | 32524 | 63028, 93532, 124036, 154540, 185044 | 9036 | AFK74775 | 9036 | 39540 | 70044, 100548, 131052, 161556, 192060 |
| 2021 | ABW39872 | 2021 | 32525 | 63029, 93533, 124037, 154541, 185045 | 9037 | AFK74785 | 9037 | 39541 | 70045, 100549, 131053, 161557, 192061 |
| 2022 | ABW39883 | 2022 | 32526 | 63030, 93534, 124038, 154542, 185046 | 9038 | AFK74795 | 9038 | 39542 | 70046, 100550, 131054, 161558, 192062 |
| 2023 | ABW39894 | 2023 | 32527 | 63031, 93535, 124039, 154543, 185047 | 9039 | AFK74805 | 9039 | 39543 | 70047, 100551, 131055, 161559, 192063 |
| 2024 | ABW39905 | 2024 | 32528 | 63032, 93536, 124040, 154544, 185048 | 9040 | AFK74815 | 9040 | 39544 | 70048, 100552, 131056, 161560, 192064 |
| 2025 | ABW39927 | 2025 | 32529 | 63033, 93537, 124041, 154545, 185049 | 9041 | AFK74825 | 9041 | 39545 | 70049, 100553, 131057, 161561, 192065 |
| 2026 | ABW39938 | 2026 | 32530 | 63034, 93538, 124042, 154546, 185050 | 9042 | AFK74835 | 9042 | 39546 | 70050, 100554, 131058, 161562, 192066 |
| 2027 | ABW39949 | 2027 | 32531 | 63035, 93539, 124043, 154547, 185051 | 9043 | AFK74845 | 9043 | 39547 | 70051, 100555, 131059, 161563, 192067 |

FIG. 1 continued

| | | | | | | | | | |
|---|---|---|---|---|---|---|---|---|---|
| 2028 | ABW39960 | 2028 | 32532 | 63036, 93540, 124044, 154548, 185052 | 9044 | AFK74895 | 9044 | 39548 | 70052, 100556, 131060, 161564, 192068 |
| 2029 | ABW39982 | 2029 | 32533 | 63037, 93541, 124045, 154549, 185053 | 9045 | AFK74905 | 9045 | 39549 | 70053, 100557, 131061, 161565, 192069 |
| 2030 | ABW39993 | 2030 | 32534 | 63038, 93542, 124046, 154550, 185054 | 9046 | AFK74915 | 9046 | 39550 | 70054, 100558, 131062, 161566, 192070 |
| 2031 | ABW40004 | 2031 | 32535 | 63039, 93543, 124047, 154551, 185055 | 9047 | AFK74925 | 9047 | 39551 | 70055, 100559, 131063, 161567, 192071 |
| 2032 | ABW40015 | 2032 | 32536 | 63040, 93544, 124048, 154552, 185056 | 9048 | AFK74935 | 9048 | 39552 | 70056, 100560, 131064, 161568, 192072 |
| 2033 | ABW40026 | 2033 | 32537 | 63041, 93545, 124049, 154553, 185057 | 9049 | AFK74945 | 9049 | 39553 | 70057, 100561, 131065, 161569, 192073 |
| 2034 | ABW40037 | 2034 | 32538 | 63042, 93546, 124050, 154554, 185058 | 9050 | AFK74955 | 9050 | 39554 | 70058, 100562, 131066, 161570, 192074 |
| 2035 | ABW40048 | 2035 | 32539 | 63043, 93547, 124051, 154555, 185059 | 9051 | AFK74965 | 9051 | 39555 | 70059, 100563, 131067, 161571, 192075 |
| 2036 | ABW40059 | 2036 | 32540 | 63044, 93548, 124052, 154556, 185060 | 9052 | AFK74975 | 9052 | 39556 | 70060, 100564, 131068, 161572, 192076 |
| 2037 | ABW40070 | 2037 | 32541 | 63045, 93549, 124053, 154557, 185061 | 9053 | AFK74985 | 9053 | 39557 | 70061, 100565, 131069, 161573, 192077 |
| 2038 | ABW40081 | 2038 | 32542 | 63046, 93550, 124054, 154558, 185062 | 9054 | AFK74995 | 9054 | 39558 | 70062, 100566, 131070, 161574, 192078 |
| 2039 | ABW40092 | 2039 | 32543 | 63047, 93551, 124055, 154559, 185063 | 9055 | AFK75005 | 9055 | 39559 | 70063, 100567, 131071, 161575, 192079 |
| 2040 | ABW40103 | 2040 | 32544 | 63048, 93552, 124056, 154560, 185064 | 9056 | AFK75015 | 9056 | 39560 | 70064, 100568, 131072, 161576, 192080 |
| 2041 | ABW40114 | 2041 | 32545 | 63049, 93553, 124057, 154561, 185065 | 9057 | AFK75025 | 9057 | 39561 | 70065, 100569, 131073, 161577, 192081 |
| 2042 | ABW40125 | 2042 | 32546 | 63050, 93554, 124058, 154562, 185066 | 9058 | AFK75035 | 9058 | 39562 | 70066, 100570, 131074, 161578, 192082 |
| 2043 | ABW40136 | 2043 | 32547 | 63051, 93555, 124059, 154563, 185067 | 9059 | AFK75045 | 9059 | 39563 | 70067, 100571, 131075, 161579, 192083 |
| 2044 | ABW40147 | 2044 | 32548 | 63052, 93556, 124060, 154564, 185068 | 9060 | AFK75055 | 9060 | 39564 | 70068, 100572, 131076, 161580, 192084 |
| 2045 | ABW40158 | 2045 | 32549 | 63053, 93557, 124061, 154565, 185069 | 9061 | AFK75065 | 9061 | 39565 | 70069, 100573, 131077, 161581, 192085 |

FIG. 1 continued

| | | | | | | | | | |
|---|---|---|---|---|---|---|---|---|---|
| 2046 | ABW40180 | 2046 | 32550 | 63054, 93558, 124062, 154566, 185070 | 9062 | AFK75075 | 9062 | 39566 | 70070, 100574, 131078, 161582, 192086 |
| 2047 | ABW40191 | 2047 | 32551 | 63055, 93559, 124063, 154567, 185071 | 9063 | AFK75085 | 9063 | 39567 | 70071, 100575, 131079, 161583, 192087 |
| 2048 | ABW40202 | 2048 | 32552 | 63056, 93560, 124064, 154568, 185072 | 9064 | AFK75095 | 9064 | 39568 | 70072, 100576, 131080, 161584, 192088 |
| 2049 | ABW40213 | 2049 | 32553 | 63057, 93561, 124065, 154569, 185073 | 9065 | AFK75105 | 9065 | 39569 | 70073, 100577, 131081, 161585, 192089 |
| 2050 | ABW40224 | 2050 | 32554 | 63058, 93562, 124066, 154570, 185074 | 9066 | AFK77857 | 9066 | 39570 | 70074, 100578, 131082, 161586, 192090 |
| 2051 | ABW40235 | 2051 | 32555 | 63059, 93563, 124067, 154571, 185075 | 9067 | AFK77867 | 9067 | 39571 | 70075, 100579, 131083, 161587, 192091 |
| 2052 | ABW40246 | 2052 | 32556 | 63060, 93564, 124068, 154572, 185076 | 9068 | AFK77877 | 9068 | 39572 | 70076, 100580, 131084, 161588, 192092 |
| 2053 | ABW40257 | 2053 | 32557 | 63061, 93565, 124069, 154573, 185077 | 9069 | AFK77887 | 9069 | 39573 | 70077, 100581, 131085, 161589, 192093 |
| 2054 | ABW40268 | 2054 | 32558 | 63062, 93566, 124070, 154574, 185078 | 9070 | AFK77897 | 9070 | 39574 | 70078, 100582, 131086, 161590, 192094 |
| 2055 | ABW40312 | 2055 | 32559 | 63063, 93567, 124071, 154575, 185079 | 9071 | AFK78028 | 9071 | 39575 | 70079, 100583, 131087, 161591, 192095 |
| 2056 | ABW40323 | 2056 | 32560 | 63064, 93568, 124072, 154576, 185080 | 9072 | AFK78187 | 9072 | 39576 | 70080, 100584, 131088, 161592, 192096 |
| 2057 | ABW40334 | 2057 | 32561 | 63065, 93569, 124073, 154577, 185081 | 9073 | AFM45476 | 9073 | 39577 | 70081, 100585, 131089, 161593, 192097 |
| 2058 | ABW40345 | 2058 | 32562 | 63066, 93570, 124074, 154578, 185082 | 9074 | AFM45487 | 9074 | 39578 | 70082, 100586, 131090, 161594, 192098 |
| 2059 | ABW40356 | 2059 | 32563 | 63067, 93571, 124075, 154579, 185083 | 9075 | AFM45489 | 9075 | 39579 | 70083, 100587, 131091, 161595, 192099 |
| 2060 | ABW40367 | 2060 | 32564 | 63068, 93572, 124076, 154580, 185084 | 9076 | AFM45494 | 9076 | 39580 | 70084, 100588, 131092, 161596, 192100 |
| 2061 | ABW40378 | 2061 | 32565 | 63069, 93573, 124077, 154581, 185085 | 9077 | AFM68954 | 9077 | 39581 | 70085, 100589, 131093, 161597, 192101 |
| 2062 | ABW40389 | 2062 | 32566 | 63070, 93574, 124078, 154582, 185086 | 9078 | AFM68965 | 9078 | 39582 | 70086, 100590, 131094, 161598, 192102 |
| 2063 | ABW40400 | 2063 | 32567 | 63071, 93575, 124079, 154583, 185087 | 9079 | AFM68987 | 9079 | 39583 | 70087, 100591, 131095, 161599, 192103 |

FIG. 1 continued

| | | | | | | | | | |
|---|---|---|---|---|---|---|---|---|---|
| 2064 | ABW40411 | 2064 | 32568 | 63072, 93576, 124080, 154584, 185088 | 9080 | AFM71720 | 9080 | 39584 | 70088, 100592, 131096, 161600, 192104 |
| 2065 | ABW40422 | 2065 | 32569 | 63073, 93577, 124081, 154585, 185089 | 9081 | AFM71731 | 9081 | 39585 | 70089, 100593, 131097, 161601, 192105 |
| 2066 | ABW40433 | 2066 | 32570 | 63074, 93578, 124082, 154586, 185090 | 9082 | AFM71754 | 9082 | 39586 | 70090, 100594, 131098, 161602, 192106 |
| 2067 | ABW40444 | 2067 | 32571 | 63075, 93579, 124083, 154587, 185091 | 9083 | AFM71768 | 9083 | 39587 | 70091, 100595, 131099, 161603, 192107 |
| 2068 | ABW40455 | 2068 | 32572 | 63076, 93580, 124084, 154588, 185092 | 9084 | AFM71791 | 9084 | 39588 | 70092, 100596, 131100, 161604, 192108 |
| 2069 | ABW40466 | 2069 | 32573 | 63077, 93581, 124085, 154589, 185093 | 9085 | AFM71824 | 9085 | 39589 | 70093, 100597, 131101, 161605, 192109 |
| 2070 | ABW40477 | 2070 | 32574 | 63078, 93582, 124086, 154590, 185094 | 9086 | AFM71835 | 9086 | 39590 | 70094, 100598, 131102, 161606, 192110 |
| 2071 | ABW40488 | 2071 | 32575 | 63079, 93583, 124087, 154591, 185095 | 9087 | AFM71846 | 9087 | 39591 | 70095, 100599, 131103, 161607, 192111 |
| 2072 | ABW40499 | 2072 | 32576 | 63080, 93584, 124088, 154592, 185096 | 9088 | AFM71857 | 9088 | 39592 | 70096, 100600, 131104, 161608, 192112 |
| 2073 | ABW40510 | 2073 | 32577 | 63081, 93585, 124089, 154593, 185097 | 9089 | AFM71868 | 9089 | 39593 | 70097, 100601, 131105, 161609, 192113 |
| 2074 | ABW40521 | 2074 | 32578 | 63082, 93586, 124090, 154594, 185098 | 9090 | AFM71879 | 9090 | 39594 | 70098, 100602, 131106, 161610, 192114 |
| 2075 | ABW40532 | 2075 | 32579 | 63083, 93587, 124091, 154595, 185099 | 9091 | AFM71890 | 9091 | 39595 | 70099, 100603, 131107, 161611, 192115 |
| 2076 | ABW40543 | 2076 | 32580 | 63084, 93588, 124092, 154596, 185100 | 9092 | AFM71901 | 9092 | 39596 | 70100, 100604, 131108, 161612, 192116 |
| 2077 | ABW40554 | 2077 | 32581 | 63085, 93589, 124093, 154597, 185101 | 9093 | AFM71923 | 9093 | 39597 | 70101, 100605, 131109, 161613, 192117 |
| 2078 | ABW40565 | 2078 | 32582 | 63086, 93590, 124094, 154598, 185102 | 9094 | AFM71934 | 9094 | 39598 | 70102, 100606, 131110, 161614, 192118 |
| 2079 | ABW40576 | 2079 | 32583 | 63087, 93591, 124095, 154599, 185103 | 9095 | AFM71945 | 9095 | 39599 | 70103, 100607, 131111, 161615, 192119 |
| 2080 | ABW40587 | 2080 | 32584 | 63088, 93592, 124096, 154600, 185104 | 9096 | AFM71956 | 9096 | 39600 | 70104, 100608, 131112, 161616, 192120 |
| 2081 | ABW40598 | 2081 | 32585 | 63089, 93593, 124097, 154601, 185105 | 9097 | AFM71978 | 9097 | 39601 | 70105, 100609, 131113, 161617, 192121 |

FIG. 1 continued

| | | | | | | | | | |
|---|---|---|---|---|---|---|---|---|---|
| 2082 | ABW40609 | 2082 | 32586 | 63090, 93594, 124098, 154602, 185106 | 9098 | AFM71989 | 9098 | 39602 | 70106, 100610, 131114, 161618, 192122 |
| 2083 | ABW40620 | 2083 | 32587 | 63091, 93595, 124099, 154603, 185107 | 9099 | AFM72010 | 9099 | 39603 | 70107, 100611, 131115, 161619, 192123 |
| 2084 | ABW40631 | 2084 | 32588 | 63092, 93596, 124100, 154604, 185108 | 9100 | AFM72021 | 9100 | 39604 | 70108, 100612, 131116, 161620, 192124 |
| 2085 | ABW40642 | 2085 | 32589 | 63093, 93597, 124101, 154605, 185109 | 9101 | AFM72032 | 9101 | 39605 | 70109, 100613, 131117, 161621, 192125 |
| 2086 | ABW40653 | 2086 | 32590 | 63094, 93598, 124102, 154606, 185110 | 9102 | AFM72043 | 9102 | 39606 | 70110, 100614, 131118, 161622, 192126 |
| 2087 | ABW40664 | 2087 | 32591 | 63095, 93599, 124103, 154607, 185111 | 9103 | AFM72054 | 9103 | 39607 | 70111, 100615, 131119, 161623, 192127 |
| 2088 | ABW40675 | 2088 | 32592 | 63096, 93600, 124104, 154608, 185112 | 9104 | AFM72065 | 9104 | 39608 | 70112, 100616, 131120, 161624, 192128 |
| 2089 | ABW71294 | 2089 | 32593 | 63097, 93601, 124105, 154609, 185113 | 9105 | AFM72087 | 9105 | 39609 | 70113, 100617, 131121, 161625, 192129 |
| 2090 | ABW71305 | 2090 | 32594 | 63098, 93602, 124106, 154610, 185114 | 9106 | AFM72098 | 9106 | 39610 | 70114, 100618, 131122, 161626, 192130 |
| 2091 | ABW71316 | 2091 | 32595 | 63099, 93603, 124107, 154611, 185115 | 9107 | AFM72109 | 9107 | 39611 | 70115, 100619, 131123, 161627, 192131 |
| 2092 | ABW71327 | 2092 | 32596 | 63100, 93604, 124108, 154612, 185116 | 9108 | AFM72120 | 9108 | 39612 | 70116, 100620, 131124, 161628, 192132 |
| 2093 | ABW71338 | 2093 | 32597 | 63101, 93605, 124109, 154613, 185117 | 9109 | AFM72131 | 9109 | 39613 | 70117, 100621, 131125, 161629, 192133 |
| 2094 | ABW71349 | 2094 | 32598 | 63102, 93606, 124110, 154614, 185118 | 9110 | AFM72142 | 9110 | 39614 | 70118, 100622, 131126, 161630, 192134 |
| 2095 | ABW71360 | 2095 | 32599 | 63103, 93607, 124111, 154615, 185119 | 9111 | AFM72153 | 9111 | 39615 | 70119, 100623, 131127, 161631, 192135 |
| 2096 | ABW71371 | 2096 | 32600 | 63104, 93608, 124112, 154616, 185120 | 9112 | AFM72164 | 9112 | 39616 | 70120, 100624, 131128, 161632, 192136 |
| 2097 | ABW71382 | 2097 | 32601 | 63105, 93609, 124113, 154617, 185121 | 9113 | AFM72175 | 9113 | 39617 | 70121, 100625, 131129, 161633, 192137 |
| 2098 | ABW71393 | 2098 | 32602 | 63106, 93610, 124114, 154618, 185122 | 9114 | AFM72197 | 9114 | 39618 | 70122, 100626, 131130, 161634, 192138 |
| 2099 | ABW71404 | 2099 | 32603 | 63107, 93611, 124115, 154619, 185123 | 9115 | AFM72208 | 9115 | 39619 | 70123, 100627, 131131, 161635, 192139 |

FIG. 1 continued

| | | | | | | | | | |
|---|---|---|---|---|---|---|---|---|---|
| 2100 | ABW71415 | 2100 | 32604 | 63108, 93612, 124116, 154620, 185124 | 9116 | AFM72219 | 9116 | 39620 | 70124, 100628, 131132, 161636, 192140 |
| 2101 | ABW71426 | 2101 | 32605 | 63109, 93613, 124117, 154621, 185125 | 9117 | AFM72230 | 9117 | 39621 | 70125, 100629, 131133, 161637, 192141 |
| 2102 | ABW71448 | 2102 | 32606 | 63110, 93614, 124118, 154622, 185126 | 9118 | AFM72246 | 9118 | 39622 | 70126, 100630, 131134, 161638, 192142 |
| 2103 | ABW71459 | 2103 | 32607 | 63111, 93615, 124119, 154623, 185127 | 9119 | AFM72257 | 9119 | 39623 | 70127, 100631, 131135, 161639, 192143 |
| 2104 | ABW71470 | 2104 | 32608 | 63112, 93616, 124120, 154624, 185128 | 9120 | AFM72268 | 9120 | 39624 | 70128, 100632, 131136, 161640, 192144 |
| 2105 | ABW74702 | 2105 | 32609 | 63113, 93617, 124121, 154625, 185129 | 9121 | AFM72279 | 9121 | 39625 | 70129, 100633, 131137, 161641, 192145 |
| 2106 | ABW74703 | 2106 | 32610 | 63114, 93618, 124122, 154626, 185130 | 9122 | AFM72290 | 9122 | 39626 | 70130, 100634, 131138, 161642, 192146 |
| 2107 | ABW74705 | 2107 | 32611 | 63115, 93619, 124123, 154627, 185131 | 9123 | AFM72301 | 9123 | 39627 | 70131, 100635, 131139, 161643, 192147 |
| 2108 | ABW74707 | 2108 | 32612 | 63116, 93620, 124124, 154628, 185132 | 9124 | AFM72312 | 9124 | 39628 | 70132, 100636, 131140, 161644, 192148 |
| 2109 | ABW74708 | 2109 | 32613 | 63117, 93621, 124125, 154629, 185133 | 9125 | AFM72323 | 9125 | 39629 | 70133, 100637, 131141, 161645, 192149 |
| 2110 | ABW74710 | 2110 | 32614 | 63118, 93622, 124126, 154630, 185134 | 9126 | AFM72334 | 9126 | 39630 | 70134, 100638, 131142, 161646, 192150 |
| 2111 | ABW74711 | 2111 | 32615 | 63119, 93623, 124127, 154631, 185135 | 9127 | AFM72345 | 9127 | 39631 | 70135, 100639, 131143, 161647, 192151 |
| 2112 | ABW74712 | 2112 | 32616 | 63120, 93624, 124128, 154632, 185136 | 9128 | AFM72356 | 9128 | 39632 | 70136, 100640, 131144, 161648, 192152 |
| 2113 | ABW80976 | 2113 | 32617 | 63121, 93625, 124129, 154633, 185137 | 9129 | AFM72367 | 9129 | 39633 | 70137, 100641, 131145, 161649, 192153 |
| 2114 | ABW80977 | 2114 | 32618 | 63122, 93626, 124130, 154634, 185138 | 9130 | AFM72378 | 9130 | 39634 | 70138, 100642, 131146, 161650, 192154 |
| 2115 | ABW80979 | 2115 | 32619 | 63123, 93627, 124131, 154635, 185139 | 9131 | AFM72389 | 9131 | 39635 | 70139, 100643, 131147, 161651, 192155 |
| 2116 | ABW81505 | 2116 | 32620 | 63124, 93628, 124132, 154636, 185140 | 9132 | AFM72400 | 9132 | 39636 | 70140, 100644, 131148, 161652, 192156 |
| 2117 | ABW81506 | 2117 | 32621 | 63125, 93629, 124133, 154637, 185141 | 9133 | AFM72411 | 9133 | 39637 | 70141, 100645, 131149, 161653, 192157 |

FIG. 1 continued

| | | | | | | | | | |
|---|---|---|---|---|---|---|---|---|---|
| 2118 | ABW81507 | 2118 | 32622 | 63126, 93630, 124134, 154638, 185142 | 9134 | AFM72422 | 9134 | 39638 | 70142, 100646, 131150, 161654, 192158 |
| 2119 | ABW81508 | 2119 | 32623 | 63127, 93631, 124135, 154639, 185143 | 9135 | AFM72433 | 9135 | 39639 | 70143, 100647, 131151, 161655, 192159 |
| 2120 | ABW81509 | 2120 | 32624 | 63128, 93632, 124136, 154640, 185144 | 9136 | AFM72444 | 9136 | 39640 | 70144, 100648, 131152, 161656, 192160 |
| 2121 | ABW81511 | 2121 | 32625 | 63129, 93633, 124137, 154641, 185145 | 9137 | AFM72455 | 9137 | 39641 | 70145, 100649, 131153, 161657, 192161 |
| 2122 | ABW81512 | 2122 | 32626 | 63130, 93634, 124138, 154642, 185146 | 9138 | AFM72466 | 9138 | 39642 | 70146, 100650, 131154, 161658, 192162 |
| 2123 | ABW81513 | 2123 | 32627 | 63131, 93635, 124139, 154643, 185147 | 9139 | AFM72488 | 9139 | 39643 | 70147, 100651, 131155, 161659, 192163 |
| 2124 | ABW81514 | 2124 | 32628 | 63132, 93636, 124140, 154644, 185148 | 9140 | AFM72499 | 9140 | 39644 | 70148, 100652, 131156, 161660, 192164 |
| 2125 | ABW81515 | 2125 | 32629 | 63133, 93637, 124141, 154645, 185149 | 9141 | AFM72521 | 9141 | 39645 | 70149, 100653, 131157, 161661, 192165 |
| 2126 | ABW81516 | 2126 | 32630 | 63134, 93638, 124142, 154646, 185150 | 9142 | AFM72532 | 9142 | 39646 | 70150, 100654, 131158, 161662, 192166 |
| 2127 | ABW81517 | 2127 | 32631 | 63135, 93639, 124143, 154647, 185151 | 9143 | AFM72543 | 9143 | 39647 | 70151, 100655, 131159, 161663, 192167 |
| 2128 | ABW81518 | 2128 | 32632 | 63136, 93640, 124144, 154648, 185152 | 9144 | AFM72554 | 9144 | 39648 | 70152, 100656, 131160, 161664, 192168 |
| 2129 | ABW81519 | 2129 | 32633 | 63137, 93641, 124145, 154649, 185153 | 9145 | AFM72565 | 9145 | 39649 | 70153, 100657, 131161, 161665, 192169 |
| 2130 | ABW81520 | 2130 | 32634 | 63138, 93642, 124146, 154650, 185154 | 9146 | AFM72576 | 9146 | 39650 | 70154, 100658, 131162, 161666, 192170 |
| 2131 | ABW81521 | 2131 | 32635 | 63139, 93643, 124147, 154651, 185155 | 9147 | AFM72799 | 9147 | 39651 | 70155, 100659, 131163, 161667, 192171 |
| 2132 | ABW81522 | 2132 | 32636 | 63140, 93644, 124148, 154652, 185156 | 9148 | AFM72810 | 9148 | 39652 | 70156, 100660, 131164, 161668, 192172 |
| 2133 | ABW81523 | 2133 | 32637 | 63141, 93645, 124149, 154653, 185157 | 9149 | AFM72821 | 9149 | 39653 | 70157, 100661, 131165, 161669, 192173 |
| 2134 | ABW81524 | 2134 | 32638 | 63142, 93646, 124150, 154654, 185158 | 9150 | AFM72852 | 9150 | 39654 | 70158, 100662, 131166, 161670, 192174 |
| 2135 | ABW81526 | 2135 | 32639 | 63143, 93647, 124151, 154655, 185159 | 9151 | AFM72862 | 9151 | 39655 | 70159, 100663, 131167, 161671, 192175 |

FIG. 1 continued

| | | | | | | | | | |
|---|---|---|---|---|---|---|---|---|---|
| 2136 | ABW81527 | 2136 | 32640 | 63144, 93648, 124152, 154656, 185160 | 9152 | AFM72872 | 9152 | 39656 | 70160, 100664, 131168, 161672, 192176 |
| 2137 | ABW81528 | 2137 | 32641 | 63145, 93649, 124153, 154657, 185161 | 9153 | AFM72883 | 9153 | 39657 | 70161, 100665, 131169, 161673, 192177 |
| 2138 | ABW81529 | 2138 | 32642 | 63146, 93650, 124154, 154658, 185162 | 9154 | AFM72894 | 9154 | 39658 | 70162, 100666, 131170, 161674, 192178 |
| 2139 | ABW81530 | 2139 | 32643 | 63147, 93651, 124155, 154659, 185163 | 9155 | AFM72916 | 9155 | 39659 | 70163, 100667, 131171, 161675, 192179 |
| 2140 | ABW81531 | 2140 | 32644 | 63148, 93652, 124156, 154660, 185164 | 9156 | AFM72927 | 9156 | 39660 | 70164, 100668, 131172, 161676, 192180 |
| 2141 | ABW81532 | 2141 | 32645 | 63149, 93653, 124157, 154661, 185165 | 9157 | AFM72938 | 9157 | 39661 | 70165, 100669, 131173, 161677, 192181 |
| 2142 | ABW86321 | 2142 | 32646 | 63150, 93654, 124158, 154662, 185166 | 9158 | AFM72949 | 9158 | 39662 | 70166, 100670, 131174, 161678, 192182 |
| 2143 | ABW86332 | 2143 | 32647 | 63151, 93655, 124159, 154663, 185167 | 9159 | AFM72960 | 9159 | 39663 | 70167, 100671, 131175, 161679, 192183 |
| 2144 | ABW86343 | 2144 | 32648 | 63152, 93656, 124160, 154664, 185168 | 9160 | AFM72971 | 9160 | 39664 | 70168, 100672, 131176, 161680, 192184 |
| 2145 | ABW86354 | 2145 | 32649 | 63153, 93657, 124161, 154665, 185169 | 9161 | AFM72982 | 9161 | 39665 | 70169, 100673, 131177, 161681, 192185 |
| 2146 | ABW86365 | 2146 | 32650 | 63154, 93658, 124162, 154666, 185170 | 9162 | AFM72993 | 9162 | 39666 | 70170, 100674, 131178, 161682, 192186 |
| 2147 | ABW86376 | 2147 | 32651 | 63155, 93659, 124163, 154667, 185171 | 9163 | AFM73004 | 9163 | 39667 | 70171, 100675, 131179, 161683, 192187 |
| 2148 | ABW86387 | 2148 | 32652 | 63156, 93660, 124164, 154668, 185172 | 9164 | AFM73015 | 9164 | 39668 | 70172, 100676, 131180, 161684, 192188 |
| 2149 | ABW86409 | 2149 | 32653 | 63157, 93661, 124165, 154669, 185173 | 9165 | AFM73025 | 9165 | 39669 | 70173, 100677, 131181, 161685, 192189 |
| 2150 | ABW86431 | 2150 | 32654 | 63158, 93662, 124166, 154670, 185174 | 9166 | AFM73035 | 9166 | 39670 | 70174, 100678, 131182, 161686, 192190 |
| 2151 | ABW86442 | 2151 | 32655 | 63159, 93663, 124167, 154671, 185175 | 9167 | AFM73045 | 9167 | 39671 | 70175, 100679, 131183, 161687, 192191 |
| 2152 | ABW86453 | 2152 | 32656 | 63160, 93664, 124168, 154672, 185176 | 9168 | AFM73055 | 9168 | 39672 | 70176, 100680, 131184, 161688, 192192 |
| 2153 | ABW86464 | 2153 | 32657 | 63161, 93665, 124169, 154673, 185177 | 9169 | AFM73065 | 9169 | 39673 | 70177, 100681, 131185, 161689, 192193 |

FIG. 1 continued

| | | | | | | | | | |
|---|---|---|---|---|---|---|---|---|---|
| 2154 | ABW86475 | 2154 | 32658 | 63162, 93666, 124170, 154674, 185178 | 9170 | AFM73477 | 9170 | 39674 | 70178, 100682, 131186, 161690, 192194 |
| 2155 | ABW86486 | 2155 | 32659 | 63163, 93667, 124171, 154675, 185179 | 9171 | AFM78567 | 9171 | 39675 | 70179, 100683, 131187, 161691, 192195 |
| 2156 | ABW86497 | 2156 | 32660 | 63164, 93668, 124172, 154676, 185180 | 9172 | AFM78646 | 9172 | 39676 | 70180, 100684, 131188, 161692, 192196 |
| 2157 | ABW86508 | 2157 | 32661 | 63165, 93669, 124173, 154677, 185181 | 9173 | AFM85179 | 9173 | 39677 | 70181, 100685, 131189, 161693, 192197 |
| 2158 | ABW86519 | 2158 | 32662 | 63166, 93670, 124174, 154678, 185182 | 9174 | AFN11846 | 9174 | 39678 | 70182, 100686, 131190, 161694, 192198 |
| 2159 | ABW86530 | 2159 | 32663 | 63167, 93671, 124175, 154679, 185183 | 9175 | AFN17371 | 9175 | 39679 | 70183, 100687, 131191, 161695, 192199 |
| 2160 | ABW86541 | 2160 | 32664 | 63168, 93672, 124176, 154680, 185184 | 9176 | AFN17381 | 9176 | 39680 | 70184, 100688, 131192, 161696, 192200 |
| 2161 | ABW86552 | 2161 | 32665 | 63169, 93673, 124177, 154681, 185185 | 9177 | AFN17391 | 9177 | 39681 | 70185, 100689, 131193, 161697, 192201 |
| 2162 | ABW86563 | 2162 | 32666 | 63170, 93674, 124178, 154682, 185186 | 9178 | AFN17401 | 9178 | 39682 | 70186, 100690, 131194, 161698, 192202 |
| 2163 | ABW86606 | 2163 | 32667 | 63171, 93675, 124179, 154683, 185187 | 9179 | AFN17411 | 9179 | 39683 | 70187, 100691, 131195, 161699, 192203 |
| 2164 | ABW91185 | 2164 | 32668 | 63172, 93676, 124180, 154684, 185188 | 9180 | AFN17421 | 9180 | 39684 | 70188, 100692, 131196, 161700, 192204 |
| 2165 | ABW91196 | 2165 | 32669 | 63173, 93677, 124181, 154685, 185189 | 9181 | AFN17431 | 9181 | 39685 | 70189, 100693, 131197, 161701, 192205 |
| 2166 | ABW91207 | 2166 | 32670 | 63174, 93678, 124182, 154686, 185190 | 9182 | AFN17441 | 9182 | 39686 | 70190, 100694, 131198, 161702, 192206 |
| 2167 | ABW91218 | 2167 | 32671 | 63175, 93679, 124183, 154687, 185191 | 9183 | AFN17451 | 9183 | 39687 | 70191, 100695, 131199, 161703, 192207 |
| 2168 | ABW91240 | 2168 | 32672 | 63176, 93680, 124184, 154688, 185192 | 9184 | AFN17467 | 9184 | 39688 | 70192, 100696, 131200, 161704, 192208 |
| 2169 | ABW91251 | 2169 | 32673 | 63177, 93681, 124185, 154689, 185193 | 9185 | AFN17477 | 9185 | 39689 | 70193, 100697, 131201, 161705, 192209 |
| 2170 | ABW91262 | 2170 | 32674 | 63178, 93682, 124186, 154690, 185194 | 9186 | AFN17487 | 9186 | 39690 | 70194, 100698, 131202, 161706, 192210 |
| 2171 | ABW91273 | 2171 | 32675 | 63179, 93683, 124187, 154691, 185195 | 9187 | AFN17497 | 9187 | 39691 | 70195, 100699, 131203, 161707, 192211 |

FIG. 1 continued

| | | | | | | | | | |
|---|---|---|---|---|---|---|---|---|---|
| 2172 | ABW91284 | 2172 | 32676 | 63180, 93684, 124188, 154692, 185196 | 9188 | AFN17507 | 9188 | 39692 | 70196, 100700, 131204, 161708, 192212 |
| 2173 | ABW91295 | 2173 | 32677 | 63181, 93685, 124189, 154693, 185197 | 9189 | AFN17517 | 9189 | 39693 | 70197, 100701, 131205, 161709, 192213 |
| 2174 | ABW91306 | 2174 | 32678 | 63182, 93686, 124190, 154694, 185198 | 9190 | AFN17527 | 9190 | 39694 | 70198, 100702, 131206, 161710, 192214 |
| 2175 | ABW91317 | 2175 | 32679 | 63183, 93687, 124191, 154695, 185199 | 9191 | AFN17537 | 9191 | 39695 | 70199, 100703, 131207, 161711, 192215 |
| 2176 | ABW91328 | 2176 | 32680 | 63184, 93688, 124192, 154696, 185200 | 9192 | AFN17547 | 9192 | 39696 | 70200, 100704, 131208, 161712, 192216 |
| 2177 | ABW91339 | 2177 | 32681 | 63185, 93689, 124193, 154697, 185201 | 9193 | AFN17557 | 9193 | 39697 | 70201, 100705, 131209, 161713, 192217 |
| 2178 | ABW91350 | 2178 | 32682 | 63186, 93690, 124194, 154698, 185202 | 9194 | AFN17567 | 9194 | 39698 | 70202, 100706, 131210, 161714, 192218 |
| 2179 | ABW91361 | 2179 | 32683 | 63187, 93691, 124195, 154699, 185203 | 9195 | AFN17574 | 9195 | 39699 | 70203, 100707, 131211, 161715, 192219 |
| 2180 | ABW91372 | 2180 | 32684 | 63188, 93692, 124196, 154700, 185204 | 9196 | AFN17580 | 9196 | 39700 | 70204, 100708, 131212, 161716, 192220 |
| 2181 | ABW91383 | 2181 | 32685 | 63189, 93693, 124197, 154701, 185205 | 9197 | AFN17586 | 9197 | 39701 | 70205, 100709, 131213, 161717, 192221 |
| 2182 | ABW91394 | 2182 | 32686 | 63190, 93694, 124198, 154702, 185206 | 9198 | AFN17595 | 9198 | 39702 | 70206, 100710, 131214, 161718, 192222 |
| 2183 | ABW91405 | 2183 | 32687 | 63191, 93695, 124199, 154703, 185207 | 9199 | AFN17605 | 9199 | 39703 | 70207, 100711, 131215, 161719, 192223 |
| 2184 | ABW91416 | 2184 | 32688 | 63192, 93696, 124200, 154704, 185208 | 9200 | AFN17615 | 9200 | 39704 | 70208, 100712, 131216, 161720, 192224 |
| 2185 | ABW91427 | 2185 | 32689 | 63193, 93697, 124201, 154705, 185209 | 9201 | AFN17625 | 9201 | 39705 | 70209, 100713, 131217, 161721, 192225 |
| 2186 | ABW91438 | 2186 | 32690 | 63194, 93698, 124202, 154706, 185210 | 9202 | AFN17635 | 9202 | 39706 | 70210, 100714, 131218, 161722, 192226 |
| 2187 | ABW91449 | 2187 | 32691 | 63195, 93699, 124203, 154707, 185211 | 9203 | AFN17645 | 9203 | 39707 | 70211, 100715, 131219, 161723, 192227 |
| 2188 | ABW91460 | 2188 | 32692 | 63196, 93700, 124204, 154708, 185212 | 9204 | AFN17655 | 9204 | 39708 | 70212, 100716, 131220, 161724, 192228 |
| 2189 | ABW91471 | 2189 | 32693 | 63197, 93701, 124205, 154709, 185213 | 9205 | AFN17665 | 9205 | 39709 | 70213, 100717, 131221, 161725, 192229 |

FIG. 1 continued

| | | | | | | | | | |
|---|---|---|---|---|---|---|---|---|---|
| 2190 | ABW91482 | 2190 | 32694 | 63198, 93702, 124206, 154710, 185214 | 9206 | AFN17675 | 9206 | 39710 | 70214, 100718, 131222, 161726, 192230 |
| 2191 | ABW91493 | 2191 | 32695 | 63199, 93703, 124207, 154711, 185215 | 9207 | AFN17685 | 9207 | 39711 | 70215, 100719, 131223, 161727, 192231 |
| 2192 | ABW91504 | 2192 | 32696 | 63200, 93704, 124208, 154712, 185216 | 9208 | AFN17695 | 9208 | 39712 | 70216, 100720, 131224, 161728, 192232 |
| 2193 | ABW91515 | 2193 | 32697 | 63201, 93705, 124209, 154713, 185217 | 9209 | AFN17705 | 9209 | 39713 | 70217, 100721, 131225, 161729, 192233 |
| 2194 | ABW91526 | 2194 | 32698 | 63202, 93706, 124210, 154714, 185218 | 9210 | AFN17715 | 9210 | 39714 | 70218, 100722, 131226, 161730, 192234 |
| 2195 | ABW91537 | 2195 | 32699 | 63203, 93707, 124211, 154715, 185219 | 9211 | AFN17725 | 9211 | 39715 | 70219, 100723, 131227, 161731, 192235 |
| 2196 | ABW91548 | 2196 | 32700 | 63204, 93708, 124212, 154716, 185220 | 9212 | AFN17735 | 9212 | 39716 | 70220, 100724, 131228, 161732, 192236 |
| 2197 | ABW91559 | 2197 | 32701 | 63205, 93709, 124213, 154717, 185221 | 9213 | AFN17742 | 9213 | 39717 | 70221, 100725, 131229, 161733, 192237 |
| 2198 | ABW91570 | 2198 | 32702 | 63206, 93710, 124214, 154718, 185222 | 9214 | AFN17748 | 9214 | 39718 | 70222, 100726, 131230, 161734, 192238 |
| 2199 | ABW91581 | 2199 | 32703 | 63207, 93711, 124215, 154719, 185223 | 9215 | AFN17757 | 9215 | 39719 | 70223, 100727, 131231, 161735, 192239 |
| 2200 | ABW91592 | 2200 | 32704 | 63208, 93712, 124216, 154720, 185224 | 9216 | AFN17767 | 9216 | 39720 | 70224, 100728, 131232, 161736, 192240 |
| 2201 | ABW91603 | 2201 | 32705 | 63209, 93713, 124217, 154721, 185225 | 9217 | AFN17774 | 9217 | 39721 | 70225, 100729, 131233, 161737, 192241 |
| 2202 | ABW91614 | 2202 | 32706 | 63210, 93714, 124218, 154722, 185226 | 9218 | AFN17783 | 9218 | 39722 | 70226, 100730, 131234, 161738, 192242 |
| 2203 | ABW91625 | 2203 | 32707 | 63211, 93715, 124219, 154723, 185227 | 9219 | AFN17793 | 9219 | 39723 | 70227, 100731, 131235, 161739, 192243 |
| 2204 | ABW91636 | 2204 | 32708 | 63212, 93716, 124220, 154724, 185228 | 9220 | AFN17803 | 9220 | 39724 | 70228, 100732, 131236, 161740, 192244 |
| 2205 | ABW91647 | 2205 | 32709 | 63213, 93717, 124221, 154725, 185229 | 9221 | AFN17813 | 9221 | 39725 | 70229, 100733, 131237, 161741, 192245 |
| 2206 | ABX10515 | 2206 | 32710 | 63214, 93718, 124222, 154726, 185230 | 9222 | AFN17823 | 9222 | 39726 | 70230, 100734, 131238, 161742, 192246 |
| 2207 | ABX10525 | 2207 | 32711 | 63215, 93719, 124223, 154727, 185231 | 9223 | AFN17833 | 9223 | 39727 | 70231, 100735, 131239, 161743, 192247 |

FIG. 1 continued

| | | | | | | | | | |
|---|---|---|---|---|---|---|---|---|---|
| 2208 | ABX58239 | 2208 | 32712 | 63216, 93720, 124224, 154728, 185232 | 9224 | AFN17843 | 9224 | 39728 | 70232, 100736, 131240, 161744, 192248 |
| 2209 | ABX58250 | 2209 | 32713 | 63217, 93721, 124225, 154729, 185233 | 9225 | AFN17853 | 9225 | 39729 | 70233, 100737, 131241, 161745, 192249 |
| 2210 | ABX58261 | 2210 | 32714 | 63218, 93722, 124226, 154730, 185234 | 9226 | AFN17863 | 9226 | 39730 | 70234, 100738, 131242, 161746, 192250 |
| 2211 | ABX58272 | 2211 | 32715 | 63219, 93723, 124227, 154731, 185235 | 9227 | AFN17873 | 9227 | 39731 | 70235, 100739, 131243, 161747, 192251 |
| 2212 | ABX58283 | 2212 | 32716 | 63220, 93724, 124228, 154732, 185236 | 9228 | AFN17883 | 9228 | 39732 | 70236, 100740, 131244, 161748, 192252 |
| 2213 | ABX58294 | 2213 | 32717 | 63221, 93725, 124229, 154733, 185237 | 9229 | AFN17893 | 9229 | 39733 | 70237, 100741, 131245, 161749, 192253 |
| 2214 | ABX58316 | 2214 | 32718 | 63222, 93726, 124230, 154734, 185238 | 9230 | AFN17903 | 9230 | 39734 | 70238, 100742, 131246, 161750, 192254 |
| 2215 | ABX58327 | 2215 | 32719 | 63223, 93727, 124231, 154735, 185239 | 9231 | AFN17919 | 9231 | 39735 | 70239, 100743, 131247, 161751, 192255 |
| 2216 | ABX58338 | 2216 | 32720 | 63224, 93728, 124232, 154736, 185240 | 9232 | AFN17929 | 9232 | 39736 | 70240, 100744, 131248, 161752, 192256 |
| 2217 | ABX58360 | 2217 | 32721 | 63225, 93729, 124233, 154737, 185241 | 9233 | AFN17939 | 9233 | 39737 | 70241, 100745, 131249, 161753, 192257 |
| 2218 | ABX58371 | 2218 | 32722 | 63226, 93730, 124234, 154738, 185242 | 9234 | AFN17949 | 9234 | 39738 | 70242, 100746, 131250, 161754, 192258 |
| 2219 | ABX58382 | 2219 | 32723 | 63227, 93731, 124235, 154739, 185243 | 9235 | AFN17959 | 9235 | 39739 | 70243, 100747, 131251, 161755, 192259 |
| 2220 | ABX58393 | 2220 | 32724 | 63228, 93732, 124236, 154740, 185244 | 9236 | AFN17969 | 9236 | 39740 | 70244, 100748, 131252, 161756, 192260 |
| 2221 | ABX58404 | 2221 | 32725 | 63229, 93733, 124237, 154741, 185245 | 9237 | AFN17979 | 9237 | 39741 | 70245, 100749, 131253, 161757, 192261 |
| 2222 | ABX58415 | 2222 | 32726 | 63230, 93734, 124238, 154742, 185246 | 9238 | AFN17989 | 9238 | 39742 | 70246, 100750, 131254, 161758, 192262 |
| 2223 | ABX58426 | 2223 | 32727 | 63231, 93735, 124239, 154743, 185247 | 9239 | AFN17999 | 9239 | 39743 | 70247, 100751, 131255, 161759, 192263 |
| 2224 | ABX58437 | 2224 | 32728 | 63232, 93736, 124240, 154744, 185248 | 9240 | AFN18019 | 9240 | 39744 | 70248, 100752, 131256, 161760, 192264 |
| 2225 | ABX58448 | 2225 | 32729 | 63233, 93737, 124241, 154745, 185249 | 9241 | AFN18039 | 9241 | 39745 | 70249, 100753, 131257, 161761, 192265 |

FIG. 1 continued

| | | | | | | | | | |
|---|---|---|---|---|---|---|---|---|---|
| 2226 | ABX58459 | 2226 | 32730 | 63234, 93738, 124242, 154746, 185250 | 9242 | AFN18049 | 9242 | 39746 | 70250, 100754, 131258, 161762, 192266 |
| 2227 | ABX58470 | 2227 | 32731 | 63235, 93739, 124243, 154747, 185251 | 9243 | AFN18059 | 9243 | 39747 | 70251, 100755, 131259, 161763, 192267 |
| 2228 | ABX58481 | 2228 | 32732 | 63236, 93740, 124244, 154748, 185252 | 9244 | AFN18078 | 9244 | 39748 | 70252, 100756, 131260, 161764, 192268 |
| 2229 | ABX58492 | 2229 | 32733 | 63237, 93741, 124245, 154749, 185253 | 9245 | AFN18088 | 9245 | 39749 | 70253, 100757, 131261, 161765, 192269 |
| 2230 | ABX58503 | 2230 | 32734 | 63238, 93742, 124246, 154750, 185254 | 9246 | AFN18098 | 9246 | 39750 | 70254, 100758, 131262, 161766, 192270 |
| 2231 | ABX58525 | 2231 | 32735 | 63239, 93743, 124247, 154751, 185255 | 9247 | AFN18105 | 9247 | 39751 | 70255, 100759, 131263, 161767, 192271 |
| 2232 | ABX58536 | 2232 | 32736 | 63240, 93744, 124248, 154752, 185256 | 9248 | AFN18107 | 9248 | 39752 | 70256, 100760, 131264, 161768, 192272 |
| 2233 | ABX58547 | 2233 | 32737 | 63241, 93745, 124249, 154753, 185257 | 9249 | AFN18117 | 9249 | 39753 | 70257, 100761, 131265, 161769, 192273 |
| 2234 | ABX58558 | 2234 | 32738 | 63242, 93746, 124250, 154754, 185258 | 9250 | AFN18119 | 9250 | 39754 | 70258, 100762, 131266, 161770, 192274 |
| 2235 | ABX58569 | 2235 | 32739 | 63243, 93747, 124251, 154755, 185259 | 9251 | AFN18121 | 9251 | 39755 | 70259, 100763, 131267, 161771, 192275 |
| 2236 | ABX58580 | 2236 | 32740 | 63244, 93748, 124252, 154756, 185260 | 9252 | AFN18133 | 9252 | 39756 | 70260, 100764, 131268, 161772, 192276 |
| 2237 | ABX58591 | 2237 | 32741 | 63245, 93749, 124253, 154757, 185261 | 9253 | AFN18135 | 9253 | 39757 | 70261, 100765, 131269, 161773, 192277 |
| 2238 | ABX58602 | 2238 | 32742 | 63246, 93750, 124254, 154758, 185262 | 9254 | AFN18137 | 9254 | 39758 | 70262, 100766, 131270, 161774, 192278 |
| 2239 | ABX58613 | 2239 | 32743 | 63247, 93751, 124255, 154759, 185263 | 9255 | AFN18139 | 9255 | 39759 | 70263, 100767, 131271, 161775, 192279 |
| 2240 | ABX58624 | 2240 | 32744 | 63248, 93752, 124256, 154760, 185264 | 9256 | AFN18141 | 9256 | 39760 | 70264, 100768, 131272, 161776, 192280 |
| 2241 | ABX58635 | 2241 | 32745 | 63249, 93753, 124257, 154761, 185265 | 9257 | AFN18148 | 9257 | 39761 | 70265, 100769, 131273, 161777, 192281 |
| 2242 | ABX58679 | 2242 | 32746 | 63250, 93754, 124258, 154762, 185266 | 9258 | AFN18155 | 9258 | 39762 | 70266, 100770, 131274, 161778, 192282 |
| 2243 | ABX58701 | 2243 | 32747 | 63251, 93755, 124259, 154763, 185267 | 9259 | AFN18157 | 9259 | 39763 | 70267, 100771, 131275, 161779, 192283 |

FIG. 1 continued

| | | | | | | | | | |
|---|---|---|---|---|---|---|---|---|---|
| 2244 | ABX58712 | 2244 | 32748 | 63252, 93756, 124260, 154764, 185268 | 9260 | AFN18159 | 9260 | 39764 | 70268, 100772, 131276, 161780, 192284 |
| 2245 | ABY19417 | 2245 | 32749 | 63253, 93757, 124261, 154765, 185269 | 9261 | AFN18164 | 9261 | 39765 | 70269, 100773, 131277, 161781, 192285 |
| 2246 | ABY19418 | 2246 | 32750 | 63254, 93758, 124262, 154766, 185270 | 9262 | AFN18171 | 9262 | 39766 | 70270, 100774, 131278, 161782, 192286 |
| 2247 | ABY19419 | 2247 | 32751 | 63255, 93759, 124263, 154767, 185271 | 9263 | AFN18176 | 9263 | 39767 | 70271, 100775, 131279, 161783, 192287 |
| 2248 | ABY51017 | 2248 | 32752 | 63256, 93760, 124264, 154768, 185272 | 9264 | AFN18183 | 9264 | 39768 | 70272, 100776, 131280, 161784, 192288 |
| 2249 | ABY51028 | 2249 | 32753 | 63257, 93761, 124265, 154769, 185273 | 9265 | AFN18195 | 9265 | 39769 | 70273, 100777, 131281, 161785, 192289 |
| 2250 | ABY51039 | 2250 | 32754 | 63258, 93762, 124266, 154770, 185274 | 9266 | AFN18200 | 9266 | 39770 | 70274, 100778, 131282, 161786, 192290 |
| 2251 | ABY51050 | 2251 | 32755 | 63259, 93763, 124267, 154771, 185275 | 9267 | AFN18207 | 9267 | 39771 | 70275, 100779, 131283, 161787, 192291 |
| 2252 | ABY51061 | 2252 | 32756 | 63260, 93764, 124268, 154772, 185276 | 9268 | AFN18214 | 9268 | 39772 | 70276, 100780, 131284, 161788, 192292 |
| 2253 | ABY51072 | 2253 | 32757 | 63261, 93765, 124269, 154773, 185277 | 9269 | AFN18224 | 9269 | 39773 | 70277, 100781, 131285, 161789, 192293 |
| 2254 | ABY51083 | 2254 | 32758 | 63262, 93766, 124270, 154774, 185278 | 9270 | AFN18231 | 9270 | 39774 | 70278, 100782, 131286, 161790, 192294 |
| 2255 | ABY51094 | 2255 | 32759 | 63263, 93767, 124271, 154775, 185279 | 9271 | AFN18233 | 9271 | 39775 | 70279, 100783, 131287, 161791, 192295 |
| 2256 | ABY51105 | 2256 | 32760 | 63264, 93768, 124272, 154776, 185280 | 9272 | AFN18243 | 9272 | 39776 | 70280, 100784, 131288, 161792, 192296 |
| 2257 | ABY51116 | 2257 | 32761 | 63265, 93769, 124273, 154777, 185281 | 9273 | AFN18245 | 9273 | 39777 | 70281, 100785, 131289, 161793, 192297 |
| 2258 | ABY51127 | 2258 | 32762 | 63266, 93770, 124274, 154778, 185282 | 9274 | AFN18255 | 9274 | 39778 | 70282, 100786, 131290, 161794, 192298 |
| 2259 | ABY51138 | 2259 | 32763 | 63267, 93771, 124275, 154779, 185283 | 9275 | AFN18260 | 9275 | 39779 | 70283, 100787, 131291, 161795, 192299 |
| 2260 | ABY51149 | 2260 | 32764 | 63268, 93772, 124276, 154780, 185284 | 9276 | AFN18267 | 9276 | 39780 | 70284, 100788, 131292, 161796, 192300 |
| 2261 | ABY51160 | 2261 | 32765 | 63269, 93773, 124277, 154781, 185285 | 9277 | AFN18269 | 9277 | 39781 | 70285, 100789, 131293, 161797, 192301 |

FIG. 1 continued

| | | | | | | | | | |
|---|---|---|---|---|---|---|---|---|---|
| 2262 | ABY51171 | 2262 | 32766 | 63270, 93774, 124278, 154782, 185286 | 9278 | AFN18271 | 9278 | 39782 | 70286, 100790, 131294, 161798, 192302 |
| 2263 | ABY51182 | 2263 | 32767 | 63271, 93775, 124279, 154783, 185287 | 9279 | AFN18273 | 9279 | 39783 | 70287, 100791, 131295, 161799, 192303 |
| 2264 | ABY51193 | 2264 | 32768 | 63272, 93776, 124280, 154784, 185288 | 9280 | AFN18280 | 9280 | 39784 | 70288, 100792, 131296, 161800, 192304 |
| 2265 | ABY51237 | 2265 | 32769 | 63273, 93777, 124281, 154785, 185289 | 9281 | AFN18303 | 9281 | 39785 | 70289, 100793, 131297, 161801, 192305 |
| 2266 | ABY51248 | 2266 | 32770 | 63274, 93778, 124282, 154786, 185290 | 9282 | AFN18305 | 9282 | 39786 | 70290, 100794, 131298, 161802, 192306 |
| 2267 | ABY51259 | 2267 | 32771 | 63275, 93779, 124283, 154787, 185291 | 9283 | AFN18307 | 9283 | 39787 | 70291, 100795, 131299, 161803, 192307 |
| 2268 | ABY51270 | 2268 | 32772 | 63276, 93780, 124284, 154788, 185292 | 9284 | AFN18312 | 9284 | 39788 | 70292, 100796, 131300, 161804, 192308 |
| 2269 | ABY76282 | 2269 | 32773 | 63277, 93781, 124285, 154789, 185293 | 9285 | AFN18319 | 9285 | 39789 | 70293, 100797, 131301, 161805, 192309 |
| 2270 | ABY81349 | 2270 | 32774 | 63278, 93782, 124286, 154790, 185294 | 9286 | AFN18324 | 9286 | 39790 | 70294, 100798, 131302, 161806, 192310 |
| 2271 | ABY81371 | 2271 | 32775 | 63279, 93783, 124287, 154791, 185295 | 9287 | AFN18334 | 9287 | 39791 | 70295, 100799, 131303, 161807, 192311 |
| 2272 | ABY81382 | 2272 | 32776 | 63280, 93784, 124288, 154792, 185296 | 9288 | AFN18344 | 9288 | 39792 | 70296, 100800, 131304, 161808, 192312 |
| 2273 | ABY81393 | 2273 | 32777 | 63281, 93785, 124289, 154793, 185297 | 9289 | AFN18354 | 9289 | 39793 | 70297, 100801, 131305, 161809, 192313 |
| 2274 | ABY81415 | 2274 | 32778 | 63282, 93786, 124290, 154794, 185298 | 9290 | AFN18364 | 9290 | 39794 | 70298, 100802, 131306, 161810, 192314 |
| 2275 | ACA24502 | 2275 | 32779 | 63283, 93787, 124291, 154795, 185299 | 9291 | AFN18374 | 9291 | 39795 | 70299, 100803, 131307, 161811, 192315 |
| 2276 | ACA24513 | 2276 | 32780 | 63284, 93788, 124292, 154796, 185300 | 9292 | AFN18381 | 9292 | 39796 | 70300, 100804, 131308, 161812, 192316 |
| 2277 | ACA24524 | 2277 | 32781 | 63285, 93789, 124293, 154797, 185301 | 9293 | AFN18390 | 9293 | 39797 | 70301, 100805, 131309, 161813, 192317 |
| 2278 | ACA24689 | 2278 | 32782 | 63286, 93790, 124294, 154798, 185302 | 9294 | AFN18400 | 9294 | 39798 | 70302, 100806, 131310, 161814, 192318 |
| 2279 | ACA24700 | 2279 | 32783 | 63287, 93791, 124295, 154799, 185303 | 9295 | AFN18410 | 9295 | 39799 | 70303, 100807, 131311, 161815, 192319 |

FIG. 1 continued

| | | | | | | | | | |
|---|---|---|---|---|---|---|---|---|---|
| 2280 | ACA28846 | 2280 | 32784 | 63288, 93792, 124296, 154800, 185304 | 9296 | AFN18420 | 9296 | 39800 | 70304, 100808, 131312, 161816, 192320 |
| 2281 | ACA33749 | 2281 | 32785 | 63289, 93793, 124297, 154801, 185305 | 9297 | AFN18430 | 9297 | 39801 | 70305, 100809, 131313, 161817, 192321 |
| 2282 | ACA96519 | 2282 | 32786 | 63290, 93794, 124298, 154802, 185306 | 9298 | AFN18440 | 9298 | 39802 | 70306, 100810, 131314, 161818, 192322 |
| 2283 | ACC55270 | 2283 | 32787 | 63291, 93795, 124299, 154803, 185307 | 9299 | AFN18450 | 9299 | 39803 | 70307, 100811, 131315, 161819, 192323 |
| 2284 | ACC61964 | 2284 | 32788 | 63292, 93796, 124300, 154804, 185308 | 9300 | AFN18460 | 9300 | 39804 | 70308, 100812, 131316, 161820, 192324 |
| 2285 | ACC61975 | 2285 | 32789 | 63293, 93797, 124301, 154805, 185309 | 9301 | AFN18470 | 9301 | 39805 | 70309, 100813, 131317, 161821, 192325 |
| 2286 | ACC61986 | 2286 | 32790 | 63294, 93798, 124302, 154806, 185310 | 9302 | AFN18480 | 9302 | 39806 | 70310, 100814, 131318, 161822, 192326 |
| 2287 | ACD37430 | 2287 | 32791 | 63295, 93799, 124303, 154807, 185311 | 9303 | AFN18490 | 9303 | 39807 | 70311, 100815, 131319, 161823, 192327 |
| 2288 | ACD37507 | 2288 | 32792 | 63296, 93800, 124304, 154808, 185312 | 9304 | AFN18497 | 9304 | 39808 | 70312, 100816, 131320, 161824, 192328 |
| 2289 | ACD56113 | 2289 | 32793 | 63297, 93801, 124305, 154809, 185313 | 9305 | AFN18512 | 9305 | 39809 | 70313, 100817, 131321, 161825, 192329 |
| 2290 | ACD56124 | 2290 | 32794 | 63298, 93802, 124306, 154810, 185314 | 9306 | AFN18519 | 9306 | 39810 | 70314, 100818, 131322, 161826, 192330 |
| 2291 | ACD56258 | 2291 | 32795 | 63299, 93803, 124307, 154811, 185315 | 9307 | AFN18521 | 9307 | 39811 | 70315, 100819, 131323, 161827, 192331 |
| 2292 | ACD56269 | 2292 | 32796 | 63300, 93804, 124308, 154812, 185316 | 9308 | AFN18528 | 9308 | 39812 | 70316, 100820, 131324, 161828, 192332 |
| 2293 | ACD56280 | 2293 | 32797 | 63301, 93805, 124309, 154813, 185317 | 9309 | AFN18531 | 9309 | 39813 | 70317, 100821, 131325, 161829, 192333 |
| 2294 | ACD56324 | 2294 | 32798 | 63302, 93806, 124310, 154814, 185318 | 9310 | AFN18543 | 9310 | 39814 | 70318, 100822, 131326, 161830, 192334 |
| 2295 | ACD85187 | 2295 | 32799 | 63303, 93807, 124311, 154815, 185319 | 9311 | AFN18545 | 9311 | 39815 | 70319, 100823, 131327, 161831, 192335 |
| 2296 | ACD85198 | 2296 | 32800 | 63304, 93808, 124312, 154816, 185320 | 9312 | AFN18550 | 9312 | 39816 | 70320, 100824, 131328, 161832, 192336 |
| 2297 | ACD85209 | 2297 | 32801 | 63305, 93809, 124313, 154817, 185321 | 9313 | AFN18557 | 9313 | 39817 | 70321, 100825, 131329, 161833, 192337 |

FIG. 1 continued

| | | | | | | | | | |
|---|---|---|---|---|---|---|---|---|---|
| 2298 | ACD85220 | 2298 | 32802 | 63306, 93810, 124314, 154818, 185322 | 9314 | AFN18559 | 9314 | 39818 | 70322, 100826, 131330, 161834, 192338 |
| 2299 | ACD85242 | 2299 | 32803 | 63307, 93811, 124315, 154819, 185323 | 9315 | AFN18561 | 9315 | 39819 | 70323, 100827, 131331, 161835, 192339 |
| 2300 | ACD85253 | 2300 | 32804 | 63308, 93812, 124316, 154820, 185324 | 9316 | AFN18563 | 9316 | 39820 | 70324, 100828, 131332, 161836, 192340 |
| 2301 | ACD85440 | 2301 | 32805 | 63309, 93813, 124317, 154821, 185325 | 9317 | AFN18565 | 9317 | 39821 | 70325, 100829, 131333, 161837, 192341 |
| 2302 | ACD85451 | 2302 | 32806 | 63310, 93814, 124318, 154822, 185326 | 9318 | AFN18570 | 9318 | 39822 | 70326, 100830, 131334, 161838, 192342 |
| 2303 | ACD85462 | 2303 | 32807 | 63311, 93815, 124319, 154823, 185327 | 9319 | AFN18580 | 9319 | 39823 | 70327, 100831, 131335, 161839, 192343 |
| 2304 | ACD85473 | 2304 | 32808 | 63312, 93816, 124320, 154824, 185328 | 9320 | AFN18590 | 9320 | 39824 | 70328, 100832, 131336, 161840, 192344 |
| 2305 | ACD85484 | 2305 | 32809 | 63313, 93817, 124321, 154825, 185329 | 9321 | AFN18600 | 9321 | 39825 | 70329, 100833, 131337, 161841, 192345 |
| 2306 | ACD85495 | 2306 | 32810 | 63314, 93818, 124322, 154826, 185330 | 9322 | AFN18610 | 9322 | 39826 | 70330, 100834, 131338, 161842, 192346 |
| 2307 | ACD85528 | 2307 | 32811 | 63315, 93819, 124323, 154827, 185331 | 9323 | AFN18617 | 9323 | 39827 | 70331, 100835, 131339, 161843, 192347 |
| 2308 | ACD85539 | 2308 | 32812 | 63316, 93820, 124324, 154828, 185332 | 9324 | AFN18622 | 9324 | 39828 | 70332, 100836, 131340, 161844, 192348 |
| 2309 | ACD85550 | 2309 | 32813 | 63317, 93821, 124325, 154829, 185333 | 9325 | AFN18629 | 9325 | 39829 | 70333, 100837, 131341, 161845, 192349 |
| 2310 | ACD85561 | 2310 | 32814 | 63318, 93822, 124326, 154830, 185334 | 9326 | AFN18634 | 9326 | 39830 | 70334, 100838, 131342, 161846, 192350 |
| 2311 | ACD85572 | 2311 | 32815 | 63319, 93823, 124327, 154831, 185335 | 9327 | AFN18644 | 9327 | 39831 | 70335, 100839, 131343, 161847, 192351 |
| 2312 | ACD85583 | 2312 | 32816 | 63320, 93824, 124328, 154832, 185336 | 9328 | AFN18654 | 9328 | 39832 | 70336, 100840, 131344, 161848, 192352 |
| 2313 | ACD93579 | 2313 | 32817 | 63321, 93825, 124329, 154833, 185337 | 9329 | AFN18664 | 9329 | 39833 | 70337, 100841, 131345, 161849, 192353 |
| 2314 | ACF09402 | 2314 | 32818 | 63322, 93826, 124330, 154834, 185338 | 9330 | AFN18674 | 9330 | 39834 | 70338, 100842, 131346, 161850, 192354 |
| 2315 | ACF22159 | 2315 | 32819 | 63323, 93827, 124331, 154835, 185339 | 9331 | AFN18684 | 9331 | 39835 | 70339, 100843, 131347, 161851, 192355 |

FIG. 1 continued

| | | | | | | | | | |
|---|---|---|---|---|---|---|---|---|---|
| 2316 | ACF22188 | 2316 | 32820 | 63324, 93828, 124332, 154836, 185340 | 9332 | AFN18694 | 9332 | 39836 | 70340, 100844, 131348, 161852, 192356 |
| 2317 | ACF22199 | 2317 | 32821 | 63325, 93829, 124333, 154837, 185341 | 9333 | AFN18704 | 9333 | 39837 | 70341, 100845, 131349, 161853, 192357 |
| 2318 | ACF22210 | 2318 | 32822 | 63326, 93830, 124334, 154838, 185342 | 9334 | AFN18714 | 9334 | 39838 | 70342, 100846, 131350, 161854, 192358 |
| 2319 | ACF22221 | 2319 | 32823 | 63327, 93831, 124335, 154839, 185343 | 9335 | AFN18721 | 9335 | 39839 | 70343, 100847, 131351, 161855, 192359 |
| 2320 | ACF22232 | 2320 | 32824 | 63328, 93832, 124336, 154840, 185344 | 9336 | AFN18725 | 9336 | 39840 | 70344, 100848, 131352, 161856, 192360 |
| 2321 | ACF22243 | 2321 | 32825 | 63329, 93833, 124337, 154841, 185345 | 9337 | AFN18735 | 9337 | 39841 | 70345, 100849, 131353, 161857, 192361 |
| 2322 | ACF22254 | 2322 | 32826 | 63330, 93834, 124338, 154842, 185346 | 9338 | AFN18742 | 9338 | 39842 | 70346, 100850, 131354, 161858, 192362 |
| 2323 | ACF22265 | 2323 | 32827 | 63331, 93835, 124339, 154843, 185347 | 9339 | AFN18747 | 9339 | 39843 | 70347, 100851, 131355, 161859, 192363 |
| 2324 | ACF22276 | 2324 | 32828 | 63332, 93836, 124340, 154844, 185348 | 9340 | AFN18757 | 9340 | 39844 | 70348, 100852, 131356, 161860, 192364 |
| 2325 | ACF22287 | 2325 | 32829 | 63333, 93837, 124341, 154845, 185349 | 9341 | AFN18767 | 9341 | 39845 | 70349, 100853, 131357, 161861, 192365 |
| 2326 | ACF22298 | 2326 | 32830 | 63334, 93838, 124342, 154846, 185350 | 9342 | AFN18774 | 9342 | 39846 | 70350, 100854, 131358, 161862, 192366 |
| 2327 | ACF22320 | 2327 | 32831 | 63335, 93839, 124343, 154847, 185351 | 9343 | AFN18776 | 9343 | 39847 | 70351, 100855, 131359, 161863, 192367 |
| 2328 | ACF22342 | 2328 | 32832 | 63336, 93840, 124344, 154848, 185352 | 9344 | AFN18778 | 9344 | 39848 | 70352, 100856, 131360, 161864, 192368 |
| 2329 | ACF22364 | 2329 | 32833 | 63337, 93841, 124345, 154849, 185353 | 9345 | AFN18784 | 9345 | 39849 | 70353, 100857, 131361, 161865, 192369 |
| 2330 | ACF22408 | 2330 | 32834 | 63338, 93842, 124346, 154850, 185354 | 9346 | AFN18789 | 9346 | 39850 | 70354, 100858, 131362, 161866, 192370 |
| 2331 | ACF41669 | 2331 | 32835 | 63339, 93843, 124347, 154851, 185355 | 9347 | AFN18799 | 9347 | 39851 | 70355, 100859, 131363, 161867, 192371 |
| 2332 | ACF41680 | 2332 | 32836 | 63340, 93844, 124348, 154852, 185356 | 9348 | AFN18809 | 9348 | 39852 | 70356, 100860, 131364, 161868, 192372 |
| 2333 | ACF41691 | 2333 | 32837 | 63341, 93845, 124349, 154853, 185357 | 9349 | AFN18816 | 9349 | 39853 | 70357, 100861, 131365, 161869, 192373 |

FIG. 1 continued

| | | | | | | | | | |
|---|---|---|---|---|---|---|---|---|---|
| 2334 | ACF41735 | 2334 | 32838 | 63342, 93846, 124350, 154854, 185358 | 9350 | AFN18818 | 9350 | 39854 | 70358, 100862, 131366, 161870, 192374 |
| 2335 | ACF41790 | 2335 | 32839 | 63343, 93847, 124351, 154855, 185359 | 9351 | AFN18820 | 9351 | 39855 | 70359, 100863, 131367, 161871, 192375 |
| 2336 | ACF41823 | 2336 | 32840 | 63344, 93848, 124352, 154856, 185360 | 9352 | AFN18822 | 9352 | 39856 | 70360, 100864, 131368, 161872, 192376 |
| 2337 | ACF41834 | 2337 | 32841 | 63345, 93849, 124353, 154857, 185361 | 9353 | AFN18824 | 9353 | 39857 | 70361, 100865, 131369, 161873, 192377 |
| 2338 | ACF41856 | 2338 | 32842 | 63346, 93850, 124354, 154858, 185362 | 9354 | AFN18826 | 9354 | 39858 | 70362, 100866, 131370, 161874, 192378 |
| 2339 | ACF41867 | 2339 | 32843 | 63347, 93851, 124355, 154859, 185363 | 9355 | AFN18828 | 9355 | 39859 | 70363, 100867, 131371, 161875, 192379 |
| 2340 | ACF41878 | 2340 | 32844 | 63348, 93852, 124356, 154860, 185364 | 9356 | AFN18830 | 9356 | 39860 | 70364, 100868, 131372, 161876, 192380 |
| 2341 | ACF41922 | 2341 | 32845 | 63349, 93853, 124357, 154861, 185365 | 9357 | AFN18832 | 9357 | 39861 | 70365, 100869, 131373, 161877, 192381 |
| 2342 | ACF54389 | 2342 | 32846 | 63350, 93854, 124358, 154862, 185366 | 9358 | AFN18834 | 9358 | 39862 | 70366, 100870, 131374, 161878, 192382 |
| 2343 | ACF54400 | 2343 | 32847 | 63351, 93855, 124359, 154863, 185367 | 9359 | AFN18849 | 9359 | 39863 | 70367, 100871, 131375, 161879, 192383 |
| 2344 | ACF54411 | 2344 | 32848 | 63352, 93856, 124360, 154864, 185368 | 9360 | AFN18856 | 9360 | 39864 | 70368, 100872, 131376, 161880, 192384 |
| 2345 | ACF54422 | 2345 | 32849 | 63353, 93857, 124361, 154865, 185369 | 9361 | AFN18858 | 9361 | 39865 | 70369, 100873, 131377, 161881, 192385 |
| 2346 | ACF54433 | 2346 | 32850 | 63354, 93858, 124362, 154866, 185370 | 9362 | AFN18860 | 9362 | 39866 | 70370, 100874, 131378, 161882, 192386 |
| 2347 | ACF54444 | 2347 | 32851 | 63355, 93859, 124363, 154867, 185371 | 9363 | AFN18865 | 9363 | 39867 | 70371, 100875, 131379, 161883, 192387 |
| 2348 | ACF54466 | 2348 | 32852 | 63356, 93860, 124364, 154868, 185372 | 9364 | AFN18875 | 9364 | 39868 | 70372, 100876, 131380, 161884, 192388 |
| 2349 | ACF54477 | 2349 | 32853 | 63357, 93861, 124365, 154869, 185373 | 9365 | AFN18885 | 9365 | 39869 | 70373, 100877, 131381, 161885, 192389 |
| 2350 | ACF54499 | 2350 | 32854 | 63358, 93862, 124366, 154870, 185374 | 9366 | AFN18892 | 9366 | 39870 | 70374, 100878, 131382, 161886, 192390 |
| 2351 | ACF54510 | 2351 | 32855 | 63359, 93863, 124367, 154871, 185375 | 9367 | AFN18894 | 9367 | 39871 | 70375, 100879, 131383, 161887, 192391 |

FIG. 1 continued

| | | | | | | | | | |
|---|---|---|---|---|---|---|---|---|---|
| 2352 | ACF54521 | 2352 | 32856 | 63360, 93864, 124368, 154872, 185376 | 9368 | AFN18903 | 9368 | 39872 | 70376, 100880, 131384, 161888, 192392 |
| 2353 | ACF54532 | 2353 | 32857 | 63361, 93865, 124369, 154873, 185377 | 9369 | AFN18910 | 9369 | 39873 | 70377, 100881, 131385, 161889, 192393 |
| 2354 | ACF54543 | 2354 | 32858 | 63362, 93866, 124370, 154874, 185378 | 9370 | AFN18912 | 9370 | 39874 | 70378, 100882, 131386, 161890, 192394 |
| 2355 | ACF54565 | 2355 | 32859 | 63363, 93867, 124371, 154875, 185379 | 9371 | AFN18917 | 9371 | 39875 | 70379, 100883, 131387, 161891, 192395 |
| 2356 | ACF54576 | 2356 | 32860 | 63364, 93868, 124372, 154876, 185380 | 9372 | AFN18927 | 9372 | 39876 | 70380, 100884, 131388, 161892, 192396 |
| 2357 | ACF54598 | 2357 | 32861 | 63365, 93869, 124373, 154877, 185381 | 9373 | AFN18937 | 9373 | 39877 | 70381, 100885, 131389, 161893, 192397 |
| 2358 | ACG50699 | 2358 | 32862 | 63366, 93870, 124374, 154878, 185382 | 9374 | AFN18952 | 9374 | 39878 | 70382, 100886, 131390, 161894, 192398 |
| 2359 | ACG70142 | 2359 | 32863 | 63367, 93871, 124375, 154879, 185383 | 9375 | AFN18957 | 9375 | 39879 | 70383, 100887, 131391, 161895, 192399 |
| 2360 | ACG70153 | 2360 | 32864 | 63368, 93872, 124376, 154880, 185384 | 9376 | AFN18964 | 9376 | 39880 | 70384, 100888, 131392, 161896, 192400 |
| 2361 | ACG80410 | 2361 | 32865 | 63369, 93873, 124377, 154881, 185385 | 9377 | AFN18974 | 9377 | 39881 | 70385, 100889, 131393, 161897, 192401 |
| 2362 | ACG80420 | 2362 | 32866 | 63370, 93874, 124378, 154882, 185386 | 9378 | AFN18979 | 9378 | 39882 | 70386, 100890, 131394, 161898, 192402 |
| 2363 | ACG80426 | 2363 | 32867 | 63371, 93875, 124379, 154883, 185387 | 9379 | AFN18982 | 9379 | 39883 | 70387, 100891, 131395, 161899, 192403 |
| 2364 | ACG80430 | 2364 | 32868 | 63372, 93876, 124380, 154884, 185388 | 9380 | AFN18984 | 9380 | 39884 | 70388, 100892, 131396, 161900, 192404 |
| 2365 | ACG80436 | 2365 | 32869 | 63373, 93877, 124381, 154885, 185389 | 9381 | AFN18986 | 9381 | 39885 | 70389, 100893, 131397, 161901, 192405 |
| 2366 | ACG80445 | 2366 | 32870 | 63374, 93878, 124382, 154886, 185390 | 9382 | AFN18988 | 9382 | 39886 | 70390, 100894, 131398, 161902, 192406 |
| 2367 | ACG80454 | 2367 | 32871 | 63375, 93879, 124383, 154887, 185391 | 9383 | AFN18993 | 9383 | 39887 | 70391, 100895, 131399, 161903, 192407 |
| 2368 | ACG80463 | 2368 | 32872 | 63376, 93880, 124384, 154888, 185392 | 9384 | AFN18999 | 9384 | 39888 | 70392, 100896, 131400, 161904, 192408 |
| 2369 | ACG80472 | 2369 | 32873 | 63377, 93881, 124385, 154889, 185393 | 9385 | AFN19006 | 9385 | 39889 | 70393, 100897, 131401, 161905, 192409 |

FIG. 1 continued

| | | | | | | | | | |
|---|---|---|---|---|---|---|---|---|---|
| 2370 | ACH69558 | 2370 | 32874 | 63378, 93882, 124386, 154890, 185394 | 9386 | AFN19026 | 9386 | 39890 | 70394, 100898, 131402, 161906, 192410 |
| 2371 | ACH69569 | 2371 | 32875 | 63379, 93883, 124387, 154891, 185395 | 9387 | AFN19036 | 9387 | 39891 | 70395, 100899, 131403, 161907, 192411 |
| 2372 | ACH69580 | 2372 | 32876 | 63380, 93884, 124388, 154892, 185396 | 9388 | AFN19043 | 9388 | 39892 | 70396, 100900, 131404, 161908, 192412 |
| 2373 | ACH69591 | 2373 | 32877 | 63381, 93885, 124389, 154893, 185397 | 9389 | AFN19053 | 9389 | 39893 | 70397, 100901, 131405, 161909, 192413 |
| 2374 | ACH69602 | 2374 | 32878 | 63382, 93886, 124390, 154894, 185398 | 9390 | AFN19063 | 9390 | 39894 | 70398, 100902, 131406, 161910, 192414 |
| 2375 | ACH69613 | 2375 | 32879 | 63383, 93887, 124391, 154895, 185399 | 9391 | AFN19070 | 9391 | 39895 | 70399, 100903, 131407, 161911, 192415 |
| 2376 | ACH82060 | 2376 | 32880 | 63384, 93888, 124392, 154896, 185400 | 9392 | AFN19076 | 9392 | 39896 | 70400, 100904, 131408, 161912, 192416 |
| 2377 | ACI06123 | 2377 | 32881 | 63385, 93889, 124393, 154897, 185401 | 9393 | AFN19082 | 9393 | 39897 | 70401, 100905, 131409, 161913, 192417 |
| 2378 | ACI06126 | 2378 | 32882 | 63386, 93890, 124394, 154898, 185402 | 9394 | AFN19088 | 9394 | 39898 | 70402, 100906, 131410, 161914, 192418 |
| 2379 | ACI06127 | 2379 | 32883 | 63387, 93891, 124395, 154899, 185403 | 9395 | AFN19097 | 9395 | 39899 | 70403, 100907, 131411, 161915, 192419 |
| 2380 | ACI06129 | 2380 | 32884 | 63388, 93892, 124396, 154900, 185404 | 9396 | AFN19104 | 9396 | 39900 | 70404, 100908, 131412, 161916, 192420 |
| 2381 | ACI06130 | 2381 | 32885 | 63389, 93893, 124397, 154901, 185405 | 9397 | AFN19113 | 9397 | 39901 | 70405, 100909, 131413, 161917, 192421 |
| 2382 | ACI06132 | 2382 | 32886 | 63390, 93894, 124398, 154902, 185406 | 9398 | AFN19119 | 9398 | 39902 | 70406, 100910, 131414, 161918, 192422 |
| 2383 | ACI06133 | 2383 | 32887 | 63391, 93895, 124399, 154903, 185407 | 9399 | AFN19125 | 9399 | 39903 | 70407, 100911, 131415, 161919, 192423 |
| 2384 | ACI06134 | 2384 | 32888 | 63392, 93896, 124400, 154904, 185408 | 9400 | AFN19134 | 9400 | 39904 | 70408, 100912, 131416, 161920, 192424 |
| 2385 | ACI06135 | 2385 | 32889 | 63393, 93897, 124401, 154905, 185409 | 9401 | AFN19144 | 9401 | 39905 | 70409, 100913, 131417, 161921, 192425 |
| 2386 | ACI06136 | 2386 | 32890 | 63394, 93898, 124402, 154906, 185410 | 9402 | AFN19154 | 9402 | 39906 | 70410, 100914, 131418, 161922, 192426 |
| 2387 | ACI06137 | 2387 | 32891 | 63395, 93899, 124403, 154907, 185411 | 9403 | AFN19164 | 9403 | 39907 | 70411, 100915, 131419, 161923, 192427 |

FIG. 1 continued

| | | | | | | | | | |
|---|---|---|---|---|---|---|---|---|---|
| 2388 | ACI06138 | 2388 | 32892 | 63396, 93900, 124404, 154908, 185412 | 9404 | AFN19174 | 9404 | 39908 | 70412, 100916, 131420, 161924, 192428 |
| 2389 | ACI06139 | 2389 | 32893 | 63397, 93901, 124405, 154909, 185413 | 9405 | AFN19184 | 9405 | 39909 | 70413, 100917, 131421, 161925, 192429 |
| 2390 | ACI06140 | 2390 | 32894 | 63398, 93902, 124406, 154910, 185414 | 9406 | AFN19194 | 9406 | 39910 | 70414, 100918, 131422, 161926, 192430 |
| 2391 | ACI06141 | 2391 | 32895 | 63399, 93903, 124407, 154911, 185415 | 9407 | AFN19203 | 9407 | 39911 | 70415, 100919, 131423, 161927, 192431 |
| 2392 | ACI06142 | 2392 | 32896 | 63400, 93904, 124408, 154912, 185416 | 9408 | AFN19213 | 9408 | 39912 | 70416, 100920, 131424, 161928, 192432 |
| 2393 | ACI06143 | 2393 | 32897 | 63401, 93905, 124409, 154913, 185417 | 9409 | AFN19223 | 9409 | 39913 | 70417, 100921, 131425, 161929, 192433 |
| 2394 | ACI06144 | 2394 | 32898 | 63402, 93906, 124410, 154914, 185418 | 9410 | AFN19233 | 9410 | 39914 | 70418, 100922, 131426, 161930, 192434 |
| 2395 | ACI06145 | 2395 | 32899 | 63403, 93907, 124411, 154915, 185419 | 9411 | AFN19243 | 9411 | 39915 | 70419, 100923, 131427, 161931, 192435 |
| 2396 | ACI06146 | 2396 | 32900 | 63404, 93908, 124412, 154916, 185420 | 9412 | AFN19250 | 9412 | 39916 | 70420, 100924, 131428, 161932, 192436 |
| 2397 | ACI06147 | 2397 | 32901 | 63405, 93909, 124413, 154917, 185421 | 9413 | AFN19259 | 9413 | 39917 | 70421, 100925, 131429, 161933, 192437 |
| 2398 | ACI06148 | 2398 | 32902 | 63406, 93910, 124414, 154918, 185422 | 9414 | AFN19269 | 9414 | 39918 | 70422, 100926, 131430, 161934, 192438 |
| 2399 | ACI06149 | 2399 | 32903 | 63407, 93911, 124415, 154919, 185423 | 9415 | AFN19279 | 9415 | 39919 | 70423, 100927, 131431, 161935, 192439 |
| 2400 | ACI06151 | 2400 | 32904 | 63408, 93912, 124416, 154920, 185424 | 9416 | AFN19286 | 9416 | 39920 | 70424, 100928, 131432, 161936, 192440 |
| 2401 | ACI06152 | 2401 | 32905 | 63409, 93913, 124417, 154921, 185425 | 9417 | AFN19295 | 9417 | 39921 | 70425, 100929, 131433, 161937, 192441 |
| 2402 | ACI06153 | 2402 | 32906 | 63410, 93914, 124418, 154922, 185426 | 9418 | AFN19305 | 9418 | 39922 | 70426, 100930, 131434, 161938, 192442 |
| 2403 | ACI06155 | 2403 | 32907 | 63411, 93915, 124419, 154923, 185427 | 9419 | AFN19315 | 9419 | 39923 | 70427, 100931, 131435, 161939, 192443 |
| 2404 | ACI06156 | 2404 | 32908 | 63412, 93916, 124420, 154924, 185428 | 9420 | AFN19325 | 9420 | 39924 | 70428, 100932, 131436, 161940, 192444 |
| 2405 | ACI06157 | 2405 | 32909 | 63413, 93917, 124421, 154925, 185429 | 9421 | AFN19335 | 9421 | 39925 | 70429, 100933, 131437, 161941, 192445 |

FIG. 1 continued

| | | | | | | | | | |
|---|---|---|---|---|---|---|---|---|---|
| 2406 | ACI06158 | 2406 | 32910 | 63414, 93918, 124422, 154926, 185430 | 9422 | AFN19344 | 9422 | 39926 | 70430, 100934, 131438, 161942, 192446 |
| 2407 | ACI06159 | 2407 | 32911 | 63415, 93919, 124423, 154927, 185431 | 9423 | AFN19351 | 9423 | 39927 | 70431, 100935, 131439, 161943, 192447 |
| 2408 | ACI06160 | 2408 | 32912 | 63416, 93920, 124424, 154928, 185432 | 9424 | AFN19355 | 9424 | 39928 | 70432, 100936, 131440, 161944, 192448 |
| 2409 | ACI06161 | 2409 | 32913 | 63417, 93921, 124425, 154929, 185433 | 9425 | AFN19357 | 9425 | 39929 | 70433, 100937, 131441, 161945, 192449 |
| 2410 | ACI06162 | 2410 | 32914 | 63418, 93922, 124426, 154930, 185434 | 9426 | AFN19361 | 9426 | 39930 | 70434, 100938, 131442, 161946, 192450 |
| 2411 | ACI06163 | 2411 | 32915 | 63419, 93923, 124427, 154931, 185435 | 9427 | AFN19363 | 9427 | 39931 | 70435, 100939, 131443, 161947, 192451 |
| 2412 | ACI06164 | 2412 | 32916 | 63420, 93924, 124428, 154932, 185436 | 9428 | AFN19365 | 9428 | 39932 | 70436, 100940, 131444, 161948, 192452 |
| 2413 | ACI06165 | 2413 | 32917 | 63421, 93925, 124429, 154933, 185437 | 9429 | AFN19367 | 9429 | 39933 | 70437, 100941, 131445, 161949, 192453 |
| 2414 | ACI06166 | 2414 | 32918 | 63422, 93926, 124430, 154934, 185438 | 9430 | AFN19369 | 9430 | 39934 | 70438, 100942, 131446, 161950, 192454 |
| 2415 | ACI06167 | 2415 | 32919 | 63423, 93927, 124431, 154935, 185439 | 9431 | AFN19373 | 9431 | 39935 | 70439, 100943, 131447, 161951, 192455 |
| 2416 | ACI06168 | 2416 | 32920 | 63424, 93928, 124432, 154936, 185440 | 9432 | AFN19375 | 9432 | 39936 | 70440, 100944, 131448, 161952, 192456 |
| 2417 | ACI06169 | 2417 | 32921 | 63425, 93929, 124433, 154937, 185441 | 9433 | AFN19377 | 9433 | 39937 | 70441, 100945, 131449, 161953, 192457 |
| 2418 | ACI06171 | 2418 | 32922 | 63426, 93930, 124434, 154938, 185442 | 9434 | AFN19379 | 9434 | 39938 | 70442, 100946, 131450, 161954, 192458 |
| 2419 | ACI06172 | 2419 | 32923 | 63427, 93931, 124435, 154939, 185443 | 9435 | AFN19381 | 9435 | 39939 | 70443, 100947, 131451, 161955, 192459 |
| 2420 | ACI06173 | 2420 | 32924 | 63428, 93932, 124436, 154940, 185444 | 9436 | AFN19383 | 9436 | 39940 | 70444, 100948, 131452, 161956, 192460 |
| 2421 | ACI06174 | 2421 | 32925 | 63429, 93933, 124437, 154941, 185445 | 9437 | AFN19385 | 9437 | 39941 | 70445, 100949, 131453, 161957, 192461 |
| 2422 | ACI06175 | 2422 | 32926 | 63430, 93934, 124438, 154942, 185446 | 9438 | AFN19387 | 9438 | 39942 | 70446, 100950, 131454, 161958, 192462 |
| 2423 | ACI06176 | 2423 | 32927 | 63431, 93935, 124439, 154943, 185447 | 9439 | AFN19389 | 9439 | 39943 | 70447, 100951, 131455, 161959, 192463 |

FIG. 1 continued

| | | | | | | | | | |
|---|---|---|---|---|---|---|---|---|---|
| 2424 | ACI06177 | 2424 | 32928 | 63432, 93936, 124440, 154944, 185448 | 9440 | AFN19391 | 9440 | 39944 | 70448, 100952, 131456, 161960, 192464 |
| 2425 | ACI25724 | 2425 | 32929 | 63433, 93937, 124441, 154945, 185449 | 9441 | AFN19393 | 9441 | 39945 | 70449, 100953, 131457, 161961, 192465 |
| 2426 | ACI25746 | 2426 | 32930 | 63434, 93938, 124442, 154946, 185450 | 9442 | AFN19397 | 9442 | 39946 | 70450, 100954, 131458, 161962, 192466 |
| 2427 | ACI25757 | 2427 | 32931 | 63435, 93939, 124443, 154947, 185451 | 9443 | AFN19399 | 9443 | 39947 | 70451, 100955, 131459, 161963, 192467 |
| 2428 | ACI25768 | 2428 | 32932 | 63436, 93940, 124444, 154948, 185452 | 9444 | AFN19401 | 9444 | 39948 | 70452, 100956, 131460, 161964, 192468 |
| 2429 | ACI25779 | 2429 | 32933 | 63437, 93941, 124445, 154949, 185453 | 9445 | AFN19403 | 9445 | 39949 | 70453, 100957, 131461, 161965, 192469 |
| 2430 | ACI25790 | 2430 | 32934 | 63438, 93942, 124446, 154950, 185454 | 9446 | AFN19405 | 9446 | 39950 | 70454, 100958, 131462, 161966, 192470 |
| 2431 | ACI25801 | 2431 | 32935 | 63439, 93943, 124447, 154951, 185455 | 9447 | AFN19407 | 9447 | 39951 | 70455, 100959, 131463, 161967, 192471 |
| 2432 | ACI26274 | 2432 | 32936 | 63440, 93944, 124448, 154952, 185456 | 9448 | AFN19409 | 9448 | 39952 | 70456, 100960, 131464, 161968, 192472 |
| 2433 | ACI26307 | 2433 | 32937 | 63441, 93945, 124449, 154953, 185457 | 9449 | AFN19411 | 9449 | 39953 | 70457, 100961, 131465, 161969, 192473 |
| 2434 | ACI26362 | 2434 | 32938 | 63442, 93946, 124450, 154954, 185458 | 9450 | AFN19413 | 9450 | 39954 | 70458, 100962, 131466, 161970, 192474 |
| 2435 | ACI26373 | 2435 | 32939 | 63443, 93947, 124451, 154955, 185459 | 9451 | AFN19415 | 9451 | 39955 | 70459, 100963, 131467, 161971, 192475 |
| 2436 | ACI26395 | 2436 | 32940 | 63444, 93948, 124452, 154956, 185460 | 9452 | AFN19417 | 9452 | 39956 | 70460, 100964, 131468, 161972, 192476 |
| 2437 | ACI26406 | 2437 | 32941 | 63445, 93949, 124453, 154957, 185461 | 9453 | AFN19423 | 9453 | 39957 | 70461, 100965, 131469, 161973, 192477 |
| 2438 | ACI26417 | 2438 | 32942 | 63446, 93950, 124454, 154958, 185462 | 9454 | AFN19425 | 9454 | 39958 | 70462, 100966, 131470, 161974, 192478 |
| 2439 | ACI26428 | 2439 | 32943 | 63447, 93951, 124455, 154959, 185463 | 9455 | AFN19437 | 9455 | 39959 | 70463, 100967, 131471, 161975, 192479 |
| 2440 | ACI26439 | 2440 | 32944 | 63448, 93952, 124456, 154960, 185464 | 9456 | AFN19439 | 9456 | 39960 | 70464, 100968, 131472, 161976, 192480 |
| 2441 | ACI26450 | 2441 | 32945 | 63449, 93953, 124457, 154961, 185465 | 9457 | AFN19443 | 9457 | 39961 | 70465, 100969, 131473, 161977, 192481 |

FIG. 1 continued

| | | | | | | | | | |
|---|---|---|---|---|---|---|---|---|---|
| 2442 | ACI26461 | 2442 | 32946 | 63450, 93954, 124458, 154962, 185466 | 9458 | AFN19445 | 9458 | 39962 | 70466, 100970, 131474, 161978, 192482 |
| 2443 | ACI26472 | 2443 | 32947 | 63451, 93955, 124459, 154963, 185467 | 9459 | AFN19447 | 9459 | 39963 | 70467, 100971, 131475, 161979, 192483 |
| 2444 | ACI26483 | 2444 | 32948 | 63452, 93956, 124460, 154964, 185468 | 9460 | AFN19451 | 9460 | 39964 | 70468, 100972, 131476, 161980, 192484 |
| 2445 | ACI26505 | 2445 | 32949 | 63453, 93957, 124461, 154965, 185469 | 9461 | AFN19453 | 9461 | 39965 | 70469, 100973, 131477, 161981, 192485 |
| 2446 | ACI26516 | 2446 | 32950 | 63454, 93958, 124462, 154966, 185470 | 9462 | AFN19455 | 9462 | 39966 | 70470, 100974, 131478, 161982, 192486 |
| 2447 | ACI26527 | 2447 | 32951 | 63455, 93959, 124463, 154967, 185471 | 9463 | AFN19457 | 9463 | 39967 | 70471, 100975, 131479, 161983, 192487 |
| 2448 | ACI26538 | 2448 | 32952 | 63456, 93960, 124464, 154968, 185472 | 9464 | AFN19459 | 9464 | 39968 | 70472, 100976, 131480, 161984, 192488 |
| 2449 | ACI26549 | 2449 | 32953 | 63457, 93961, 124465, 154969, 185473 | 9465 | AFN19461 | 9465 | 39969 | 70473, 100977, 131481, 161985, 192489 |
| 2450 | ACI26560 | 2450 | 32954 | 63458, 93962, 124466, 154970, 185474 | 9466 | AFN19465 | 9466 | 39970 | 70474, 100978, 131482, 161986, 192490 |
| 2451 | ACI26571 | 2451 | 32955 | 63459, 93963, 124467, 154971, 185475 | 9467 | AFN19467 | 9467 | 39971 | 70475, 100979, 131483, 161987, 192491 |
| 2452 | ACI26593 | 2452 | 32956 | 63460, 93964, 124468, 154972, 185476 | 9468 | AFN19469 | 9468 | 39972 | 70476, 100980, 131484, 161988, 192492 |
| 2453 | ACI32715 | 2453 | 32957 | 63461, 93965, 124469, 154973, 185477 | 9469 | AFN19471 | 9469 | 39973 | 70477, 100981, 131485, 161989, 192493 |
| 2454 | ACI32716 | 2454 | 32958 | 63462, 93966, 124470, 154974, 185478 | 9470 | AFN19473 | 9470 | 39974 | 70478, 100982, 131486, 161990, 192494 |
| 2455 | ACI32717 | 2455 | 32959 | 63463, 93967, 124471, 154975, 185479 | 9471 | AFN19475 | 9471 | 39975 | 70479, 100983, 131487, 161991, 192495 |
| 2456 | ACI32718 | 2456 | 32960 | 63464, 93968, 124472, 154976, 185480 | 9472 | AFN19477 | 9472 | 39976 | 70480, 100984, 131488, 161992, 192496 |
| 2457 | ACI32719 | 2457 | 32961 | 63465, 93969, 124473, 154977, 185481 | 9473 | AFN19479 | 9473 | 39977 | 70481, 100985, 131489, 161993, 192497 |
| 2458 | ACI32720 | 2458 | 32962 | 63466, 93970, 124474, 154978, 185482 | 9474 | AFN19483 | 9474 | 39978 | 70482, 100986, 131490, 161994, 192498 |
| 2459 | ACI32721 | 2459 | 32963 | 63467, 93971, 124475, 154979, 185483 | 9475 | AFN19485 | 9475 | 39979 | 70483, 100987, 131491, 161995, 192499 |

FIG. 1 continued

| | | | | | | | | | |
|---|---|---|---|---|---|---|---|---|---|
| 2460 | ACI32722 | 2460 | 32964 | 63468, 93972, 124476, 154980, 185484 | 9476 | AFN19487 | 9476 | 39980 | 70484, 100988, 131492, 161996, 192500 |
| 2461 | ACI32723 | 2461 | 32965 | 63469, 93973, 124477, 154981, 185485 | 9477 | AFN19491 | 9477 | 39981 | 70485, 100989, 131493, 161997, 192501 |
| 2462 | ACI32724 | 2462 | 32966 | 63470, 93974, 124478, 154982, 185486 | 9478 | AFN19493 | 9478 | 39982 | 70486, 100990, 131494, 161998, 192502 |
| 2463 | ACI32725 | 2463 | 32967 | 63471, 93975, 124479, 154983, 185487 | 9479 | AFN19495 | 9479 | 39983 | 70487, 100991, 131495, 161999, 192503 |
| 2464 | ACI32726 | 2464 | 32968 | 63472, 93976, 124480, 154984, 185488 | 9480 | AFN19497 | 9480 | 39984 | 70488, 100992, 131496, 162000, 192504 |
| 2465 | ACI32727 | 2465 | 32969 | 63473, 93977, 124481, 154985, 185489 | 9481 | AFN19499 | 9481 | 39985 | 70489, 100993, 131497, 162001, 192505 |
| 2466 | ACI32729 | 2466 | 32970 | 63474, 93978, 124482, 154986, 185490 | 9482 | AFN19501 | 9482 | 39986 | 70490, 100994, 131498, 162002, 192506 |
| 2467 | ACI32730 | 2467 | 32971 | 63475, 93979, 124483, 154987, 185491 | 9483 | AFN19503 | 9483 | 39987 | 70491, 100995, 131499, 162003, 192507 |
| 2468 | ACI32731 | 2468 | 32972 | 63476, 93980, 124484, 154988, 185492 | 9484 | AFN19507 | 9484 | 39988 | 70492, 100996, 131500, 162004, 192508 |
| 2469 | ACI32732 | 2469 | 32973 | 63477, 93981, 124485, 154989, 185493 | 9485 | AFN19509 | 9485 | 39989 | 70493, 100997, 131501, 162005, 192509 |
| 2470 | ACI32733 | 2470 | 32974 | 63478, 93982, 124486, 154990, 185494 | 9486 | AFN19513 | 9486 | 39990 | 70494, 100998, 131502, 162006, 192510 |
| 2471 | ACI32734 | 2471 | 32975 | 63479, 93983, 124487, 154991, 185495 | 9487 | AFN19515 | 9487 | 39991 | 70495, 100999, 131503, 162007, 192511 |
| 2472 | ACI32736 | 2472 | 32976 | 63480, 93984, 124488, 154992, 185496 | 9488 | AFN19517 | 9488 | 39992 | 70496, 101000, 131504, 162008, 192512 |
| 2473 | ACI32737 | 2473 | 32977 | 63481, 93985, 124489, 154993, 185497 | 9489 | AFN19519 | 9489 | 39993 | 70497, 101001, 131505, 162009, 192513 |
| 2474 | ACI32739 | 2474 | 32978 | 63482, 93986, 124490, 154994, 185498 | 9490 | AFN19521 | 9490 | 39994 | 70498, 101002, 131506, 162010, 192514 |
| 2475 | ACI32740 | 2475 | 32979 | 63483, 93987, 124491, 154995, 185499 | 9491 | AFN19523 | 9491 | 39995 | 70499, 101003, 131507, 162011, 192515 |
| 2476 | ACI32741 | 2476 | 32980 | 63484, 93988, 124492, 154996, 185500 | 9492 | AFN19527 | 9492 | 39996 | 70500, 101004, 131508, 162012, 192516 |
| 2477 | ACI32742 | 2477 | 32981 | 63485, 93989, 124493, 154997, 185501 | 9493 | AFN19529 | 9493 | 39997 | 70501, 101005, 131509, 162013, 192517 |

FIG. 1 continued

| | | | | | | | | | |
|---|---|---|---|---|---|---|---|---|---|
| 2478 | ACI32743 | 2478 | 32982 | 63486, 93990, 124494, 154998, 185502 | 9494 | AFN19531 | 9494 | 39998 | 70502, 101006, 131510, 162014, 192518 |
| 2479 | ACJ09818 | 2479 | 32983 | 63487, 93991, 124495, 154999, 185503 | 9495 | AFN19533 | 9495 | 39999 | 70503, 101007, 131511, 162015, 192519 |
| 2480 | ACJ67533 | 2480 | 32984 | 63488, 93992, 124496, 155000, 185504 | 9496 | AFN19535 | 9496 | 40000 | 70504, 101008, 131512, 162016, 192520 |
| 2481 | ACJ68607 | 2481 | 32985 | 63489, 93993, 124497, 155001, 185505 | 9497 | AFN19537 | 9497 | 40001 | 70505, 101009, 131513, 162017, 192521 |
| 2482 | ACJ68609 | 2482 | 32986 | 63490, 93994, 124498, 155002, 185506 | 9498 | AFN19539 | 9498 | 40002 | 70506, 101010, 131514, 162018, 192522 |
| 2483 | ACJ68610 | 2483 | 32987 | 63491, 93995, 124499, 155003, 185507 | 9499 | AFN19543 | 9499 | 40003 | 70507, 101011, 131515, 162019, 192523 |
| 2484 | ACJ68611 | 2484 | 32988 | 63492, 93996, 124500, 155004, 185508 | 9500 | AFN19545 | 9500 | 40004 | 70508, 101012, 131516, 162020, 192524 |
| 2485 | ACJ68612 | 2485 | 32989 | 63493, 93997, 124501, 155005, 185509 | 9501 | AFN19547 | 9501 | 40005 | 70509, 101013, 131517, 162021, 192525 |
| 2486 | ACJ68613 | 2486 | 32990 | 63494, 93998, 124502, 155006, 185510 | 9502 | AFN19549 | 9502 | 40006 | 70510, 101014, 131518, 162022, 192526 |
| 2487 | ACJ68614 | 2487 | 32991 | 63495, 93999, 124503, 155007, 185511 | 9503 | AFN19551 | 9503 | 40007 | 70511, 101015, 131519, 162023, 192527 |
| 2488 | ACK99007 | 2488 | 32992 | 63496, 94000, 124504, 155008, 185512 | 9504 | AFN19553 | 9504 | 40008 | 70512, 101016, 131520, 162024, 192528 |
| 2489 | ACK99008 | 2489 | 32993 | 63497, 94001, 124505, 155009, 185513 | 9505 | AFN19555 | 9505 | 40009 | 70513, 101017, 131521, 162025, 192529 |
| 2490 | ACK99009 | 2490 | 32994 | 63498, 94002, 124506, 155010, 185514 | 9506 | AFN19557 | 9506 | 40010 | 70514, 101018, 131522, 162026, 192530 |
| 2491 | ACK99011 | 2491 | 32995 | 63499, 94003, 124507, 155011, 185515 | 9507 | AFN19559 | 9507 | 40011 | 70515, 101019, 131523, 162027, 192531 |
| 2492 | ACK99012 | 2492 | 32996 | 63500, 94004, 124508, 155012, 185516 | 9508 | AFN19561 | 9508 | 40012 | 70516, 101020, 131524, 162028, 192532 |
| 2493 | ACK99013 | 2493 | 32997 | 63501, 94005, 124509, 155013, 185517 | 9509 | AFN19563 | 9509 | 40013 | 70517, 101021, 131525, 162029, 192533 |
| 2494 | ACK99014 | 2494 | 32998 | 63502, 94006, 124510, 155014, 185518 | 9510 | AFN19565 | 9510 | 40014 | 70518, 101022, 131526, 162030, 192534 |
| 2495 | ACK99016 | 2495 | 32999 | 63503, 94007, 124511, 155015, 185519 | 9511 | AFN19567 | 9511 | 40015 | 70519, 101023, 131527, 162031, 192535 |

FIG. 1 continued

| | | | | | | | | | |
|---|---|---|---|---|---|---|---|---|---|
| 2496 | ACK99018 | 2496 | 33000 | 63504, 94008, 124512, 155016, 185520 | 9512 | AFN19569 | 9512 | 40016 | 70520, 101024, 131528, 162032, 192536 |
| 2497 | ACK99023 | 2497 | 33001 | 63505, 94009, 124513, 155017, 185521 | 9513 | AFN19571 | 9513 | 40017 | 70521, 101025, 131529, 162033, 192537 |
| 2498 | ACK99026 | 2498 | 33002 | 63506, 94010, 124514, 155018, 185522 | 9514 | AFN19573 | 9514 | 40018 | 70522, 101026, 131530, 162034, 192538 |
| 2499 | ACK99027 | 2499 | 33003 | 63507, 94011, 124515, 155019, 185523 | 9515 | AFN19575 | 9515 | 40019 | 70523, 101027, 131531, 162035, 192539 |
| 2500 | ACK99028 | 2500 | 33004 | 63508, 94012, 124516, 155020, 185524 | 9516 | AFN19577 | 9516 | 40020 | 70524, 101028, 131532, 162036, 192540 |
| 2501 | ACK99029 | 2501 | 33005 | 63509, 94013, 124517, 155021, 185525 | 9517 | AFN19579 | 9517 | 40021 | 70525, 101029, 131533, 162037, 192541 |
| 2502 | ACK99030 | 2502 | 33006 | 63510, 94014, 124518, 155022, 185526 | 9518 | AFN19581 | 9518 | 40022 | 70526, 101030, 131534, 162038, 192542 |
| 2503 | ACK99031 | 2503 | 33007 | 63511, 94015, 124519, 155023, 185527 | 9519 | AFN19583 | 9519 | 40023 | 70527, 101031, 131535, 162039, 192543 |
| 2504 | ACK99032 | 2504 | 33008 | 63512, 94016, 124520, 155024, 185528 | 9520 | AFN19587 | 9520 | 40024 | 70528, 101032, 131536, 162040, 192544 |
| 2505 | ACK99033 | 2505 | 33009 | 63513, 94017, 124521, 155025, 185529 | 9521 | AFN19589 | 9521 | 40025 | 70529, 101033, 131537, 162041, 192545 |
| 2506 | ACK99034 | 2506 | 33010 | 63514, 94018, 124522, 155026, 185530 | 9522 | AFN19591 | 9522 | 40026 | 70530, 101034, 131538, 162042, 192546 |
| 2507 | ACK99035 | 2507 | 33011 | 63515, 94019, 124523, 155027, 185531 | 9523 | AFN19593 | 9523 | 40027 | 70531, 101035, 131539, 162043, 192547 |
| 2508 | ACK99421 | 2508 | 33012 | 63516, 94020, 124524, 155028, 185532 | 9524 | AFN19595 | 9524 | 40028 | 70532, 101036, 131540, 162044, 192548 |
| 2509 | ACK99432 | 2509 | 33013 | 63517, 94021, 124525, 155029, 185533 | 9525 | AFN19599 | 9525 | 40029 | 70533, 101037, 131541, 162045, 192549 |
| 2510 | ACK99443 | 2510 | 33014 | 63518, 94022, 124526, 155030, 185534 | 9526 | AFN19601 | 9526 | 40030 | 70534, 101038, 131542, 162046, 192550 |
| 2511 | ACK99465 | 2511 | 33015 | 63519, 94023, 124527, 155031, 185535 | 9527 | AFN19607 | 9527 | 40031 | 70535, 101039, 131543, 162047, 192551 |
| 2512 | ACK99476 | 2512 | 33016 | 63520, 94024, 124528, 155032, 185536 | 9528 | AFN19609 | 9528 | 40032 | 70536, 101040, 131544, 162048, 192552 |
| 2513 | ACL12063 | 2513 | 33017 | 63521, 94025, 124529, 155033, 185537 | 9529 | AFN19611 | 9529 | 40033 | 70537, 101041, 131545, 162049, 192553 |

FIG. 1 continued

| | | | | | | | | | |
|---|---|---|---|---|---|---|---|---|---|
| 2514 | ACL12129 | 2514 | 33018 | 63522, 94026, 124530, 155034, 185538 | 9530 | AFN19613 | 9530 | 40034 | 70538, 101042, 131546, 162050, 192554 |
| 2515 | ACL12140 | 2515 | 33019 | 63523, 94027, 124531, 155035, 185539 | 9531 | AFN19617 | 9531 | 40035 | 70539, 101043, 131547, 162051, 192555 |
| 2516 | ACL12151 | 2516 | 33020 | 63524, 94028, 124532, 155036, 185540 | 9532 | AFN19619 | 9532 | 40036 | 70540, 101044, 131548, 162052, 192556 |
| 2517 | ACL12162 | 2517 | 33021 | 63525, 94029, 124533, 155037, 185541 | 9533 | AFN19623 | 9533 | 40037 | 70541, 101045, 131549, 162053, 192557 |
| 2518 | ACL12173 | 2518 | 33022 | 63526, 94030, 124534, 155038, 185542 | 9534 | AFN19629 | 9534 | 40038 | 70542, 101046, 131550, 162054, 192558 |
| 2519 | ACL12184 | 2519 | 33023 | 63527, 94031, 124535, 155039, 185543 | 9535 | AFN19631 | 9535 | 40039 | 70543, 101047, 131551, 162055, 192559 |
| 2520 | ACL12195 | 2520 | 33024 | 63528, 94032, 124536, 155040, 185544 | 9536 | AFN19633 | 9536 | 40040 | 70544, 101048, 131552, 162056, 192560 |
| 2521 | ACL12217 | 2521 | 33025 | 63529, 94033, 124537, 155041, 185545 | 9537 | AFN19635 | 9537 | 40041 | 70545, 101049, 131553, 162057, 192561 |
| 2522 | ACL12228 | 2522 | 33026 | 63530, 94034, 124538, 155042, 185546 | 9538 | AFN19637 | 9538 | 40042 | 70546, 101050, 131554, 162058, 192562 |
| 2523 | ACL12239 | 2523 | 33027 | 63531, 94035, 124539, 155043, 185547 | 9539 | AFN19639 | 9539 | 40043 | 70547, 101051, 131555, 162059, 192563 |
| 2524 | ACL12250 | 2524 | 33028 | 63532, 94036, 124540, 155044, 185548 | 9540 | AFN19641 | 9540 | 40044 | 70548, 101052, 131556, 162060, 192564 |
| 2525 | ACL12261 | 2525 | 33029 | 63533, 94037, 124541, 155045, 185549 | 9541 | AFN19643 | 9541 | 40045 | 70549, 101053, 131557, 162061, 192565 |
| 2526 | ACN32272 | 2526 | 33030 | 63534, 94038, 124542, 155046, 185550 | 9542 | AFN19645 | 9542 | 40046 | 70550, 101054, 131558, 162062, 192566 |
| 2527 | ACN32283 | 2527 | 33031 | 63535, 94039, 124543, 155047, 185551 | 9543 | AFN19647 | 9543 | 40047 | 70551, 101055, 131559, 162063, 192567 |
| 2528 | ACN32474 | 2528 | 33032 | 63536, 94040, 124544, 155048, 185552 | 9544 | AFN19649 | 9544 | 40048 | 70552, 101056, 131560, 162064, 192568 |
| 2529 | ACN32501 | 2529 | 33033 | 63537, 94041, 124545, 155049, 185553 | 9545 | AFN19653 | 9545 | 40049 | 70553, 101057, 131561, 162065, 192569 |
| 2530 | ACN32534 | 2530 | 33034 | 63538, 94042, 124546, 155050, 185554 | 9546 | AFN19663 | 9546 | 40050 | 70554, 101058, 131562, 162066, 192570 |
| 2531 | ACN32545 | 2531 | 33035 | 63539, 94043, 124547, 155051, 185555 | 9547 | AFN19665 | 9547 | 40051 | 70555, 101059, 131563, 162067, 192571 |

FIG. 1 continued

| | | | | | | | | | |
|---|---|---|---|---|---|---|---|---|---|
| 2532 | ACN32793 | 2532 | 33036 | 63540, 94044, 124548, 155052, 185556 | 9548 | AFN19667 | 9548 | 40052 | 70556, 101060, 131564, 162068, 192572 |
| 2533 | ACN32804 | 2533 | 33037 | 63541, 94045, 124549, 155053, 185557 | 9549 | AFN19669 | 9549 | 40053 | 70557, 101061, 131565, 162069, 192573 |
| 2534 | ACN32815 | 2534 | 33038 | 63542, 94046, 124550, 155054, 185558 | 9550 | AFN19671 | 9550 | 40054 | 70558, 101062, 131566, 162070, 192574 |
| 2535 | ACN32826 | 2535 | 33039 | 63543, 94047, 124551, 155055, 185559 | 9551 | AFN19674 | 9551 | 40055 | 70559, 101063, 131567, 162071, 192575 |
| 2536 | ACN32848 | 2536 | 33040 | 63544, 94048, 124552, 155056, 185560 | 9552 | AFN19676 | 9552 | 40056 | 70560, 101064, 131568, 162072, 192576 |
| 2537 | ACN32870 | 2537 | 33041 | 63545, 94049, 124553, 155057, 185561 | 9553 | AFN19678 | 9553 | 40057 | 70561, 101065, 131569, 162073, 192577 |
| 2538 | ACN32892 | 2538 | 33042 | 63546, 94050, 124554, 155058, 185562 | 9554 | AFN19682 | 9554 | 40058 | 70562, 101066, 131570, 162074, 192578 |
| 2539 | ACN32903 | 2539 | 33043 | 63547, 94051, 124555, 155059, 185563 | 9555 | AFN19684 | 9555 | 40059 | 70563, 101067, 131571, 162075, 192579 |
| 2540 | ACN32914 | 2540 | 33044 | 63548, 94052, 124556, 155060, 185564 | 9556 | AFN19686 | 9556 | 40060 | 70564, 101068, 131572, 162076, 192580 |
| 2541 | ACN32925 | 2541 | 33045 | 63549, 94053, 124557, 155061, 185565 | 9557 | AFN19688 | 9557 | 40061 | 70565, 101069, 131573, 162077, 192581 |
| 2542 | ACN32936 | 2542 | 33046 | 63550, 94054, 124558, 155062, 185566 | 9558 | AFN19690 | 9558 | 40062 | 70566, 101070, 131574, 162078, 192582 |
| 2543 | ACN32947 | 2543 | 33047 | 63551, 94055, 124559, 155063, 185567 | 9559 | AFN19692 | 9559 | 40063 | 70567, 101071, 131575, 162079, 192583 |
| 2544 | ACN32958 | 2544 | 33048 | 63552, 94056, 124560, 155064, 185568 | 9560 | AFN19694 | 9560 | 40064 | 70568, 101072, 131576, 162080, 192584 |
| 2545 | ACN32969 | 2545 | 33049 | 63553, 94057, 124561, 155065, 185569 | 9561 | AFN19700 | 9561 | 40065 | 70569, 101073, 131577, 162081, 192585 |
| 2546 | ACN32980 | 2546 | 33050 | 63554, 94058, 124562, 155066, 185570 | 9562 | AFN19702 | 9562 | 40066 | 70570, 101074, 131578, 162082, 192586 |
| 2547 | ACN32991 | 2547 | 33051 | 63555, 94059, 124563, 155067, 185571 | 9563 | AFN19709 | 9563 | 40067 | 70571, 101075, 131579, 162083, 192587 |
| 2548 | ACN33002 | 2548 | 33052 | 63556, 94060, 124564, 155068, 185572 | 9564 | AFN19719 | 9564 | 40068 | 70572, 101076, 131580, 162084, 192588 |
| 2549 | ACN33013 | 2549 | 33053 | 63557, 94061, 124565, 155069, 185573 | 9565 | AFN19730 | 9565 | 40069 | 70573, 101077, 131581, 162085, 192589 |

FIG. 1 continued

| | | | | | | | | | |
|---|---|---|---|---|---|---|---|---|---|
| 2550 | ACN33035 | 2550 | 33054 | 63558, 94062, 124566, 155070, 185574 | 9566 | AFN19736 | 9566 | 40070 | 70574, 101078, 131582, 162086, 192590 |
| 2551 | ACN33046 | 2551 | 33055 | 63559, 94063, 124567, 155071, 185575 | 9567 | AFN19748 | 9567 | 40071 | 70575, 101079, 131583, 162087, 192591 |
| 2552 | ACN33057 | 2552 | 33056 | 63560, 94064, 124568, 155072, 185576 | 9568 | AFN19757 | 9568 | 40072 | 70576, 101080, 131584, 162088, 192592 |
| 2553 | ACN33068 | 2553 | 33057 | 63561, 94065, 124569, 155073, 185577 | 9569 | AFN19768 | 9569 | 40073 | 70577, 101081, 131585, 162089, 192593 |
| 2554 | ACN33079 | 2554 | 33058 | 63562, 94066, 124570, 155074, 185578 | 9570 | AFN19781 | 9570 | 40074 | 70578, 101082, 131586, 162090, 192594 |
| 2555 | ACN33090 | 2555 | 33059 | 63563, 94067, 124571, 155075, 185579 | 9571 | AFN19791 | 9571 | 40075 | 70579, 101083, 131587, 162091, 192595 |
| 2556 | ACN33101 | 2556 | 33060 | 63564, 94068, 124572, 155076, 185580 | 9572 | AFN19806 | 9572 | 40076 | 70580, 101084, 131588, 162092, 192596 |
| 2557 | ACN33112 | 2557 | 33061 | 63565, 94069, 124573, 155077, 185581 | 9573 | AFN19808 | 9573 | 40077 | 70581, 101085, 131589, 162093, 192597 |
| 2558 | ACN33123 | 2558 | 33062 | 63566, 94070, 124574, 155078, 185582 | 9574 | AFN19814 | 9574 | 40078 | 70582, 101086, 131590, 162094, 192598 |
| 2559 | ACN33145 | 2559 | 33063 | 63567, 94071, 124575, 155079, 185583 | 9575 | AFN19816 | 9575 | 40079 | 70583, 101087, 131591, 162095, 192599 |
| 2560 | ACN33156 | 2560 | 33064 | 63568, 94072, 124576, 155080, 185584 | 9576 | AFN19821 | 9576 | 40080 | 70584, 101088, 131592, 162096, 192600 |
| 2561 | ACN33178 | 2561 | 33065 | 63569, 94073, 124577, 155081, 185585 | 9577 | AFN19831 | 9577 | 40081 | 70585, 101089, 131593, 162097, 192601 |
| 2562 | ACN33189 | 2562 | 33066 | 63570, 94074, 124578, 155082, 185586 | 9578 | AFN19849 | 9578 | 40082 | 70586, 101090, 131594, 162098, 192602 |
| 2563 | ACN33200 | 2563 | 33067 | 63571, 94075, 124579, 155083, 185587 | 9579 | AFN19865 | 9579 | 40083 | 70587, 101091, 131595, 162099, 192603 |
| 2564 | ACN33211 | 2564 | 33068 | 63572, 94076, 124580, 155084, 185588 | 9580 | AFN19875 | 9580 | 40084 | 70588, 101092, 131596, 162100, 192604 |
| 2565 | ACN42981 | 2565 | 33069 | 63573, 94077, 124581, 155085, 185589 | 9581 | AFN19895 | 9581 | 40085 | 70589, 101093, 131597, 162101, 192605 |
| 2566 | ACN42992 | 2566 | 33070 | 63574, 94078, 124582, 155086, 185590 | 9582 | AFN19905 | 9582 | 40086 | 70590, 101094, 131598, 162102, 192606 |
| 2567 | ACN43003 | 2567 | 33071 | 63575, 94079, 124583, 155087, 185591 | 9583 | AFN19915 | 9583 | 40087 | 70591, 101095, 131599, 162103, 192607 |

FIG. 1 continued

| | | | | | | | | | |
|---|---|---|---|---|---|---|---|---|---|
| 2568 | ACN43014 | 2568 | 33072 | 63576, 94080, 124584, 155088, 185592 | 9584 | AFN19922 | 9584 | 40088 | 70592, 101096, 131600, 162104, 192608 |
| 2569 | ACN43025 | 2569 | 33073 | 63577, 94081, 124585, 155089, 185593 | 9585 | AFN19931 | 9585 | 40089 | 70593, 101097, 131601, 162105, 192609 |
| 2570 | ACN43036 | 2570 | 33074 | 63578, 94082, 124586, 155090, 185594 | 9586 | AFN19941 | 9586 | 40090 | 70594, 101098, 131602, 162106, 192610 |
| 2571 | ACN43047 | 2571 | 33075 | 63579, 94083, 124587, 155091, 185595 | 9587 | AFN19951 | 9587 | 40091 | 70595, 101099, 131603, 162107, 192611 |
| 2572 | ACN43058 | 2572 | 33076 | 63580, 94084, 124588, 155092, 185596 | 9588 | AFN19966 | 9588 | 40092 | 70596, 101100, 131604, 162108, 192612 |
| 2573 | ACN43069 | 2573 | 33077 | 63581, 94085, 124589, 155093, 185597 | 9589 | AFN19972 | 9589 | 40093 | 70597, 101101, 131605, 162109, 192613 |
| 2574 | ACN43080 | 2574 | 33078 | 63582, 94086, 124590, 155094, 185598 | 9590 | AFN19978 | 9590 | 40094 | 70598, 101102, 131606, 162110, 192614 |
| 2575 | ACN72617 | 2575 | 33079 | 63583, 94087, 124591, 155095, 185599 | 9591 | AFN19983 | 9591 | 40095 | 70599, 101103, 131607, 162111, 192615 |
| 2576 | ACN72632 | 2576 | 33080 | 63584, 94088, 124592, 155096, 185600 | 9592 | AFN19993 | 9592 | 40096 | 70600, 101104, 131608, 162112, 192616 |
| 2577 | ACN76478 | 2577 | 33081 | 63585, 94089, 124593, 155097, 185601 | 9593 | AFN20000 | 9593 | 40097 | 70601, 101105, 131609, 162113, 192617 |
| 2578 | ACN76489 | 2578 | 33082 | 63586, 94090, 124594, 155098, 185602 | 9594 | AFN20006 | 9594 | 40098 | 70602, 101106, 131610, 162114, 192618 |
| 2579 | ACN76500 | 2579 | 33083 | 63587, 94091, 124595, 155099, 185603 | 9595 | AFN20012 | 9595 | 40099 | 70603, 101107, 131611, 162115, 192619 |
| 2580 | ACN76511 | 2580 | 33084 | 63588, 94092, 124596, 155100, 185604 | 9596 | AFN20018 | 9596 | 40100 | 70604, 101108, 131612, 162116, 192620 |
| 2581 | ACN76522 | 2581 | 33085 | 63589, 94093, 124597, 155101, 185605 | 9597 | AFN20019 | 9597 | 40101 | 70605, 101109, 131613, 162117, 192621 |
| 2582 | ACO36331 | 2582 | 33086 | 63590, 94094, 124598, 155102, 185606 | 9598 | AFN20021 | 9598 | 40102 | 70606, 101110, 131614, 162118, 192622 |
| 2583 | ACO36342 | 2583 | 33087 | 63591, 94095, 124599, 155103, 185607 | 9599 | AFN20034 | 9599 | 40103 | 70607, 101111, 131615, 162119, 192623 |
| 2584 | ACO36364 | 2584 | 33088 | 63592, 94096, 124600, 155104, 185608 | 9600 | AFN20040 | 9600 | 40104 | 70608, 101112, 131616, 162120, 192624 |
| 2585 | ACO36375 | 2585 | 33089 | 63593, 94097, 124601, 155105, 185609 | 9601 | AFN20046 | 9601 | 40105 | 70609, 101113, 131617, 162121, 192625 |

FIG. 1 continued

| | | | | | | | | | |
|---|---|---|---|---|---|---|---|---|---|
| 2586 | AC036397 | 2586 | 33090 | 63594, 94098, 124602, 155106, 185610 | 9602 | AFN20052 | 9602 | 40106 | 70610, 101114, 131618, 162122, 192626 |
| 2587 | AC036408 | 2587 | 33091 | 63595, 94099, 124603, 155107, 185611 | 9603 | AFN20061 | 9603 | 40107 | 70611, 101115, 131619, 162123, 192627 |
| 2588 | AC036419 | 2588 | 33092 | 63596, 94100, 124604, 155108, 185612 | 9604 | AFN20076 | 9604 | 40108 | 70612, 101116, 131620, 162124, 192628 |
| 2589 | AC036430 | 2589 | 33093 | 63597, 94101, 124605, 155109, 185613 | 9605 | AFN20081 | 9605 | 40109 | 70613, 101117, 131621, 162125, 192629 |
| 2590 | AC036441 | 2590 | 33094 | 63598, 94102, 124606, 155110, 185614 | 9606 | AFN20092 | 9606 | 40110 | 70614, 101118, 131622, 162126, 192630 |
| 2591 | AC036452 | 2591 | 33095 | 63599, 94103, 124607, 155111, 185615 | 9607 | AFN20099 | 9607 | 40111 | 70615, 101119, 131623, 162127, 192631 |
| 2592 | AC036463 | 2592 | 33096 | 63600, 94104, 124608, 155112, 185616 | 9608 | AFN20112 | 9608 | 40112 | 70616, 101120, 131624, 162128, 192632 |
| 2593 | AC036474 | 2593 | 33097 | 63601, 94105, 124609, 155113, 185617 | 9609 | AFN87924 | 9609 | 40113 | 70617, 101121, 131625, 162129, 192633 |
| 2594 | AC036496 | 2594 | 33098 | 63602, 94106, 124610, 155114, 185618 | 9610 | AFN87926 | 9610 | 40114 | 70618, 101122, 131626, 162130, 192634 |
| 2595 | AC036518 | 2595 | 33099 | 63603, 94107, 124611, 155115, 185619 | 9611 | AFN87927 | 9611 | 40115 | 70619, 101123, 131627, 162131, 192635 |
| 2596 | AC036551 | 2596 | 33100 | 63604, 94108, 124612, 155116, 185620 | 9612 | AFN87928 | 9612 | 40116 | 70620, 101124, 131628, 162132, 192636 |
| 2597 | AC036562 | 2597 | 33101 | 63605, 94109, 124613, 155117, 185621 | 9613 | AFN87929 | 9613 | 40117 | 70621, 101125, 131629, 162133, 192637 |
| 2598 | AC036573 | 2598 | 33102 | 63606, 94110, 124614, 155118, 185622 | 9614 | AFN87930 | 9614 | 40118 | 70622, 101126, 131630, 162134, 192638 |
| 2599 | AC036584 | 2599 | 33103 | 63607, 94111, 124615, 155119, 185623 | 9615 | AFN87931 | 9615 | 40119 | 70623, 101127, 131631, 162135, 192639 |
| 2600 | AC036595 | 2600 | 33104 | 63608, 94112, 124616, 155120, 185624 | 9616 | AFN87932 | 9616 | 40120 | 70624, 101128, 131632, 162136, 192640 |
| 2601 | AC036606 | 2601 | 33105 | 63609, 94113, 124617, 155121, 185625 | 9617 | AFN87933 | 9617 | 40121 | 70625, 101129, 131633, 162137, 192641 |
| 2602 | AC036617 | 2602 | 33106 | 63610, 94114, 124618, 155122, 185626 | 9618 | AFN87934 | 9618 | 40122 | 70626, 101130, 131634, 162138, 192642 |
| 2603 | AC036628 | 2603 | 33107 | 63611, 94115, 124619, 155123, 185627 | 9619 | AFN87936 | 9619 | 40123 | 70627, 101131, 131635, 162139, 192643 |

FIG. 1 continued

| | | | | | | | | | |
|---|---|---|---|---|---|---|---|---|---|
| 2604 | AC036639 | 2604 | 33108 | 63612, 94116, 124620, 155124, 185628 | 9620 | AFN87938 | 9620 | 40124 | 70628, 101132, 131636, 162140, 192644 |
| 2605 | AC036661 | 2605 | 33109 | 63613, 94117, 124621, 155125, 185629 | 9621 | AFN87939 | 9621 | 40125 | 70629, 101133, 131637, 162141, 192645 |
| 2606 | AC036683 | 2606 | 33110 | 63614, 94118, 124622, 155126, 185630 | 9622 | AFN87941 | 9622 | 40126 | 70630, 101134, 131638, 162142, 192646 |
| 2607 | AC037122 | 2607 | 33111 | 63615, 94119, 124623, 155127, 185631 | 9623 | AFN87943 | 9623 | 40127 | 70631, 101135, 131639, 162143, 192647 |
| 2608 | AC094514 | 2608 | 33112 | 63616, 94120, 124624, 155128, 185632 | 9624 | AFN87945 | 9624 | 40128 | 70632, 101136, 131640, 162144, 192648 |
| 2609 | AC094515 | 2609 | 33113 | 63617, 94121, 124625, 155129, 185633 | 9625 | AFN87947 | 9625 | 40129 | 70633, 101137, 131641, 162145, 192649 |
| 2610 | AC094516 | 2610 | 33114 | 63618, 94122, 124626, 155130, 185634 | 9626 | AFN87949 | 9626 | 40130 | 70634, 101138, 131642, 162146, 192650 |
| 2611 | AC094672 | 2611 | 33115 | 63619, 94123, 124627, 155131, 185635 | 9627 | AFN87951 | 9627 | 40131 | 70635, 101139, 131643, 162147, 192651 |
| 2612 | AC094683 | 2612 | 33116 | 63620, 94124, 124628, 155132, 185636 | 9628 | AFN87953 | 9628 | 40132 | 70636, 101140, 131644, 162148, 192652 |
| 2613 | AC094694 | 2613 | 33117 | 63621, 94125, 124629, 155133, 185637 | 9629 | AFN87955 | 9629 | 40133 | 70637, 101141, 131645, 162149, 192653 |
| 2614 | AC094705 | 2614 | 33118 | 63622, 94126, 124630, 155134, 185638 | 9630 | AFN87957 | 9630 | 40134 | 70638, 101142, 131646, 162150, 192654 |
| 2615 | AC094727 | 2615 | 33119 | 63623, 94127, 124631, 155135, 185639 | 9631 | AFN87959 | 9631 | 40135 | 70639, 101143, 131647, 162151, 192655 |
| 2616 | AC094738 | 2616 | 33120 | 63624, 94128, 124632, 155136, 185640 | 9632 | AFN87961 | 9632 | 40136 | 70640, 101144, 131648, 162152, 192656 |
| 2617 | AC094760 | 2617 | 33121 | 63625, 94129, 124633, 155137, 185641 | 9633 | AF064802 | 9633 | 40137 | 70641, 101145, 131649, 162153, 192657 |
| 2618 | AC094771 | 2618 | 33122 | 63626, 94130, 124634, 155138, 185642 | 9634 | AF064813 | 9634 | 40138 | 70642, 101146, 131650, 162154, 192658 |
| 2619 | AC094782 | 2619 | 33123 | 63627, 94131, 124635, 155139, 185643 | 9635 | AF064824 | 9635 | 40139 | 70643, 101147, 131651, 162155, 192659 |
| 2620 | AC094793 | 2620 | 33124 | 63628, 94132, 124636, 155140, 185644 | 9636 | AF064835 | 9636 | 40140 | 70644, 101148, 131652, 162156, 192660 |
| 2621 | AC094804 | 2621 | 33125 | 63629, 94133, 124637, 155141, 185645 | 9637 | AF064846 | 9637 | 40141 | 70645, 101149, 131653, 162157, 192661 |

FIG. 1 continued

| | | | | | | | | | |
|---|---|---|---|---|---|---|---|---|---|
| 2622 | AC094815 | 2622 | 33126 | 63630, 94134, 124638, 155142, 185646 | 9638 | AF064857 | 9638 | 40142 | 70646, 101150, 131654, 162158, 192662 |
| 2623 | AC094848 | 2623 | 33127 | 63631, 94135, 124639, 155143, 185647 | 9639 | AF064868 | 9639 | 40143 | 70647, 101151, 131655, 162159, 192663 |
| 2624 | AC094859 | 2624 | 33128 | 63632, 94136, 124640, 155144, 185648 | 9640 | AF064879 | 9640 | 40144 | 70648, 101152, 131656, 162160, 192664 |
| 2625 | AC094870 | 2625 | 33129 | 63633, 94137, 124641, 155145, 185649 | 9641 | AF064890 | 9641 | 40145 | 70649, 101153, 131657, 162161, 192665 |
| 2626 | AC094881 | 2626 | 33130 | 63634, 94138, 124642, 155146, 185650 | 9642 | AF064901 | 9642 | 40146 | 70650, 101154, 131658, 162162, 192666 |
| 2627 | AC094892 | 2627 | 33131 | 63635, 94139, 124643, 155147, 185651 | 9643 | AF065016 | 9643 | 40147 | 70651, 101155, 131659, 162163, 192667 |
| 2628 | AC094903 | 2628 | 33132 | 63636, 94140, 124644, 155148, 185652 | 9644 | AF065027 | 9644 | 40148 | 70652, 101156, 131660, 162164, 192668 |
| 2629 | AC094925 | 2629 | 33133 | 63637, 94141, 124645, 155149, 185653 | 9645 | AF065038 | 9645 | 40149 | 70653, 101157, 131661, 162165, 192669 |
| 2630 | AC094936 | 2630 | 33134 | 63638, 94142, 124646, 155150, 185654 | 9646 | AF066136 | 9646 | 40150 | 70654, 101158, 131662, 162166, 192670 |
| 2631 | AC094947 | 2631 | 33135 | 63639, 94143, 124647, 155151, 185655 | 9647 | AF066147 | 9647 | 40151 | 70655, 101159, 131663, 162167, 192671 |
| 2632 | AC095153 | 2632 | 33136 | 63640, 94144, 124648, 155152, 185656 | 9648 | AF066158 | 9648 | 40152 | 70656, 101160, 131664, 162168, 192672 |
| 2633 | AC095171 | 2633 | 33137 | 63641, 94145, 124649, 155153, 185657 | 9649 | AF066169 | 9649 | 40153 | 70657, 101161, 131665, 162169, 192673 |
| 2634 | AC095193 | 2634 | 33138 | 63642, 94146, 124650, 155154, 185658 | 9650 | AF066180 | 9650 | 40154 | 70658, 101162, 131666, 162170, 192674 |
| 2635 | AC095204 | 2635 | 33139 | 63643, 94147, 124651, 155155, 185659 | 9651 | AF066191 | 9651 | 40155 | 70659, 101163, 131667, 162171, 192675 |
| 2636 | AC095215 | 2636 | 33140 | 63644, 94148, 124652, 155156, 185660 | 9652 | AF066202 | 9652 | 40156 | 70660, 101164, 131668, 162172, 192676 |
| 2637 | AC095226 | 2637 | 33141 | 63645, 94149, 124653, 155157, 185661 | 9653 | AF066213 | 9653 | 40157 | 70661, 101165, 131669, 162173, 192677 |
| 2638 | AC095248 | 2638 | 33142 | 63646, 94150, 124654, 155158, 185662 | 9654 | AF066224 | 9654 | 40158 | 70662, 101166, 131670, 162174, 192678 |
| 2639 | AC095270 | 2639 | 33143 | 63647, 94151, 124655, 155159, 185663 | 9655 | AF066235 | 9655 | 40159 | 70663, 101167, 131671, 162175, 192679 |

FIG. 1 continued

| | | | | | | | | | |
|---|---|---|---|---|---|---|---|---|---|
| 2640 | AC095281 | 2640 | 33144 | 63648, 94152, 124656, 155160, 185664 | 9656 | AF066246 | 9656 | 40160 | 70664, 101168, 131672, 162176, 192680 |
| 2641 | AC095292 | 2641 | 33145 | 63649, 94153, 124657, 155161, 185665 | 9657 | AFP33324 | 9657 | 40161 | 70665, 101169, 131673, 162177, 192681 |
| 2642 | AC095303 | 2642 | 33146 | 63650, 94154, 124658, 155162, 185666 | 9658 | AFP33325 | 9658 | 40162 | 70666, 101170, 131674, 162178, 192682 |
| 2643 | AC095382 | 2643 | 33147 | 63651, 94155, 124659, 155163, 185667 | 9659 | AFQ32573 | 9659 | 40163 | 70667, 101171, 131675, 162179, 192683 |
| 2644 | AC095415 | 2644 | 33148 | 63652, 94156, 124660, 155164, 185668 | 9660 | AFQ37281 | 9660 | 40164 | 70668, 101172, 131676, 162180, 192684 |
| 2645 | AC095426 | 2645 | 33149 | 63653, 94157, 124661, 155165, 185669 | 9661 | AFQ55689 | 9661 | 40165 | 70669, 101173, 131677, 162181, 192685 |
| 2646 | AC095437 | 2646 | 33150 | 63654, 94158, 124662, 155166, 185670 | 9662 | AFR68153 | 9662 | 40166 | 70670, 101174, 131678, 162182, 192686 |
| 2647 | AC095448 | 2647 | 33151 | 63655, 94159, 124663, 155167, 185671 | 9663 | AFR68163 | 9663 | 40167 | 70671, 101175, 131679, 162183, 192687 |
| 2648 | AC095459 | 2648 | 33152 | 63656, 94160, 124664, 155168, 185672 | 9664 | AFR68173 | 9664 | 40168 | 70672, 101176, 131680, 162184, 192688 |
| 2649 | AC095470 | 2649 | 33153 | 63657, 94161, 124665, 155169, 185673 | 9665 | AFR84675 | 9665 | 40169 | 70673, 101177, 131681, 162185, 192689 |
| 2650 | AC095481 | 2650 | 33154 | 63658, 94162, 124666, 155170, 185674 | 9666 | AFR84685 | 9666 | 40170 | 70674, 101178, 131682, 162186, 192690 |
| 2651 | AC095492 | 2651 | 33155 | 63659, 94163, 124667, 155171, 185675 | 9667 | AFR84694 | 9667 | 40171 | 70675, 101179, 131683, 162187, 192691 |
| 2652 | AC095503 | 2652 | 33156 | 63660, 94164, 124668, 155172, 185676 | 9668 | AFR84704 | 9668 | 40172 | 70676, 101180, 131684, 162188, 192692 |
| 2653 | AC095514 | 2653 | 33157 | 63661, 94165, 124669, 155173, 185677 | 9669 | AFR84714 | 9669 | 40173 | 70677, 101181, 131685, 162189, 192693 |
| 2654 | AC095536 | 2654 | 33158 | 63662, 94166, 124670, 155174, 185678 | 9670 | AFR84724 | 9670 | 40174 | 70678, 101182, 131686, 162190, 192694 |
| 2655 | AC095547 | 2655 | 33159 | 63663, 94167, 124671, 155175, 185679 | 9671 | AFR84734 | 9671 | 40175 | 70679, 101183, 131687, 162191, 192695 |
| 2656 | ACP41963 | 2656 | 33160 | 63664, 94168, 124672, 155176, 185680 | 9672 | AFR84754 | 9672 | 40176 | 70680, 101184, 131688, 162192, 192696 |
| 2657 | ACP44192 | 2657 | 33161 | 63665, 94169, 124673, 155177, 185681 | 9673 | AFR84764 | 9673 | 40177 | 70681, 101185, 131689, 162193, 192697 |

FIG. 1 continued

| | | | | | | | | | |
|---|---|---|---|---|---|---|---|---|---|
| 2658 | ACP44203 | 2658 | 33162 | 63666, 94170, 124674, 155178, 185682 | 9674 | AFR84774 | 9674 | 40178 | 70682, 101186, 131690, 162194, 192698 |
| 2659 | ACP44225 | 2659 | 33163 | 63667, 94171, 124675, 155179, 185683 | 9675 | AFR84784 | 9675 | 40179 | 70683, 101187, 131691, 162195, 192699 |
| 2660 | ACP44236 | 2660 | 33164 | 63668, 94172, 124676, 155180, 185684 | 9676 | AFR84794 | 9676 | 40180 | 70684, 101188, 131692, 162196, 192700 |
| 2661 | ACP44247 | 2661 | 33165 | 63669, 94173, 124677, 155181, 185685 | 9677 | AFR84804 | 9677 | 40181 | 70685, 101189, 131693, 162197, 192701 |
| 2662 | ACP44258 | 2662 | 33166 | 63670, 94174, 124678, 155182, 185686 | 9678 | AFR84814 | 9678 | 40182 | 70686, 101190, 131694, 162198, 192702 |
| 2663 | ACP44269 | 2663 | 33167 | 63671, 94175, 124679, 155183, 185687 | 9679 | AFR84824 | 9679 | 40183 | 70687, 101191, 131695, 162199, 192703 |
| 2664 | ACQ44554 | 2664 | 33168 | 63672, 94176, 124680, 155184, 185688 | 9680 | AFR84834 | 9680 | 40184 | 70688, 101192, 131696, 162200, 192704 |
| 2665 | ACQ44556 | 2665 | 33169 | 63673, 94177, 124681, 155185, 185689 | 9681 | AFR84844 | 9681 | 40185 | 70689, 101193, 131697, 162201, 192705 |
| 2666 | ACQ45338 | 2666 | 33170 | 63674, 94178, 124682, 155186, 185690 | 9682 | AFR84854 | 9682 | 40186 | 70690, 101194, 131698, 162202, 192706 |
| 2667 | ACQ55359 | 2667 | 33171 | 63675, 94179, 124683, 155187, 185691 | 9683 | AFR84864 | 9683 | 40187 | 70691, 101195, 131699, 162203, 192707 |
| 2668 | ACQ55361 | 2668 | 33172 | 63676, 94180, 124684, 155188, 185692 | 9684 | AFR84874 | 9684 | 40188 | 70692, 101196, 131700, 162204, 192708 |
| 2669 | ACQ63223 | 2669 | 33173 | 63677, 94181, 124685, 155189, 185693 | 9685 | AFR84893 | 9685 | 40189 | 70693, 101197, 131701, 162205, 192709 |
| 2670 | ACQ63239 | 2670 | 33174 | 63678, 94182, 124686, 155190, 185694 | 9686 | AFR84903 | 9686 | 40190 | 70694, 101198, 131702, 162206, 192710 |
| 2671 | ACQ63244 | 2671 | 33175 | 63679, 94183, 124687, 155191, 185695 | 9687 | AFR84913 | 9687 | 40191 | 70695, 101199, 131703, 162207, 192711 |
| 2672 | ACQ63257 | 2672 | 33176 | 63680, 94184, 124688, 155192, 185696 | 9688 | AFR84923 | 9688 | 40192 | 70696, 101200, 131704, 162208, 192712 |
| 2673 | ACQ65691 | 2673 | 33177 | 63681, 94185, 124689, 155193, 185697 | 9689 | AFV53205 | 9689 | 40193 | 70697, 101201, 131705, 162209, 192713 |
| 2674 | ACQ65713 | 2674 | 33178 | 63682, 94186, 124690, 155194, 185698 | 9690 | AFV53216 | 9690 | 40194 | 70698, 101202, 131706, 162210, 192714 |
| 2675 | ACQ65724 | 2675 | 33179 | 63683, 94187, 124691, 155195, 185699 | 9691 | AFV53227 | 9691 | 40195 | 70699, 101203, 131707, 162211, 192715 |

FIG. 1 continued

| | | | | | | | | | |
|---|---|---|---|---|---|---|---|---|---|
| 2676 | ACQ65747 | 2676 | 33180 | 63684, 94188, 124692, 155196, 185700 | 9692 | AFV53238 | 9692 | 40196 | 70700, 101204, 131708, 162212, 192716 |
| 2677 | ACQ65758 | 2677 | 33181 | 63685, 94189, 124693, 155197, 185701 | 9693 | AFV53249 | 9693 | 40197 | 70701, 101205, 131709, 162213, 192717 |
| 2678 | ACQ73386 | 2678 | 33182 | 63686, 94190, 124694, 155198, 185702 | 9694 | AFV53260 | 9694 | 40198 | 70702, 101206, 131710, 162214, 192718 |
| 2679 | ACQ73387 | 2679 | 33183 | 63687, 94191, 124695, 155199, 185703 | 9695 | AFV53271 | 9695 | 40199 | 70703, 101207, 131711, 162215, 192719 |
| 2680 | ACQ73555 | 2680 | 33184 | 63688, 94192, 124696, 155200, 185704 | 9696 | AFV53282 | 9696 | 40200 | 70704, 101208, 131712, 162216, 192720 |
| 2681 | ACQ76294 | 2681 | 33185 | 63689, 94193, 124697, 155201, 185705 | 9697 | AFV53293 | 9697 | 40201 | 70705, 101209, 131713, 162217, 192721 |
| 2682 | ACQ76314 | 2682 | 33186 | 63690, 94194, 124698, 155202, 185706 | 9698 | AFV53304 | 9698 | 40202 | 70706, 101210, 131714, 162218, 192722 |
| 2683 | ACQ76317 | 2683 | 33187 | 63691, 94195, 124699, 155203, 185707 | 9699 | AFV53314 | 9699 | 40203 | 70707, 101211, 131715, 162219, 192723 |
| 2684 | ACQ76318 | 2684 | 33188 | 63692, 94196, 124700, 155204, 185708 | 9700 | AFV53325 | 9700 | 40204 | 70708, 101212, 131716, 162220, 192724 |
| 2685 | ACQ76326 | 2685 | 33189 | 63693, 94197, 124701, 155205, 185709 | 9701 | AFV53336 | 9701 | 40205 | 70709, 101213, 131717, 162221, 192725 |
| 2686 | ACQ76336 | 2686 | 33190 | 63694, 94198, 124702, 155206, 185710 | 9702 | AFV68720 | 9702 | 40206 | 70710, 101214, 131718, 162222, 192726 |
| 2687 | ACQ76347 | 2687 | 33191 | 63695, 94199, 124703, 155207, 185711 | 9703 | AFX96347 | 9703 | 40207 | 70711, 101215, 131719, 162223, 192727 |
| 2688 | ACQ76365 | 2688 | 33192 | 63696, 94200, 124704, 155208, 185712 | 9704 | AFX96359 | 9704 | 40208 | 70712, 101216, 131720, 162224, 192728 |
| 2689 | ACQ76370 | 2689 | 33193 | 63697, 94201, 124705, 155209, 185713 | 9705 | AFX96366 | 9705 | 40209 | 70713, 101217, 131721, 162225, 192729 |
| 2690 | ACQ76376 | 2690 | 33194 | 63698, 94202, 124706, 155210, 185714 | 9706 | AFX96383 | 9706 | 40210 | 70714, 101218, 131722, 162226, 192730 |
| 2691 | ACQ76383 | 2691 | 33195 | 63699, 94203, 124707, 155211, 185715 | 9707 | AFX96398 | 9707 | 40211 | 70715, 101219, 131723, 162227, 192731 |
| 2692 | ACQ76389 | 2692 | 33196 | 63700, 94204, 124708, 155212, 185716 | 9708 | AFX96408 | 9708 | 40212 | 70716, 101220, 131724, 162228, 192732 |
| 2693 | ACQ76401 | 2693 | 33197 | 63701, 94205, 124709, 155213, 185717 | 9709 | AFX96418 | 9709 | 40213 | 70717, 101221, 131725, 162229, 192733 |

FIG. 1 continued

| | | | | | | | | | |
|---|---|---|---|---|---|---|---|---|---|
| 2694 | ACQ76405 | 2694 | 33198 | 63702, 94206, 124710, 155214, 185718 | 9710 | AFX96428 | 9710 | 40214 | 70718, 101222, 131726, 162230, 192734 |
| 2695 | ACQ76408 | 2695 | 33199 | 63703, 94207, 124711, 155215, 185719 | 9711 | AFX96438 | 9711 | 40215 | 70719, 101223, 131727, 162231, 192735 |
| 2696 | ACQ77601 | 2696 | 33200 | 63704, 94208, 124712, 155216, 185720 | 9712 | AFX96448 | 9712 | 40216 | 70720, 101224, 131728, 162232, 192736 |
| 2697 | ACQ83310 | 2697 | 33201 | 63705, 94209, 124713, 155217, 185721 | 9713 | AFX96458 | 9713 | 40217 | 70721, 101225, 131729, 162233, 192737 |
| 2698 | ACQ84451 | 2698 | 33202 | 63706, 94210, 124714, 155218, 185722 | 9714 | AFX96468 | 9714 | 40218 | 70722, 101226, 131730, 162234, 192738 |
| 2699 | ACQ84457 | 2699 | 33203 | 63707, 94211, 124715, 155219, 185723 | 9715 | AFX96478 | 9715 | 40219 | 70723, 101227, 131731, 162235, 192739 |
| 2700 | ACQ84477 | 2700 | 33204 | 63708, 94212, 124716, 155220, 185724 | 9716 | AFX96488 | 9716 | 40220 | 70724, 101228, 131732, 162236, 192740 |
| 2701 | ACQ89900 | 2701 | 33205 | 63709, 94213, 124717, 155221, 185725 | 9717 | AFX96498 | 9717 | 40221 | 70725, 101229, 131733, 162237, 192741 |
| 2702 | ACQ89902 | 2702 | 33206 | 63710, 94214, 124718, 155222, 185726 | 9718 | AFX96508 | 9718 | 40222 | 70726, 101230, 131734, 162238, 192742 |
| 2703 | ACQ89904 | 2703 | 33207 | 63711, 94215, 124719, 155223, 185727 | 9719 | AFX96518 | 9719 | 40223 | 70727, 101231, 131735, 162239, 192743 |
| 2704 | ACQ89905 | 2704 | 33208 | 63712, 94216, 124720, 155224, 185728 | 9720 | AFX96528 | 9720 | 40224 | 70728, 101232, 131736, 162240, 192744 |
| 2705 | ACQ99607 | 2705 | 33209 | 63713, 94217, 124721, 155225, 185729 | 9721 | AFX96538 | 9721 | 40225 | 70729, 101233, 131737, 162241, 192745 |
| 2706 | ACQ99608 | 2706 | 33210 | 63714, 94218, 124722, 155226, 185730 | 9722 | AFX96548 | 9722 | 40226 | 70730, 101234, 131738, 162242, 192746 |
| 2707 | ACQ99609 | 2707 | 33211 | 63715, 94219, 124723, 155227, 185731 | 9723 | AFX96558 | 9723 | 40227 | 70731, 101235, 131739, 162243, 192747 |
| 2708 | ACQ99611 | 2708 | 33212 | 63716, 94220, 124724, 155228, 185732 | 9724 | AFX96568 | 9724 | 40228 | 70732, 101236, 131740, 162244, 192748 |
| 2709 | ACQ99614 | 2709 | 33213 | 63717, 94221, 124725, 155229, 185733 | 9725 | AFX96578 | 9725 | 40229 | 70733, 101237, 131741, 162245, 192749 |
| 2710 | ACQ99616 | 2710 | 33214 | 63718, 94222, 124726, 155230, 185734 | 9726 | AFX96588 | 9726 | 40230 | 70734, 101238, 131742, 162246, 192750 |
| 2711 | ACQ99617 | 2711 | 33215 | 63719, 94223, 124727, 155231, 185735 | 9727 | AFX96598 | 9727 | 40231 | 70735, 101239, 131743, 162247, 192751 |

FIG. 1 continued

| | | | | | | | | | |
|---|---|---|---|---|---|---|---|---|---|
| 2712 | ACQ99618 | 2712 | 33216 | 63720, 94224, 124728, 155232, 185736 | 9728 | AFX96608 | 9728 | 40232 | 70736, 101240, 131744, 162248, 192752 |
| 2713 | ACQ99619 | 2713 | 33217 | 63721, 94225, 124729, 155233, 185737 | 9729 | AFX96618 | 9729 | 40233 | 70737, 101241, 131745, 162249, 192753 |
| 2714 | ACQ99620 | 2714 | 33218 | 63722, 94226, 124730, 155234, 185738 | 9730 | AFX96628 | 9730 | 40234 | 70738, 101242, 131746, 162250, 192754 |
| 2715 | ACQ99621 | 2715 | 33219 | 63723, 94227, 124731, 155235, 185739 | 9731 | AFX96638 | 9731 | 40235 | 70739, 101243, 131747, 162251, 192755 |
| 2716 | ACQ99622 | 2716 | 33220 | 63724, 94228, 124732, 155236, 185740 | 9732 | AFX96648 | 9732 | 40236 | 70740, 101244, 131748, 162252, 192756 |
| 2717 | ACR01014 | 2717 | 33221 | 63725, 94229, 124733, 155237, 185741 | 9733 | AFX96658 | 9733 | 40237 | 70741, 101245, 131749, 162253, 192757 |
| 2718 | ACR08419 | 2718 | 33222 | 63726, 94230, 124734, 155238, 185742 | 9734 | AFX96668 | 9734 | 40238 | 70742, 101246, 131750, 162254, 192758 |
| 2719 | ACR08429 | 2719 | 33223 | 63727, 94231, 124735, 155239, 185743 | 9735 | AFX96678 | 9735 | 40239 | 70743, 101247, 131751, 162255, 192759 |
| 2720 | ACR08439 | 2720 | 33224 | 63728, 94232, 124736, 155240, 185744 | 9736 | AFX96688 | 9736 | 40240 | 70744, 101248, 131752, 162256, 192760 |
| 2721 | ACR08449 | 2721 | 33225 | 63729, 94233, 124737, 155241, 185745 | 9737 | AFX96698 | 9737 | 40241 | 70745, 101249, 131753, 162257, 192761 |
| 2722 | ACR08459 | 2722 | 33226 | 63730, 94234, 124738, 155242, 185746 | 9738 | AFX96718 | 9738 | 40242 | 70746, 101250, 131754, 162258, 192762 |
| 2723 | ACR08528 | 2723 | 33227 | 63731, 94235, 124739, 155243, 185747 | 9739 | AFX96728 | 9739 | 40243 | 70747, 101251, 131755, 162259, 192763 |
| 2724 | ACR08530 | 2724 | 33228 | 63732, 94236, 124740, 155244, 185748 | 9740 | AFX96738 | 9740 | 40244 | 70748, 101252, 131756, 162260, 192764 |
| 2725 | ACR08531 | 2725 | 33229 | 63733, 94237, 124741, 155245, 185749 | 9741 | AFX96748 | 9741 | 40245 | 70749, 101253, 131757, 162261, 192765 |
| 2726 | ACR08533 | 2726 | 33230 | 63734, 94238, 124742, 155246, 185750 | 9742 | AFX96758 | 9742 | 40246 | 70750, 101254, 131758, 162262, 192766 |
| 2727 | ACR08535 | 2727 | 33231 | 63735, 94239, 124743, 155247, 185751 | 9743 | AFX96768 | 9743 | 40247 | 70751, 101255, 131759, 162263, 192767 |
| 2728 | ACR08536 | 2728 | 33232 | 63736, 94240, 124744, 155248, 185752 | 9744 | AFX96778 | 9744 | 40248 | 70752, 101256, 131760, 162264, 192768 |
| 2729 | ACR08537 | 2729 | 33233 | 63737, 94241, 124745, 155249, 185753 | 9745 | AFX96788 | 9745 | 40249 | 70753, 101257, 131761, 162265, 192769 |

FIG. 1 continued

| | | | | | | | | | |
|---|---|---|---|---|---|---|---|---|---|
| 2730 | ACR08538 | 2730 | 33234 | 63738, 94242, 124746, 155250, 185754 | 9746 | AFX96798 | 9746 | 40250 | 70754, 101258, 131762, 162266, 192770 |
| 2731 | ACR08539 | 2731 | 33235 | 63739, 94243, 124747, 155251, 185755 | 9747 | AFX96808 | 9747 | 40251 | 70755, 101259, 131763, 162267, 192771 |
| 2732 | ACR08540 | 2732 | 33236 | 63740, 94244, 124748, 155252, 185756 | 9748 | AFX96818 | 9748 | 40252 | 70756, 101260, 131764, 162268, 192772 |
| 2733 | ACR08542 | 2733 | 33237 | 63741, 94245, 124749, 155253, 185757 | 9749 | AFX96828 | 9749 | 40253 | 70757, 101261, 131765, 162269, 192773 |
| 2734 | ACR08543 | 2734 | 33238 | 63742, 94246, 124750, 155254, 185758 | 9750 | AFX96838 | 9750 | 40254 | 70758, 101262, 131766, 162270, 192774 |
| 2735 | ACR08544 | 2735 | 33239 | 63743, 94247, 124751, 155255, 185759 | 9751 | AFX96856 | 9751 | 40255 | 70759, 101263, 131767, 162271, 192775 |
| 2736 | ACR08545 | 2736 | 33240 | 63744, 94248, 124752, 155256, 185760 | 9752 | AFX96904 | 9752 | 40256 | 70760, 101264, 131768, 162272, 192776 |
| 2737 | ACR08546 | 2737 | 33241 | 63745, 94249, 124753, 155257, 185761 | 9753 | AFX96914 | 9753 | 40257 | 70761, 101265, 131769, 162273, 192777 |
| 2738 | ACR08547 | 2738 | 33242 | 63746, 94250, 124754, 155258, 185762 | 9754 | AFX96924 | 9754 | 40258 | 70762, 101266, 131770, 162274, 192778 |
| 2739 | ACR08548 | 2739 | 33243 | 63747, 94251, 124755, 155259, 185763 | 9755 | AFX96934 | 9755 | 40259 | 70763, 101267, 131771, 162275, 192779 |
| 2740 | ACR08549 | 2740 | 33244 | 63748, 94252, 124756, 155260, 185764 | 9756 | AFY24097 | 9756 | 40260 | 70764, 101268, 131772, 162276, 192780 |
| 2741 | ACR08550 | 2741 | 33245 | 63749, 94253, 124757, 155261, 185765 | 9757 | AFY24162 | 9757 | 40261 | 70765, 101269, 131773, 162277, 192781 |
| 2742 | ACR08551 | 2742 | 33246 | 63750, 94254, 124758, 155262, 185766 | 9758 | AFY24195 | 9758 | 40262 | 70766, 101270, 131774, 162278, 192782 |
| 2743 | ACR08552 | 2743 | 33247 | 63751, 94255, 124759, 155263, 185767 | 9759 | AFY24217 | 9759 | 40263 | 70767, 101271, 131775, 162279, 192783 |
| 2744 | ACR08553 | 2744 | 33248 | 63752, 94256, 124760, 155264, 185768 | 9760 | AGB08294 | 9760 | 40264 | 70768, 101272, 131776, 162280, 192784 |
| 2745 | ACR08554 | 2745 | 33249 | 63753, 94257, 124761, 155265, 185769 | 9761 | AGB08295 | 9761 | 40265 | 70769, 101273, 131777, 162281, 192785 |
| 2746 | ACR09365 | 2746 | 33250 | 63754, 94258, 124762, 155266, 185770 | 9762 | AGB08296 | 9762 | 40266 | 70770, 101274, 131778, 162282, 192786 |
| 2747 | ACR09366 | 2747 | 33251 | 63755, 94259, 124763, 155267, 185771 | 9763 | AGB08297 | 9763 | 40267 | 70771, 101275, 131779, 162283, 192787 |

FIG. 1 continued

| | | | | | | | | | |
|---|---|---|---|---|---|---|---|---|---|
| 2748 | ACR09367 | 2748 | 33252 | 63756, 94260, 124764, 155268, 185772 | 9764 | AGB08298 | 9764 | 40268 | 70772, 101276, 131780, 162284, 192788 |
| 2749 | ACR09368 | 2749 | 33253 | 63757, 94261, 124765, 155269, 185773 | 9765 | AGB08301 | 9765 | 40269 | 70773, 101277, 131781, 162285, 192789 |
| 2750 | ACR09369 | 2750 | 33254 | 63758, 94262, 124766, 155270, 185774 | 9766 | AGB08343 | 9766 | 40270 | 70774, 101278, 131782, 162286, 192790 |
| 2751 | ACR09370 | 2751 | 33255 | 63759, 94263, 124767, 155271, 185775 | 9767 | AGB08362 | 9767 | 40271 | 70775, 101279, 131783, 162287, 192791 |
| 2752 | ACR09371 | 2752 | 33256 | 63760, 94264, 124768, 155272, 185776 | 9768 | AGB12986 | 9768 | 40272 | 70776, 101280, 131784, 162288, 192792 |
| 2753 | ACR09373 | 2753 | 33257 | 63761, 94265, 124769, 155273, 185777 | 9769 | AGB13006 | 9769 | 40273 | 70777, 101281, 131785, 162289, 192793 |
| 2754 | ACR09374 | 2754 | 33258 | 63762, 94266, 124770, 155274, 185778 | 9770 | AGB13016 | 9770 | 40274 | 70778, 101282, 131786, 162290, 192794 |
| 2755 | ACR09375 | 2755 | 33259 | 63763, 94267, 124771, 155275, 185779 | 9771 | AGB13026 | 9771 | 40275 | 70779, 101283, 131787, 162291, 192795 |
| 2756 | ACR09376 | 2756 | 33260 | 63764, 94268, 124772, 155276, 185780 | 9772 | AGB13036 | 9772 | 40276 | 70780, 101284, 131788, 162292, 192796 |
| 2757 | ACR09377 | 2757 | 33261 | 63765, 94269, 124773, 155277, 185781 | 9773 | AGB13048 | 9773 | 40277 | 70781, 101285, 131789, 162293, 192797 |
| 2758 | ACR09395 | 2758 | 33262 | 63766, 94270, 124774, 155278, 185782 | 9774 | AGB13066 | 9774 | 40278 | 70782, 101286, 131790, 162294, 192798 |
| 2759 | ACR09396 | 2759 | 33263 | 63767, 94271, 124775, 155279, 185783 | 9775 | AGB13082 | 9775 | 40279 | 70783, 101287, 131791, 162295, 192799 |
| 2760 | ACR10186 | 2760 | 33264 | 63768, 94272, 124776, 155280, 185784 | 9776 | AGB13105 | 9776 | 40280 | 70784, 101288, 131792, 162296, 192800 |
| 2761 | ACR10222 | 2761 | 33265 | 63769, 94273, 124777, 155281, 185785 | 9777 | AGB13125 | 9777 | 40281 | 70785, 101289, 131793, 162297, 192801 |
| 2762 | ACR10223 | 2762 | 33266 | 63770, 94274, 124778, 155282, 185786 | 9778 | AGB13130 | 9778 | 40282 | 70786, 101290, 131794, 162298, 192802 |
| 2763 | ACR15183 | 2763 | 33267 | 63771, 94275, 124779, 155283, 185787 | 9779 | AGB13140 | 9779 | 40283 | 70787, 101291, 131795, 162299, 192803 |
| 2764 | ACR15194 | 2764 | 33268 | 63772, 94276, 124780, 155284, 185788 | 9780 | AGB13159 | 9780 | 40284 | 70788, 101292, 131796, 162300, 192804 |
| 2765 | ACR15216 | 2765 | 33269 | 63773, 94277, 124781, 155285, 185789 | 9781 | AGB13170 | 9781 | 40285 | 70789, 101293, 131797, 162301, 192805 |

FIG. 1 continued

| | | | | | | | | | |
|---|---|---|---|---|---|---|---|---|---|
| 2766 | ACRI5227 | 2766 | 33270 | 63774, 94278, 124782, 155286, 185790 | 9782 | AGBI3180 | 9782 | 40286 | 70790, 101294, 131798, 162302, 192806 |
| 2767 | ACRI5238 | 2767 | 33271 | 63775, 94279, 124783, 155287, 185791 | 9783 | AGBI3190 | 9783 | 40287 | 70791, 101295, 131799, 162303, 192807 |
| 2768 | ACRI5249 | 2768 | 33272 | 63776, 94280, 124784, 155288, 185792 | 9784 | AGBI3200 | 9784 | 40288 | 70792, 101296, 131800, 162304, 192808 |
| 2769 | ACRI5282 | 2769 | 33273 | 63777, 94281, 124785, 155289, 185793 | 9785 | AGBI3210 | 9785 | 40289 | 70793, 101297, 131801, 162305, 192809 |
| 2770 | ACRI5293 | 2770 | 33274 | 63778, 94282, 124786, 155290, 185794 | 9786 | AGBI3220 | 9786 | 40290 | 70794, 101298, 131802, 162306, 192810 |
| 2771 | ACRI5304 | 2771 | 33275 | 63779, 94283, 124787, 155291, 185795 | 9787 | AGBI3230 | 9787 | 40291 | 70795, 101299, 131803, 162307, 192811 |
| 2772 | ACRI5315 | 2772 | 33276 | 63780, 94284, 124788, 155292, 185796 | 9788 | AGBI3240 | 9788 | 40292 | 70796, 101300, 131804, 162308, 192812 |
| 2773 | ACRI5326 | 2773 | 33277 | 63781, 94285, 124789, 155293, 185797 | 9789 | AGBI3250 | 9789 | 40293 | 70797, 101301, 131805, 162309, 192813 |
| 2774 | ACRI5359 | 2774 | 33278 | 63782, 94286, 124790, 155294, 185798 | 9790 | AGBI3260 | 9790 | 40294 | 70798, 101302, 131806, 162310, 192814 |
| 2775 | ACRI5370 | 2775 | 33279 | 63783, 94287, 124791, 155295, 185799 | 9791 | AGBI3270 | 9791 | 40295 | 70799, 101303, 131807, 162311, 192815 |
| 2776 | ACRI5381 | 2776 | 33280 | 63784, 94288, 124792, 155296, 185800 | 9792 | AGBI3280 | 9792 | 40296 | 70800, 101304, 131808, 162312, 192816 |
| 2777 | ACRI5392 | 2777 | 33281 | 63785, 94289, 124793, 155297, 185801 | 9793 | AGBI3290 | 9793 | 40297 | 70801, 101305, 131809, 162313, 192817 |
| 2778 | ACRI5403 | 2778 | 33282 | 63786, 94290, 124794, 155298, 185802 | 9794 | AGBI3300 | 9794 | 40298 | 70802, 101306, 131810, 162314, 192818 |
| 2779 | ACRI5414 | 2779 | 33283 | 63787, 94291, 124795, 155299, 185803 | 9795 | AGBI3310 | 9795 | 40299 | 70803, 101307, 131811, 162315, 192819 |
| 2780 | ACRI5425 | 2780 | 33284 | 63788, 94292, 124796, 155300, 185804 | 9796 | AGBI3320 | 9796 | 40300 | 70804, 101308, 131812, 162316, 192820 |
| 2781 | ACRI5436 | 2781 | 33285 | 63789, 94293, 124797, 155301, 185805 | 9797 | AGBI3330 | 9797 | 40301 | 70805, 101309, 131813, 162317, 192821 |
| 2782 | ACRI5458 | 2782 | 33286 | 63790, 94294, 124798, 155302, 185806 | 9798 | AGBI3340 | 9798 | 40302 | 70806, 101310, 131814, 162318, 192822 |
| 2783 | ACRI5469 | 2783 | 33287 | 63791, 94295, 124799, 155303, 185807 | 9799 | AGBI3350 | 9799 | 40303 | 70807, 101311, 131815, 162319, 192823 |

FIG. 1 continued

| | | | | | | | | | |
|---|---|---|---|---|---|---|---|---|---|
| 2784 | ACR15480 | 2784 | 33288 | 63792, 94296, 124800, 155304, 185808 | 9800 | AGB13360 | 9800 | 40304 | 70808, 101312, 131816, 162320, 192824 |
| 2785 | ACR15491 | 2785 | 33289 | 63793, 94297, 124801, 155305, 185809 | 9801 | AGB13380 | 9801 | 40305 | 70809, 101313, 131817, 162321, 192825 |
| 2786 | ACR15502 | 2786 | 33290 | 63794, 94298, 124802, 155306, 185810 | 9802 | AGB13390 | 9802 | 40306 | 70810, 101314, 131818, 162322, 192826 |
| 2787 | ACR15513 | 2787 | 33291 | 63795, 94299, 124803, 155307, 185811 | 9803 | AGB13400 | 9803 | 40307 | 70811, 101315, 131819, 162323, 192827 |
| 2788 | ACR15524 | 2788 | 33292 | 63796, 94300, 124804, 155308, 185812 | 9804 | AGB13410 | 9804 | 40308 | 70812, 101316, 131820, 162324, 192828 |
| 2789 | ACR15535 | 2789 | 33293 | 63797, 94301, 124805, 155309, 185813 | 9805 | AGB13420 | 9805 | 40309 | 70813, 101317, 131821, 162325, 192829 |
| 2790 | ACR15546 | 2790 | 33294 | 63798, 94302, 124806, 155310, 185814 | 9806 | AGB13430 | 9806 | 40310 | 70814, 101318, 131822, 162326, 192830 |
| 2791 | ACR15557 | 2791 | 33295 | 63799, 94303, 124807, 155311, 185815 | 9807 | AGB13440 | 9807 | 40311 | 70815, 101319, 131823, 162327, 192831 |
| 2792 | ACR15568 | 2792 | 33296 | 63800, 94304, 124808, 155312, 185816 | 9808 | AGB13450 | 9808 | 40312 | 70816, 101320, 131824, 162328, 192832 |
| 2793 | ACR15579 | 2793 | 33297 | 63801, 94305, 124809, 155313, 185817 | 9809 | AGB13460 | 9809 | 40313 | 70817, 101321, 131825, 162329, 192833 |
| 2794 | ACR15590 | 2794 | 33298 | 63802, 94306, 124810, 155314, 185818 | 9810 | AGB13470 | 9810 | 40314 | 70818, 101322, 131826, 162330, 192834 |
| 2795 | ACR15601 | 2795 | 33299 | 63803, 94307, 124811, 155315, 185819 | 9811 | AGB13480 | 9811 | 40315 | 70819, 101323, 131827, 162331, 192835 |
| 2796 | ACR18920 | 2796 | 33300 | 63804, 94308, 124812, 155316, 185820 | 9812 | AGB13490 | 9812 | 40316 | 70820, 101324, 131828, 162332, 192836 |
| 2797 | ACR18975 | 2797 | 33301 | 63805, 94309, 124813, 155317, 185821 | 9813 | AGB13500 | 9813 | 40317 | 70821, 101325, 131829, 162333, 192837 |
| 2798 | ACR18976 | 2798 | 33302 | 63806, 94310, 124814, 155318, 185822 | 9814 | AGB13520 | 9814 | 40318 | 70822, 101326, 131830, 162334, 192838 |
| 2799 | ACR18977 | 2799 | 33303 | 63807, 94311, 124815, 155319, 185823 | 9815 | AGB13530 | 9815 | 40319 | 70823, 101327, 131831, 162335, 192839 |
| 2800 | ACR18978 | 2800 | 33304 | 63808, 94312, 124816, 155320, 185824 | 9816 | AGB13540 | 9816 | 40320 | 70824, 101328, 131832, 162336, 192840 |
| 2801 | ACR18979 | 2801 | 33305 | 63809, 94313, 124817, 155321, 185825 | 9817 | AGB13550 | 9817 | 40321 | 70825, 101329, 131833, 162337, 192841 |

FIG. 1 continued

| | | | | | | | | | |
|---|---|---|---|---|---|---|---|---|---|
| 2802 | ACR18981 | 2802 | 33306 | 63810, 94314, 124818, 155322, 185826 | 9818 | AGB13560 | 9818 | 40322 | 70826, 101330, 131834, 162338, 192842 |
| 2803 | ACR18982 | 2803 | 33307 | 63811, 94315, 124819, 155323, 185827 | 9819 | AGB13570 | 9819 | 40323 | 70827, 101331, 131835, 162339, 192843 |
| 2804 | ACR18988 | 2804 | 33308 | 63812, 94316, 124820, 155324, 185828 | 9820 | AGB13580 | 9820 | 40324 | 70828, 101332, 131836, 162340, 192844 |
| 2805 | ACR18991 | 2805 | 33309 | 63813, 94317, 124821, 155325, 185829 | 9821 | AGB13590 | 9821 | 40325 | 70829, 101333, 131837, 162341, 192845 |
| 2806 | ACR18993 | 2806 | 33310 | 63814, 94318, 124822, 155326, 185830 | 9822 | AGB13600 | 9822 | 40326 | 70830, 101334, 131838, 162342, 192846 |
| 2807 | ACR18995 | 2807 | 33311 | 63815, 94319, 124823, 155327, 185831 | 9823 | AGB13610 | 9823 | 40327 | 70831, 101335, 131839, 162343, 192847 |
| 2808 | ACR23302 | 2808 | 33312 | 63816, 94320, 124824, 155328, 185832 | 9824 | AGB13620 | 9824 | 40328 | 70832, 101336, 131840, 162344, 192848 |
| 2809 | ACR33743 | 2809 | 33313 | 63817, 94321, 124825, 155329, 185833 | 9825 | AGB13630 | 9825 | 40329 | 70833, 101337, 131841, 162345, 192849 |
| 2810 | ACR38821 | 2810 | 33314 | 63818, 94322, 124826, 155330, 185834 | 9826 | AGB13640 | 9826 | 40330 | 70834, 101338, 131842, 162346, 192850 |
| 2811 | ACR38822 | 2811 | 33315 | 63819, 94323, 124827, 155331, 185835 | 9827 | AGB13650 | 9827 | 40331 | 70835, 101339, 131843, 162347, 192851 |
| 2812 | ACR38823 | 2812 | 33316 | 63820, 94324, 124828, 155332, 185836 | 9828 | AGB13660 | 9828 | 40332 | 70836, 101340, 131844, 162348, 192852 |
| 2813 | ACR38824 | 2813 | 33317 | 63821, 94325, 124829, 155333, 185837 | 9829 | AGB13721 | 9829 | 40333 | 70837, 101341, 131845, 162349, 192853 |
| 2814 | ACR38825 | 2814 | 33318 | 63822, 94326, 124830, 155334, 185838 | 9830 | AGB13731 | 9830 | 40334 | 70838, 101342, 131846, 162350, 192854 |
| 2815 | ACR38826 | 2815 | 33319 | 63823, 94327, 124831, 155335, 185839 | 9831 | AGB51356 | 9831 | 40335 | 70839, 101343, 131847, 162351, 192855 |
| 2816 | ACR38827 | 2816 | 33320 | 63824, 94328, 124832, 155336, 185840 | 9832 | AGB97269 | 9832 | 40336 | 70840, 101344, 131848, 162352, 192856 |
| 2817 | ACR38828 | 2817 | 33321 | 63825, 94329, 124833, 155337, 185841 | 9833 | AGB97273 | 9833 | 40337 | 70841, 101345, 131849, 162353, 192857 |
| 2818 | ACR38829 | 2818 | 33322 | 63826, 94330, 124834, 155338, 185842 | 9834 | AGB97288 | 9834 | 40338 | 70842, 101346, 131850, 162354, 192858 |
| 2819 | ACR38830 | 2819 | 33323 | 63827, 94331, 124835, 155339, 185843 | 9835 | AGB97292 | 9835 | 40339 | 70843, 101347, 131851, 162355, 192859 |

FIG. 1 continued

| | | | | | | | | | |
|---|---|---|---|---|---|---|---|---|---|
| 2820 | ACR39354 | 2820 | 33324 | 63828, 94332, 124836, 155340, 185844 | 9836 | AGB97300 | 9836 | 40340 | 70844, 101348, 131852, 162356, 192860 |
| 2821 | ACR39393 | 2821 | 33325 | 63829, 94333, 124837, 155341, 185845 | 9837 | AGE89267 | 9837 | 40341 | 70845, 101349, 131853, 162357, 192861 |
| 2822 | ACR39403 | 2822 | 33326 | 63830, 94334, 124838, 155342, 185846 | 9838 | AGE89277 | 9838 | 40342 | 70846, 101350, 131854, 162358, 192862 |
| 2823 | ACR39413 | 2823 | 33327 | 63831, 94335, 124839, 155343, 185847 | 9839 | AGE89287 | 9839 | 40343 | 70847, 101351, 131855, 162359, 192863 |
| 2824 | ACR39423 | 2824 | 33328 | 63832, 94336, 124840, 155344, 185848 | 9840 | AGE89298 | 9840 | 40344 | 70848, 101352, 131856, 162360, 192864 |
| 2825 | ACR39433 | 2825 | 33329 | 63833, 94337, 124841, 155345, 185849 | 9841 | AGE89308 | 9841 | 40345 | 70849, 101353, 131857, 162361, 192865 |
| 2826 | ACR39443 | 2826 | 33330 | 63834, 94338, 124842, 155346, 185850 | 9842 | AGE89318 | 9842 | 40346 | 70850, 101354, 131858, 162362, 192866 |
| 2827 | ACR39453 | 2827 | 33331 | 63835, 94339, 124843, 155347, 185851 | 9843 | AGE89329 | 9843 | 40347 | 70851, 101355, 131859, 162363, 192867 |
| 2828 | ACR39463 | 2828 | 33332 | 63836, 94340, 124844, 155348, 185852 | 9844 | AGE89340 | 9844 | 40348 | 70852, 101356, 131860, 162364, 192868 |
| 2829 | ACR39473 | 2829 | 33333 | 63837, 94341, 124845, 155349, 185853 | 9845 | AGE89350 | 9845 | 40349 | 70853, 101357, 131861, 162365, 192869 |
| 2830 | ACR39483 | 2830 | 33334 | 63838, 94342, 124846, 155350, 185854 | 9846 | AGE89361 | 9846 | 40350 | 70854, 101358, 131862, 162366, 192870 |
| 2831 | ACR39493 | 2831 | 33335 | 63839, 94343, 124847, 155351, 185855 | 9847 | AGE89371 | 9847 | 40351 | 70855, 101359, 131863, 162367, 192871 |
| 2832 | ACR40288 | 2832 | 33336 | 63840, 94344, 124848, 155352, 185856 | 9848 | AGE89382 | 9848 | 40352 | 70856, 101360, 131864, 162368, 192872 |
| 2833 | ACR40298 | 2833 | 33337 | 63841, 94345, 124849, 155353, 185857 | 9849 | AGE89392 | 9849 | 40353 | 70857, 101361, 131865, 162369, 192873 |
| 2834 | ACR40308 | 2834 | 33338 | 63842, 94346, 124850, 155354, 185858 | 9850 | AGE89422 | 9850 | 40354 | 70858, 101362, 131866, 162370, 192874 |
| 2835 | ACR40318 | 2835 | 33339 | 63843, 94347, 124851, 155355, 185859 | 9851 | AGE89719 | 9851 | 40355 | 70859, 101363, 131867, 162371, 192875 |
| 2836 | ACR40328 | 2836 | 33340 | 63844, 94348, 124852, 155356, 185860 | 9852 | AGE89730 | 9852 | 40356 | 70860, 101364, 131868, 162372, 192876 |
| 2837 | ACR40338 | 2837 | 33341 | 63845, 94349, 124853, 155357, 185861 | 9853 | AGE89740 | 9853 | 40357 | 70861, 101365, 131869, 162373, 192877 |

FIG. 1 continued

| | | | | | | | | | |
|---|---|---|---|---|---|---|---|---|---|
| 2838 | ACR40348 | 2838 | 33342 | 63846, 94350, 124854, 155358, 185862 | 9854 | AGE89751 | 9854 | 40358 | 70862, 101366, 131870, 162374, 192878 |
| 2839 | ACR40358 | 2839 | 33343 | 63847, 94351, 124855, 155359, 185863 | 9855 | AGE89762 | 9855 | 40359 | 70863, 101367, 131871, 162375, 192879 |
| 2840 | ACR40378 | 2840 | 33344 | 63848, 94352, 124856, 155360, 185864 | 9856 | AGF44891 | 9856 | 40360 | 70864, 101368, 131872, 162376, 192880 |
| 2841 | ACR40388 | 2841 | 33345 | 63849, 94353, 124857, 155361, 185865 | 9857 | AGF44892 | 9857 | 40361 | 70865, 101369, 131873, 162377, 192881 |
| 2842 | ACR46986 | 2842 | 33346 | 63850, 94354, 124858, 155362, 185866 | 9858 | AGF44895 | 9858 | 40362 | 70866, 101370, 131874, 162378, 192882 |
| 2843 | ACR46988 | 2843 | 33347 | 63851, 94355, 124859, 155363, 185867 | 9859 | AGF44896 | 9859 | 40363 | 70867, 101371, 131875, 162379, 192883 |
| 2844 | ACR46989 | 2844 | 33348 | 63852, 94356, 124860, 155364, 185868 | 9860 | AGF44897 | 9860 | 40364 | 70868, 101372, 131876, 162380, 192884 |
| 2845 | ACR46990 | 2845 | 33349 | 63853, 94357, 124861, 155365, 185869 | 9861 | AGF44900 | 9861 | 40365 | 70869, 101373, 131877, 162381, 192885 |
| 2846 | ACR46992 | 2846 | 33350 | 63854, 94358, 124862, 155366, 185870 | 9862 | AGF44901 | 9862 | 40366 | 70870, 101374, 131878, 162382, 192886 |
| 2847 | ACR46993 | 2847 | 33351 | 63855, 94359, 124863, 155367, 185871 | 9863 | AGF44902 | 9863 | 40367 | 70871, 101375, 131879, 162383, 192887 |
| 2848 | ACR46994 | 2848 | 33352 | 63856, 94360, 124864, 155368, 185872 | 9864 | AGF44903 | 9864 | 40368 | 70872, 101376, 131880, 162384, 192888 |
| 2849 | ACR47006 | 2849 | 33353 | 63857, 94361, 124865, 155369, 185873 | 9865 | AGF44904 | 9865 | 40369 | 70873, 101377, 131881, 162385, 192889 |
| 2850 | ACR49281 | 2850 | 33354 | 63858, 94362, 124866, 155370, 185874 | 9866 | AGF44905 | 9866 | 40370 | 70874, 101378, 131882, 162386, 192890 |
| 2851 | ACR49282 | 2851 | 33355 | 63859, 94363, 124867, 155371, 185875 | 9867 | AGF44906 | 9867 | 40371 | 70875, 101379, 131883, 162387, 192891 |
| 2852 | ACR49283 | 2852 | 33356 | 63860, 94364, 124868, 155372, 185876 | 9868 | AGF44908 | 9868 | 40372 | 70876, 101380, 131884, 162388, 192892 |
| 2853 | ACR49288 | 2853 | 33357 | 63861, 94365, 124869, 155373, 185877 | 9869 | AGF44909 | 9869 | 40373 | 70877, 101381, 131885, 162389, 192893 |
| 2854 | ACR49290 | 2854 | 33358 | 63862, 94366, 124870, 155374, 185878 | 9870 | AGF44910 | 9870 | 40374 | 70878, 101382, 131886, 162390, 192894 |
| 2855 | ACR49291 | 2855 | 33359 | 63863, 94367, 124871, 155375, 185879 | 9871 | AGF44911 | 9871 | 40375 | 70879, 101383, 131887, 162391, 192895 |

FIG. 1 continued

| | | | | | | | | | |
|---|---|---|---|---|---|---|---|---|---|
| 2856 | ACR49293 | 2856 | 33360 | 63864, 94368, 124872, 155376, 185880 | 9872 | AGF44912 | 9872 | 40376 | 70880, 101384, 131888, 162392, 192896 |
| 2857 | ACR49295 | 2857 | 33361 | 63865, 94369, 124873, 155377, 185881 | 9873 | AGF44913 | 9873 | 40377 | 70881, 101385, 131889, 162393, 192897 |
| 2858 | ACR50993 | 2858 | 33362 | 63866, 94370, 124874, 155378, 185882 | 9874 | AGF44914 | 9874 | 40378 | 70882, 101386, 131890, 162394, 192898 |
| 2859 | ACR50995 | 2859 | 33363 | 63867, 94371, 124875, 155379, 185883 | 9875 | AGF44916 | 9875 | 40379 | 70883, 101387, 131891, 162395, 192899 |
| 2860 | ACR51005 | 2860 | 33364 | 63868, 94372, 124876, 155380, 185884 | 9876 | AGF44917 | 9876 | 40380 | 70884, 101388, 131892, 162396, 192900 |
| 2861 | ACR51015 | 2861 | 33365 | 63869, 94373, 124877, 155381, 185885 | 9877 | AGF44918 | 9877 | 40381 | 70885, 101389, 131893, 162397, 192901 |
| 2862 | ACR51025 | 2862 | 33366 | 63870, 94374, 124878, 155382, 185886 | 9878 | AGF44919 | 9878 | 40382 | 70886, 101390, 131894, 162398, 192902 |
| 2863 | ACR51035 | 2863 | 33367 | 63871, 94375, 124879, 155383, 185887 | 9879 | AGF44920 | 9879 | 40383 | 70887, 101391, 131895, 162399, 192903 |
| 2864 | ACR51045 | 2864 | 33368 | 63872, 94376, 124880, 155384, 185888 | 9880 | AGF44921 | 9880 | 40384 | 70888, 101392, 131896, 162400, 192904 |
| 2865 | ACR51055 | 2865 | 33369 | 63873, 94377, 124881, 155385, 185889 | 9881 | AGG13411 | 9881 | 40385 | 70889, 101393, 131897, 162401, 192905 |
| 2866 | ACR51065 | 2866 | 33370 | 63874, 94378, 124882, 155386, 185890 | 9882 | AGG13447 | 9882 | 40386 | 70890, 101394, 131898, 162402, 192906 |
| 2867 | ACR52368 | 2867 | 33371 | 63875, 94379, 124883, 155387, 185891 | 9883 | AGG13459 | 9883 | 40387 | 70891, 101395, 131899, 162403, 192907 |
| 2868 | ACR52378 | 2868 | 33372 | 63876, 94380, 124884, 155388, 185892 | 9884 | AGG13495 | 9884 | 40388 | 70892, 101396, 131900, 162404, 192908 |
| 2869 | ACR52398 | 2869 | 33373 | 63877, 94381, 124885, 155389, 185893 | 9885 | AGG13507 | 9885 | 40389 | 70893, 101397, 131901, 162405, 192909 |
| 2870 | ACR52408 | 2870 | 33374 | 63878, 94382, 124886, 155390, 185894 | 9886 | AGG13519 | 9886 | 40390 | 70894, 101398, 131902, 162406, 192910 |
| 2871 | ACR52418 | 2871 | 33375 | 63879, 94383, 124887, 155391, 185895 | 9887 | AGG13531 | 9887 | 40391 | 70895, 101399, 131903, 162407, 192911 |
| 2872 | ACR52428 | 2872 | 33376 | 63880, 94384, 124888, 155392, 185896 | 9888 | AGG13543 | 9888 | 40392 | 70896, 101400, 131904, 162408, 192912 |
| 2873 | ACR52438 | 2873 | 33377 | 63881, 94385, 124889, 155393, 185897 | 9889 | AGG13555 | 9889 | 40393 | 70897, 101401, 131905, 162409, 192913 |

FIG. 1 continued

| | | | | | | | | | |
|---|---|---|---|---|---|---|---|---|---|
| 2874 | ACR52448 | 2874 | 33378 | 63882, 94386, 124890, 155394, 185898 | 9890 | AGG13567 | 9890 | 40394 | 70898, 101402, 131906, 162410, 192914 |
| 2875 | ACR52458 | 2875 | 33379 | 63883, 94387, 124891, 155395, 185899 | 9891 | AGG13591 | 9891 | 40395 | 70899, 101403, 131907, 162411, 192915 |
| 2876 | ACR52468 | 2876 | 33380 | 63884, 94388, 124892, 155396, 185900 | 9892 | AGG13615 | 9892 | 40396 | 70900, 101404, 131908, 162412, 192916 |
| 2877 | ACR52478 | 2877 | 33381 | 63885, 94389, 124893, 155397, 185901 | 9893 | AGG13627 | 9893 | 40397 | 70901, 101405, 131909, 162413, 192917 |
| 2878 | ACR52488 | 2878 | 33382 | 63886, 94390, 124894, 155398, 185902 | 9894 | AGG13639 | 9894 | 40398 | 70902, 101406, 131910, 162414, 192918 |
| 2879 | ACR54045 | 2879 | 33383 | 63887, 94391, 124895, 155399, 185903 | 9895 | AGG13651 | 9895 | 40399 | 70903, 101407, 131911, 162415, 192919 |
| 2880 | ACR54047 | 2880 | 33384 | 63888, 94392, 124896, 155400, 185904 | 9896 | AGG13663 | 9896 | 40400 | 70904, 101408, 131912, 162416, 192920 |
| 2881 | ACR54964 | 2881 | 33385 | 63889, 94393, 124897, 155401, 185905 | 9897 | AGG13675 | 9897 | 40401 | 70905, 101409, 131913, 162417, 192921 |
| 2882 | ACR54974 | 2882 | 33386 | 63890, 94394, 124898, 155402, 185906 | 9898 | AGG13687 | 9898 | 40402 | 70906, 101410, 131914, 162418, 192922 |
| 2883 | ACR54984 | 2883 | 33387 | 63891, 94395, 124899, 155403, 185907 | 9899 | AGG13711 | 9899 | 40403 | 70907, 101411, 131915, 162419, 192923 |
| 2884 | ACR54994 | 2884 | 33388 | 63892, 94396, 124900, 155404, 185908 | 9900 | AGG13723 | 9900 | 40404 | 70908, 101412, 131916, 162420, 192924 |
| 2885 | ACR55004 | 2885 | 33389 | 63893, 94397, 124901, 155405, 185909 | 9901 | AGG13735 | 9901 | 40405 | 70909, 101413, 131917, 162421, 192925 |
| 2886 | ACR56380 | 2886 | 33390 | 63894, 94398, 124902, 155406, 185910 | 9902 | AGG13747 | 9902 | 40406 | 70910, 101414, 131918, 162422, 192926 |
| 2887 | ACR56390 | 2887 | 33391 | 63895, 94399, 124903, 155407, 185911 | 9903 | AGG13759 | 9903 | 40407 | 70911, 101415, 131919, 162423, 192927 |
| 2888 | ACR56400 | 2888 | 33392 | 63896, 94400, 124904, 155408, 185912 | 9904 | AGG13771 | 9904 | 40408 | 70912, 101416, 131920, 162424, 192928 |
| 2889 | ACR56410 | 2889 | 33393 | 63897, 94401, 124905, 155409, 185913 | 9905 | AGG13783 | 9905 | 40409 | 70913, 101417, 131921, 162425, 192929 |
| 2890 | ACR56420 | 2890 | 33394 | 63898, 94402, 124906, 155410, 185914 | 9906 | AGG13795 | 9906 | 40410 | 70914, 101418, 131922, 162426, 192930 |
| 2891 | ACR56430 | 2891 | 33395 | 63899, 94403, 124907, 155411, 185915 | 9907 | AGG13807 | 9907 | 40411 | 70915, 101419, 131923, 162427, 192931 |

FIG. 1 continued

| | | | | | | | | | |
|---|---|---|---|---|---|---|---|---|---|
| 2892 | ACR56440 | 2892 | 33396 | 63900, 94404, 124908, 155412, 185916 | 9908 | AGG13819 | 9908 | 40412 | 70916, 101420, 131924, 162428, 192932 |
| 2893 | ACR58541 | 2893 | 33397 | 63901, 94405, 124909, 155413, 185917 | 9909 | AGG13831 | 9909 | 40413 | 70917, 101421, 131925, 162429, 192933 |
| 2894 | ACR61655 | 2894 | 33398 | 63902, 94406, 124910, 155414, 185918 | 9910 | AGG13855 | 9910 | 40414 | 70918, 101422, 131926, 162430, 192934 |
| 2895 | ACR61666 | 2895 | 33399 | 63903, 94407, 124911, 155415, 185919 | 9911 | AGG13867 | 9911 | 40415 | 70919, 101423, 131927, 162431, 192935 |
| 2896 | ACR61677 | 2896 | 33400 | 63904, 94408, 124912, 155416, 185920 | 9912 | AGG13879 | 9912 | 40416 | 70920, 101424, 131928, 162432, 192936 |
| 2897 | ACR61688 | 2897 | 33401 | 63905, 94409, 124913, 155417, 185921 | 9913 | AGG13891 | 9913 | 40417 | 70921, 101425, 131929, 162433, 192937 |
| 2898 | ACR61699 | 2898 | 33402 | 63906, 94410, 124914, 155418, 185922 | 9914 | AGG13903 | 9914 | 40418 | 70922, 101426, 131930, 162434, 192938 |
| 2899 | ACR67170 | 2899 | 33403 | 63907, 94411, 124915, 155419, 185923 | 9915 | AGG13927 | 9915 | 40419 | 70923, 101427, 131931, 162435, 192939 |
| 2900 | ACR67171 | 2900 | 33404 | 63908, 94412, 124916, 155420, 185924 | 9916 | AGG13939 | 9916 | 40420 | 70924, 101428, 131932, 162436, 192940 |
| 2901 | ACR67172 | 2901 | 33405 | 63909, 94413, 124917, 155421, 185925 | 9917 | AGG13962 | 9917 | 40421 | 70925, 101429, 131933, 162437, 192941 |
| 2902 | ACR67177 | 2902 | 33406 | 63910, 94414, 124918, 155422, 185926 | 9918 | AGG13973 | 9918 | 40422 | 70926, 101430, 131934, 162438, 192942 |
| 2903 | ACR67181 | 2903 | 33407 | 63911, 94415, 124919, 155423, 185927 | 9919 | AGG13985 | 9919 | 40423 | 70927, 101431, 131935, 162439, 192943 |
| 2904 | ACR67183 | 2904 | 33408 | 63912, 94416, 124920, 155424, 185928 | 9920 | AGG13997 | 9920 | 40424 | 70928, 101432, 131936, 162440, 192944 |
| 2905 | ACR67184 | 2905 | 33409 | 63913, 94417, 124921, 155425, 185929 | 9921 | AGG14009 | 9921 | 40425 | 70929, 101433, 131937, 162441, 192945 |
| 2906 | ACR67185 | 2906 | 33410 | 63914, 94418, 124922, 155426, 185930 | 9922 | AGG14021 | 9922 | 40426 | 70930, 101434, 131938, 162442, 192946 |
| 2907 | ACR67186 | 2907 | 33411 | 63915, 94419, 124923, 155427, 185931 | 9923 | AGG14033 | 9923 | 40427 | 70931, 101435, 131939, 162443, 192947 |
| 2908 | ACR67187 | 2908 | 33412 | 63916, 94420, 124924, 155428, 185932 | 9924 | AGG14318 | 9924 | 40428 | 70932, 101436, 131940, 162444, 192948 |
| 2909 | ACR67188 | 2909 | 33413 | 63917, 94421, 124925, 155429, 185933 | 9925 | AGG14330 | 9925 | 40429 | 70933, 101437, 131941, 162445, 192949 |

FIG. 1 continued

| | | | | | | | | | |
|---|---|---|---|---|---|---|---|---|---|
| 2910 | ACR67189 | 2910 | 33414 | 63918, 94422, 124926, 155430, 185934 | 9926 | AGG84179 | 9926 | 40430 | 70934, 101438, 131942, 162446, 192950 |
| 2911 | ACR67190 | 2911 | 33415 | 63919, 94423, 124927, 155431, 185935 | 9927 | AGI02564 | 9927 | 40431 | 70935, 101439, 131943, 162447, 192951 |
| 2912 | ACR67192 | 2912 | 33416 | 63920, 94424, 124928, 155432, 185936 | 9928 | AGI02565 | 9928 | 40432 | 70936, 101440, 131944, 162448, 192952 |
| 2913 | ACR67193 | 2913 | 33417 | 63921, 94425, 124929, 155433, 185937 | 9929 | AGI02566 | 9929 | 40433 | 70937, 101441, 131945, 162449, 192953 |
| 2914 | ACR67195 | 2914 | 33418 | 63922, 94426, 124930, 155434, 185938 | 9930 | AGI02567 | 9930 | 40434 | 70938, 101442, 131946, 162450, 192954 |
| 2915 | ACR67197 | 2915 | 33419 | 63923, 94427, 124931, 155435, 185939 | 9931 | AGI02568 | 9931 | 40435 | 70939, 101443, 131947, 162451, 192955 |
| 2916 | ACR67198 | 2916 | 33420 | 63924, 94428, 124932, 155436, 185940 | 9932 | AGI60301 | 9932 | 40436 | 70940, 101444, 131948, 162452, 192956 |
| 2917 | ACR67199 | 2917 | 33421 | 63925, 94429, 124933, 155437, 185941 | 9933 | AGJ72861 | 9933 | 40437 | 70941, 101445, 131949, 162453, 192957 |
| 2918 | ACR67244 | 2918 | 33422 | 63926, 94430, 124934, 155438, 185942 | 9934 | AGJ73327 | 9934 | 40438 | 70942, 101446, 131950, 162454, 192958 |
| 2919 | ACR67254 | 2919 | 33423 | 63927, 94431, 124935, 155439, 185943 | 9935 | AGJ73329 | 9935 | 40439 | 70943, 101447, 131951, 162455, 192959 |
| 2920 | ACR77438 | 2920 | 33424 | 63928, 94432, 124936, 155440, 185944 | 9936 | AGJ73331 | 9936 | 40440 | 70944, 101448, 131952, 162456, 192960 |
| 2921 | ACR77448 | 2921 | 33425 | 63929, 94433, 124937, 155441, 185945 | 9937 | AGJ73333 | 9937 | 40441 | 70945, 101449, 131953, 162457, 192961 |
| 2922 | ACR77458 | 2922 | 33426 | 63930, 94434, 124938, 155442, 185946 | 9938 | AGJ73335 | 9938 | 40442 | 70946, 101450, 131954, 162458, 192962 |
| 2923 | ACR77468 | 2923 | 33427 | 63931, 94435, 124939, 155443, 185947 | 9939 | AGJ73337 | 9939 | 40443 | 70947, 101451, 131955, 162459, 192963 |
| 2924 | ACR77478 | 2924 | 33428 | 63932, 94436, 124940, 155444, 185948 | 9940 | AGJ73339 | 9940 | 40444 | 70948, 101452, 131956, 162460, 192964 |
| 2925 | ACR77488 | 2925 | 33429 | 63933, 94437, 124941, 155445, 185949 | 9941 | AGJ73341 | 9941 | 40445 | 70949, 101453, 131957, 162461, 192965 |
| 2926 | ACR77498 | 2926 | 33430 | 63934, 94438, 124942, 155446, 185950 | 9942 | AGJ73343 | 9942 | 40446 | 70950, 101454, 131958, 162462, 192966 |
| 2927 | ACR83525 | 2927 | 33431 | 63935, 94439, 124943, 155447, 185951 | 9943 | AGJ73345 | 9943 | 40447 | 70951, 101455, 131959, 162463, 192967 |

FIG. 1 continued

| | | | | | | | | | |
|---|---|---|---|---|---|---|---|---|---|
| 2928 | ACR83538 | 2928 | 33432 | 63936, 94440, 124944, 155448, 185952 | 9944 | AGJ73347 | 9944 | 40448 | 70952, 101456, 131960, 162464, 192968 |
| 2929 | ACS14666 | 2929 | 33433 | 63937, 94441, 124945, 155449, 185953 | 9945 | AGJ73349 | 9945 | 40449 | 70953, 101457, 131961, 162465, 192969 |
| 2930 | ACS14676 | 2930 | 33434 | 63938, 94442, 124946, 155450, 185954 | 9946 | AGJ73351 | 9946 | 40450 | 70954, 101458, 131962, 162466, 192970 |
| 2931 | ACS14686 | 2931 | 33435 | 63939, 94443, 124947, 155451, 185955 | 9947 | AGJ73353 | 9947 | 40451 | 70955, 101459, 131963, 162467, 192971 |
| 2932 | ACS14696 | 2932 | 33436 | 63940, 94444, 124948, 155452, 185956 | 9948 | AGJ73355 | 9948 | 40452 | 70956, 101460, 131964, 162468, 192972 |
| 2933 | ACS14706 | 2933 | 33437 | 63941, 94445, 124949, 155453, 185957 | 9949 | AGJ73357 | 9949 | 40453 | 70957, 101461, 131965, 162469, 192973 |
| 2934 | ACS14716 | 2934 | 33438 | 63942, 94446, 124950, 155454, 185958 | 9950 | AGJ73361 | 9950 | 40454 | 70958, 101462, 131966, 162470, 192974 |
| 2935 | ACS14726 | 2935 | 33439 | 63943, 94447, 124951, 155455, 185959 | 9951 | AGJ73363 | 9951 | 40455 | 70959, 101463, 131967, 162471, 192975 |
| 2936 | ACS14736 | 2936 | 33440 | 63944, 94448, 124952, 155456, 185960 | 9952 | AGJ73365 | 9952 | 40456 | 70960, 101464, 131968, 162472, 192976 |
| 2937 | ACS27189 | 2937 | 33441 | 63945, 94449, 124953, 155457, 185961 | 9953 | AGJ73367 | 9953 | 40457 | 70961, 101465, 131969, 162473, 192977 |
| 2938 | ACS27199 | 2938 | 33442 | 63946, 94450, 124954, 155458, 185962 | 9954 | AGJ73369 | 9954 | 40458 | 70962, 101466, 131970, 162474, 192978 |
| 2939 | ACS27209 | 2939 | 33443 | 63947, 94451, 124955, 155459, 185963 | 9955 | AGJ73371 | 9955 | 40459 | 70963, 101467, 131971, 162475, 192979 |
| 2940 | ACS27219 | 2940 | 33444 | 63948, 94452, 124956, 155460, 185964 | 9956 | AGJ73373 | 9956 | 40460 | 70964, 101468, 131972, 162476, 192980 |
| 2941 | ACS27229 | 2941 | 33445 | 63949, 94453, 124957, 155461, 185965 | 9957 | AGJ73375 | 9957 | 40461 | 70965, 101469, 131973, 162477, 192981 |
| 2942 | ACS27239 | 2942 | 33446 | 63950, 94454, 124958, 155462, 185966 | 9958 | AGJ73377 | 9958 | 40462 | 70966, 101470, 131974, 162478, 192982 |
| 2943 | ACS27249 | 2943 | 33447 | 63951, 94455, 124959, 155463, 185967 | 9959 | AGJ73380 | 9959 | 40463 | 70967, 101471, 131975, 162479, 192983 |
| 2944 | ACS27775 | 2944 | 33448 | 63952, 94456, 124960, 155464, 185968 | 9960 | AGK62991 | 9960 | 40464 | 70968, 101472, 131976, 162480, 192984 |
| 2945 | ACS34705 | 2945 | 33449 | 63953, 94457, 124961, 155465, 185969 | 9961 | AGK62993 | 9961 | 40465 | 70969, 101473, 131977, 162481, 192985 |

FIG. 1 continued

| | | | | | | | | | |
|---|---|---|---|---|---|---|---|---|---|
| 2946 | ACS34966 | 2946 | 33450 | 63954, 94458, 124962, 155466, 185970 | 9962 | AGK62995 | 9962 | 40466 | 70970, 101474, 131978, 162482, 192986 |
| 2947 | ACS34967 | 2947 | 33451 | 63955, 94459, 124963, 155467, 185971 | 9963 | AGK62997 | 9963 | 40467 | 70971, 101475, 131979, 162483, 192987 |
| 2948 | ACS34968 | 2948 | 33452 | 63956, 94460, 124964, 155468, 185972 | 9964 | AGK62999 | 9964 | 40468 | 70972, 101476, 131980, 162484, 192988 |
| 2949 | ACS36632 | 2949 | 33453 | 63957, 94461, 124965, 155469, 185973 | 9965 | AGK63001 | 9965 | 40469 | 70973, 101477, 131981, 162485, 192989 |
| 2950 | ACS36645 | 2950 | 33454 | 63958, 94462, 124966, 155470, 185974 | 9966 | AGK63003 | 9966 | 40470 | 70974, 101478, 131982, 162486, 192990 |
| 2951 | ACS45035 | 2951 | 33455 | 63959, 94463, 124967, 155471, 185975 | 9967 | AGK63005 | 9967 | 40471 | 70975, 101479, 131983, 162487, 192991 |
| 2952 | ACS50084 | 2952 | 33456 | 63960, 94464, 124968, 155472, 185976 | 9968 | AGK63007 | 9968 | 40472 | 70976, 101480, 131984, 162488, 192992 |
| 2953 | ACS50095 | 2953 | 33457 | 63961, 94465, 124969, 155473, 185977 | 9969 | AGK63009 | 9969 | 40473 | 70977, 101481, 131985, 162489, 192993 |
| 2954 | ACS54258 | 2954 | 33458 | 63962, 94466, 124970, 155474, 185978 | 9970 | AGK63011 | 9970 | 40474 | 70978, 101482, 131986, 162490, 192994 |
| 2955 | ACS54259 | 2955 | 33459 | 63963, 94467, 124971, 155475, 185979 | 9971 | AGK63013 | 9971 | 40475 | 70979, 101483, 131987, 162491, 192995 |
| 2956 | ACS54260 | 2956 | 33460 | 63964, 94468, 124972, 155476, 185980 | 9972 | AGK63015 | 9972 | 40476 | 70980, 101484, 131988, 162492, 192996 |
| 2957 | ACS54261 | 2957 | 33461 | 63965, 94469, 124973, 155477, 185981 | 9973 | AGK63017 | 9973 | 40477 | 70981, 101485, 131989, 162493, 192997 |
| 2958 | ACS54263 | 2958 | 33462 | 63966, 94470, 124974, 155478, 185982 | 9974 | AGK63019 | 9974 | 40478 | 70982, 101486, 131990, 162494, 192998 |
| 2959 | ACS54301 | 2959 | 33463 | 63967, 94471, 124975, 155479, 185983 | 9975 | AGK63021 | 9975 | 40479 | 70983, 101487, 131991, 162495, 192999 |
| 2960 | ACS66821 | 2960 | 33464 | 63968, 94472, 124976, 155480, 185984 | 9976 | AGK63025 | 9976 | 40480 | 70984, 101488, 131992, 162496, 193000 |
| 2961 | ACS68822 | 2961 | 33465 | 63969, 94473, 124977, 155481, 185985 | 9977 | AGK63027 | 9977 | 40481 | 70985, 101489, 131993, 162497, 193001 |
| 2962 | ACS75821 | 2962 | 33466 | 63970, 94474, 124978, 155482, 185986 | 9978 | AGK63029 | 9978 | 40482 | 70986, 101490, 131994, 162498, 193002 |
| 2963 | ACS77926 | 2963 | 33467 | 63971, 94475, 124979, 155483, 185987 | 9979 | AGK63031 | 9979 | 40483 | 70987, 101491, 131995, 162499, 193003 |

FIG. 1 continued

| | | | | | | | | | |
|---|---|---|---|---|---|---|---|---|---|
| 2964 | ACS77936 | 2964 | 33468 | 63972, 94476, 124980, 155484, 185988 | 9980 | AGK63033 | 9980 | 40484 | 70988, 101492, 131996, 162500, 193004 |
| 2965 | ACS77946 | 2965 | 33469 | 63973, 94477, 124981, 155485, 185989 | 9981 | AGK63035 | 9981 | 40485 | 70989, 101493, 131997, 162501, 193005 |
| 2966 | ACS77956 | 2966 | 33470 | 63974, 94478, 124982, 155486, 185990 | 9982 | AGK63037 | 9982 | 40486 | 70990, 101494, 131998, 162502, 193006 |
| 2967 | ACS77966 | 2967 | 33471 | 63975, 94479, 124983, 155487, 185991 | 9983 | AGK63039 | 9983 | 40487 | 70991, 101495, 131999, 162503, 193007 |
| 2968 | ACS77976 | 2968 | 33472 | 63976, 94480, 124984, 155488, 185992 | 9984 | AGK63041 | 9984 | 40488 | 70992, 101496, 132000, 162504, 193008 |
| 2969 | ACS77986 | 2969 | 33473 | 63977, 94481, 124985, 155489, 185993 | 9985 | AGK63043 | 9985 | 40489 | 70993, 101497, 132001, 162505, 193009 |
| 2970 | ACS77996 | 2970 | 33474 | 63978, 94482, 124986, 155490, 185994 | 9986 | AGK63045 | 9986 | 40490 | 70994, 101498, 132002, 162506, 193010 |
| 2971 | ACS78006 | 2971 | 33475 | 63979, 94483, 124987, 155491, 185995 | 9987 | AGK63047 | 9987 | 40491 | 70995, 101499, 132003, 162507, 193011 |
| 2972 | ACS78016 | 2972 | 33476 | 63980, 94484, 124988, 155492, 185996 | 9988 | AGK82158 | 9988 | 40492 | 70996, 101500, 132004, 162508, 193012 |
| 2973 | ACS78026 | 2973 | 33477 | 63981, 94485, 124989, 155493, 185997 | 9989 | AGK84857 | 9989 | 40493 | 70997, 101501, 132005, 162509, 193013 |
| 2974 | ACS78036 | 2974 | 33478 | 63982, 94486, 124990, 155494, 185998 | 9990 | AGK84860 | 9990 | 40494 | 70998, 101502, 132006, 162510, 193014 |
| 2975 | ACS78046 | 2975 | 33479 | 63983, 94487, 124991, 155495, 185999 | 9991 | AGK84863 | 9991 | 40495 | 70999, 101503, 132007, 162511, 193015 |
| 2976 | ACS92569 | 2976 | 33480 | 63984, 94488, 124992, 155496, 186000 | 9992 | AGL07713 | 9992 | 40496 | 71000, 101504, 132008, 162512, 193016 |
| 2977 | ACS92579 | 2977 | 33481 | 63985, 94489, 124993, 155497, 186001 | 9993 | AGL09731 | 9993 | 40497 | 71001, 101505, 132009, 162513, 193017 |
| 2978 | ACS92589 | 2978 | 33482 | 63986, 94490, 124994, 155498, 186002 | 9994 | AGL09732 | 9994 | 40498 | 71002, 101506, 132010, 162514, 193018 |
| 2979 | ACS92612 | 2979 | 33483 | 63987, 94491, 124995, 155499, 186003 | 9995 | AGL09734 | 9995 | 40499 | 71003, 101507, 132011, 162515, 193019 |
| 2980 | ACT10307 | 2980 | 33484 | 63988, 94492, 124996, 155500, 186004 | 9996 | AGL09735 | 9996 | 40500 | 71004, 101508, 132012, 162516, 193020 |
| 2981 | ACT10314 | 2981 | 33485 | 63989, 94493, 124997, 155501, 186005 | 9997 | AGL09736 | 9997 | 40501 | 71005, 101509, 132013, 162517, 193021 |

FIG. 1 continued

| | | | | | | | | | |
|---|---|---|---|---|---|---|---|---|---|
| 2982 | ACT11057 | 2982 | 33486 | 63990, 94494, 124998, 155502, 186006 | 9998 | AGL09737 | 9998 | 40502 | 71006, 101510, 132014, 162518, 193022 |
| 2983 | ACT15312 | 2983 | 33487 | 63991, 94495, 124999, 155503, 186007 | 9999 | AGL09739 | 9999 | 40503 | 71007, 101511, 132015, 162519, 193023 |
| 2984 | ACT15314 | 2984 | 33488 | 63992, 94496, 125000, 155504, 186008 | 10000 | AGL09740 | 10000 | 40504 | 71008, 101512, 132016, 162520, 193024 |
| 2985 | ACT15316 | 2985 | 33489 | 63993, 94497, 125001, 155505, 186009 | 10001 | AGL09741 | 10001 | 40505 | 71009, 101513, 132017, 162521, 193025 |
| 2986 | ACT15320 | 2986 | 33490 | 63994, 94498, 125002, 155506, 186010 | 10002 | AGL09742 | 10002 | 40506 | 71010, 101514, 132018, 162522, 193026 |
| 2987 | ACT15322 | 2987 | 33491 | 63995, 94499, 125003, 155507, 186011 | 10003 | AGL09744 | 10003 | 40507 | 71011, 101515, 132019, 162523, 193027 |
| 2988 | ACT15326 | 2988 | 33492 | 63996, 94500, 125004, 155508, 186012 | 10004 | AGL09745 | 10004 | 40508 | 71012, 101516, 132020, 162524, 193028 |
| 2989 | ACT15328 | 2989 | 33493 | 63997, 94501, 125005, 155509, 186013 | 10005 | AGL09746 | 10005 | 40509 | 71013, 101517, 132021, 162525, 193029 |
| 2990 | ACT15330 | 2990 | 33494 | 63998, 94502, 125006, 155510, 186014 | 10006 | AGL09747 | 10006 | 40510 | 71014, 101518, 132022, 162526, 193030 |
| 2991 | ACT15332 | 2991 | 33495 | 63999, 94503, 125007, 155511, 186015 | 10007 | AGL09748 | 10007 | 40511 | 71015, 101519, 132023, 162527, 193031 |
| 2992 | ACT15336 | 2992 | 33496 | 64000, 94504, 125008, 155512, 186016 | 10008 | AGL09749 | 10008 | 40512 | 71016, 101520, 132024, 162528, 193032 |
| 2993 | ACT15338 | 2993 | 33497 | 64001, 94505, 125009, 155513, 186017 | 10009 | AGL09750 | 10009 | 40513 | 71017, 101521, 132025, 162529, 193033 |
| 2994 | ACT15340 | 2994 | 33498 | 64002, 94506, 125010, 155514, 186018 | 10010 | AGL09751 | 10010 | 40514 | 71018, 101522, 132026, 162530, 193034 |
| 2995 | ACT15342 | 2995 | 33499 | 64003, 94507, 125011, 155515, 186019 | 10011 | AGL09753 | 10011 | 40515 | 71019, 101523, 132027, 162531, 193035 |
| 2996 | ACT15343 | 2996 | 33500 | 64004, 94508, 125012, 155516, 186020 | 10012 | AGL09754 | 10012 | 40516 | 71020, 101524, 132028, 162532, 193036 |
| 2997 | ACT15345 | 2997 | 33501 | 64005, 94509, 125013, 155517, 186021 | 10013 | AGL09756 | 10013 | 40517 | 71021, 101525, 132029, 162533, 193037 |
| 2998 | ACT15347 | 2998 | 33502 | 64006, 94510, 125014, 155518, 186022 | 10014 | AGL09758 | 10014 | 40518 | 71022, 101526, 132030, 162534, 193038 |
| 2999 | ACT15349 | 2999 | 33503 | 64007, 94511, 125015, 155519, 186023 | 10015 | AGL09760 | 10015 | 40519 | 71023, 101527, 132031, 162535, 193039 |

FIG. 1 continued

| | | | | | | | | | |
|---|---|---|---|---|---|---|---|---|---|
| 3000 | ACT15351 | 3000 | 33504 | 64008, 94512, 125016, 155520, 186024 | 10016 | AGL09761 | 10016 | 40520 | 71024, 101528, 132032, 162536, 193040 |
| 3001 | ACT15353 | 3001 | 33505 | 64009, 94513, 125017, 155521, 186025 | 10017 | AGL09762 | 10017 | 40521 | 71025, 101529, 132033, 162537, 193041 |
| 3002 | ACT15355 | 3002 | 33506 | 64010, 94514, 125018, 155522, 186026 | 10018 | AGL09763 | 10018 | 40522 | 71026, 101530, 132034, 162538, 193042 |
| 3003 | ACT15357 | 3003 | 33507 | 64011, 94515, 125019, 155523, 186027 | 10019 | AGL09764 | 10019 | 40523 | 71027, 101531, 132035, 162539, 193043 |
| 3004 | ACT20200 | 3004 | 33508 | 64012, 94516, 125020, 155524, 186028 | 10020 | AGL09765 | 10020 | 40524 | 71028, 101532, 132036, 162540, 193044 |
| 3005 | ACT21466 | 3005 | 33509 | 64013, 94517, 125021, 155525, 186029 | 10021 | AGL09766 | 10021 | 40525 | 71029, 101533, 132037, 162541, 193045 |
| 3006 | ACT21467 | 3006 | 33510 | 64014, 94518, 125022, 155526, 186030 | 10022 | AGL09767 | 10022 | 40526 | 71030, 101534, 132038, 162542, 193046 |
| 3007 | ACT21468 | 3007 | 33511 | 64015, 94519, 125023, 155527, 186031 | 10023 | AGL09769 | 10023 | 40527 | 71031, 101535, 132039, 162543, 193047 |
| 3008 | ACT21469 | 3008 | 33512 | 64016, 94520, 125024, 155528, 186032 | 10024 | AGL09770 | 10024 | 40528 | 71032, 101536, 132040, 162544, 193048 |
| 3009 | ACT21471 | 3009 | 33513 | 64017, 94521, 125025, 155529, 186033 | 10025 | AGL09771 | 10025 | 40529 | 71033, 101537, 132041, 162545, 193049 |
| 3010 | ACT21472 | 3010 | 33514 | 64018, 94522, 125026, 155530, 186034 | 10026 | AGL09772 | 10026 | 40530 | 71034, 101538, 132042, 162546, 193050 |
| 3011 | ACT21507 | 3011 | 33515 | 64019, 94523, 125027, 155531, 186035 | 10027 | AGL09773 | 10027 | 40531 | 71035, 101539, 132043, 162547, 193051 |
| 3012 | ACT21508 | 3012 | 33516 | 64020, 94524, 125028, 155532, 186036 | 10028 | AGL09774 | 10028 | 40532 | 71036, 101540, 132044, 162548, 193052 |
| 3013 | ACT21509 | 3013 | 33517 | 64021, 94525, 125029, 155533, 186037 | 10029 | AGL09775 | 10029 | 40533 | 71037, 101541, 132045, 162549, 193053 |
| 3014 | ACT21510 | 3014 | 33518 | 64022, 94526, 125030, 155534, 186038 | 10030 | AGL09776 | 10030 | 40534 | 71038, 101542, 132046, 162550, 193054 |
| 3015 | ACT21572 | 3015 | 33519 | 64023, 94527, 125031, 155535, 186039 | 10031 | AGL09777 | 10031 | 40535 | 71039, 101543, 132047, 162551, 193055 |
| 3016 | ACT22031 | 3016 | 33520 | 64024, 94528, 125032, 155536, 186040 | 10032 | AGL09778 | 10032 | 40536 | 71040, 101544, 132048, 162552, 193056 |
| 3017 | ACT22032 | 3017 | 33521 | 64025, 94529, 125033, 155537, 186041 | 10033 | AGL09779 | 10033 | 40537 | 71041, 101545, 132049, 162553, 193057 |

FIG. 1 continued

| | | | | | | | | | |
|---|---|---|---|---|---|---|---|---|---|
| 3018 | ACT22033 | 3018 | 33522 | 64026, 94530, 125034, 155538, 186042 | 10034 | AGL09780 | 10034 | 40538 | 71042, 101546, 132050, 162554, 193058 |
| 3019 | ACT22034 | 3019 | 33523 | 64027, 94531, 125035, 155539, 186043 | 10035 | AGL09781 | 10035 | 40539 | 71043, 101547, 132051, 162555, 193059 |
| 3020 | ACT22035 | 3020 | 33524 | 64028, 94532, 125036, 155540, 186044 | 10036 | AGL09782 | 10036 | 40540 | 71044, 101548, 132052, 162556, 193060 |
| 3021 | ACT22036 | 3021 | 33525 | 64029, 94533, 125037, 155541, 186045 | 10037 | AGL09783 | 10037 | 40541 | 71045, 101549, 132053, 162557, 193061 |
| 3022 | ACT22037 | 3022 | 33526 | 64030, 94534, 125038, 155542, 186046 | 10038 | AGL09785 | 10038 | 40542 | 71046, 101550, 132054, 162558, 193062 |
| 3023 | ACT22038 | 3023 | 33527 | 64031, 94535, 125039, 155543, 186047 | 10039 | AGL09786 | 10039 | 40543 | 71047, 101551, 132055, 162559, 193063 |
| 3024 | ACT22055 | 3024 | 33528 | 64032, 94536, 125040, 155544, 186048 | 10040 | AGL09787 | 10040 | 40544 | 71048, 101552, 132056, 162560, 193064 |
| 3025 | ACT22504 | 3025 | 33529 | 64033, 94537, 125041, 155545, 186049 | 10041 | AGL09788 | 10041 | 40545 | 71049, 101553, 132057, 162561, 193065 |
| 3026 | ACT33122 | 3026 | 33530 | 64034, 94538, 125042, 155546, 186050 | 10042 | AGL09789 | 10042 | 40546 | 71050, 101554, 132058, 162562, 193066 |
| 3027 | ACT33123 | 3027 | 33531 | 64035, 94539, 125043, 155547, 186051 | 10043 | AGL09790 | 10043 | 40547 | 71051, 101555, 132059, 162563, 193067 |
| 3028 | ACT33125 | 3028 | 33532 | 64036, 94540, 125044, 155548, 186052 | 10044 | AGL09791 | 10044 | 40548 | 71052, 101556, 132060, 162564, 193068 |
| 3029 | ACT36505 | 3029 | 33533 | 64037, 94541, 125045, 155549, 186053 | 10045 | AGL09792 | 10045 | 40549 | 71053, 101557, 132061, 162565, 193069 |
| 3030 | ACT36649 | 3030 | 33534 | 64038, 94542, 125046, 155550, 186054 | 10046 | AGL09794 | 10046 | 40550 | 71054, 101558, 132062, 162566, 193070 |
| 3031 | ACT36650 | 3031 | 33535 | 64039, 94543, 125047, 155551, 186055 | 10047 | AGL09795 | 10047 | 40551 | 71055, 101559, 132063, 162567, 193071 |
| 3032 | ACT36652 | 3032 | 33536 | 64040, 94544, 125048, 155552, 186056 | 10048 | AGL09797 | 10048 | 40552 | 71056, 101560, 132064, 162568, 193072 |
| 3033 | ACT36653 | 3033 | 33537 | 64041, 94545, 125049, 155553, 186057 | 10049 | AGL09798 | 10049 | 40553 | 71057, 101561, 132065, 162569, 193073 |
| 3034 | ACT36655 | 3034 | 33538 | 64042, 94546, 125050, 155554, 186058 | 10050 | AGL09799 | 10050 | 40554 | 71058, 101562, 132066, 162570, 193074 |
| 3035 | ACT36658 | 3035 | 33539 | 64043, 94547, 125051, 155555, 186059 | 10051 | AGL09800 | 10051 | 40555 | 71059, 101563, 132067, 162571, 193075 |

FIG. 1 continued

| | | | | | | | | | |
|---|---|---|---|---|---|---|---|---|---|
| 3036 | ACT36659 | 3036 | 33540 | 64044, 94548, 125052, 155556, 186060 | 10052 | AGL09801 | 10052 | 40556 | 71060, 101564, 132068, 162572, 193076 |
| 3037 | ACT36661 | 3037 | 33541 | 64045, 94549, 125053, 155557, 186061 | 10053 | AGL09802 | 10053 | 40557 | 71061, 101565, 132069, 162573, 193077 |
| 3038 | ACT36663 | 3038 | 33542 | 64046, 94550, 125054, 155558, 186062 | 10054 | AGL09803 | 10054 | 40558 | 71062, 101566, 132070, 162574, 193078 |
| 3039 | ACT36666 | 3039 | 33543 | 64047, 94551, 125055, 155559, 186063 | 10055 | AGL09804 | 10055 | 40559 | 71063, 101567, 132071, 162575, 193079 |
| 3040 | ACT52687 | 3040 | 33544 | 64048, 94552, 125056, 155560, 186064 | 10056 | AGL09805 | 10056 | 40560 | 71064, 101568, 132072, 162576, 193080 |
| 3041 | ACT54606 | 3041 | 33545 | 64049, 94553, 125057, 155561, 186065 | 10057 | AGL09806 | 10057 | 40561 | 71065, 101569, 132073, 162577, 193081 |
| 3042 | ACT66146 | 3042 | 33546 | 64050, 94554, 125058, 155562, 186066 | 10058 | AGL09807 | 10058 | 40562 | 71066, 101570, 132074, 162578, 193082 |
| 3043 | ACT66155 | 3043 | 33547 | 64051, 94555, 125059, 155563, 186067 | 10059 | AGL09808 | 10059 | 40563 | 71067, 101571, 132075, 162579, 193083 |
| 3044 | ACT66162 | 3044 | 33548 | 64052, 94556, 125060, 155564, 186068 | 10060 | AGL09809 | 10060 | 40564 | 71068, 101572, 132076, 162580, 193084 |
| 3045 | ACT67239 | 3045 | 33549 | 64053, 94557, 125061, 155565, 186069 | 10061 | AGL09810 | 10061 | 40565 | 71069, 101573, 132077, 162581, 193085 |
| 3046 | ACT67255 | 3046 | 33550 | 64054, 94558, 125062, 155566, 186070 | 10062 | AGL09811 | 10062 | 40566 | 71070, 101574, 132078, 162582, 193086 |
| 3047 | ACT68102 | 3047 | 33551 | 64055, 94559, 125063, 155567, 186071 | 10063 | AGL09812 | 10063 | 40567 | 71071, 101575, 132079, 162583, 193087 |
| 3048 | ACT68103 | 3048 | 33552 | 64056, 94560, 125064, 155568, 186072 | 10064 | AGL09813 | 10064 | 40568 | 71072, 101576, 132080, 162584, 193088 |
| 3049 | ACT68104 | 3049 | 33553 | 64057, 94561, 125065, 155569, 186073 | 10065 | AGL09814 | 10065 | 40569 | 71073, 101577, 132081, 162585, 193089 |
| 3050 | ACT68105 | 3050 | 33554 | 64058, 94562, 125066, 155570, 186074 | 10066 | AGL09815 | 10066 | 40570 | 71074, 101578, 132082, 162586, 193090 |
| 3051 | ACT68106 | 3051 | 33555 | 64059, 94563, 125067, 155571, 186075 | 10067 | AGL09816 | 10067 | 40571 | 71075, 101579, 132083, 162587, 193091 |
| 3052 | ACT68107 | 3052 | 33556 | 64060, 94564, 125068, 155572, 186076 | 10068 | AGL09817 | 10068 | 40572 | 71076, 101580, 132084, 162588, 193092 |
| 3053 | ACT68108 | 3053 | 33557 | 64061, 94565, 125069, 155573, 186077 | 10069 | AGL09818 | 10069 | 40573 | 71077, 101581, 132085, 162589, 193093 |

FIG. 1 continued

| | | | | | | | | | |
|---|---|---|---|---|---|---|---|---|---|
| 3054 | ACT68109 | 3054 | 33558 | 64062, 94566, 125070, 155574, 186078 | 10070 | AGL09819 | 10070 | 40574 | 71078, 101582, 132086, 162590, 193094 |
| 3055 | ACT68110 | 3055 | 33559 | 64063, 94567, 125071, 155575, 186079 | 10071 | AGL09820 | 10071 | 40575 | 71079, 101583, 132087, 162591, 193095 |
| 3056 | ACT68112 | 3056 | 33560 | 64064, 94568, 125072, 155576, 186080 | 10072 | AGL09821 | 10072 | 40576 | 71080, 101584, 132088, 162592, 193096 |
| 3057 | ACT68113 | 3057 | 33561 | 64065, 94569, 125073, 155577, 186081 | 10073 | AGL09822 | 10073 | 40577 | 71081, 101585, 132089, 162593, 193097 |
| 3058 | ACT68115 | 3058 | 33562 | 64066, 94570, 125074, 155578, 186082 | 10074 | AGL09823 | 10074 | 40578 | 71082, 101586, 132090, 162594, 193098 |
| 3059 | ACT68119 | 3059 | 33563 | 64067, 94571, 125075, 155579, 186083 | 10075 | AGL09824 | 10075 | 40579 | 71083, 101587, 132091, 162595, 193099 |
| 3060 | ACT79133 | 3060 | 33564 | 64068, 94572, 125076, 155580, 186084 | 10076 | AGL09825 | 10076 | 40580 | 71084, 101588, 132092, 162596, 193100 |
| 3061 | ACT79143 | 3061 | 33565 | 64069, 94573, 125077, 155581, 186085 | 10077 | AGL09826 | 10077 | 40581 | 71085, 101589, 132093, 162597, 193101 |
| 3062 | ACT79153 | 3062 | 33566 | 64070, 94574, 125078, 155582, 186086 | 10078 | AGL09827 | 10078 | 40582 | 71086, 101590, 132094, 162598, 193102 |
| 3063 | ACT79163 | 3063 | 33567 | 64071, 94575, 125079, 155583, 186087 | 10079 | AGL09828 | 10079 | 40583 | 71087, 101591, 132095, 162599, 193103 |
| 3064 | ACT79173 | 3064 | 33568 | 64072, 94576, 125080, 155584, 186088 | 10080 | AGL09829 | 10080 | 40584 | 71088, 101592, 132096, 162600, 193104 |
| 3065 | ACT79625 | 3065 | 33569 | 64073, 94577, 125081, 155585, 186089 | 10081 | AGL09830 | 10081 | 40585 | 71089, 101593, 132097, 162601, 193105 |
| 3066 | ACT79627 | 3066 | 33570 | 64074, 94578, 125082, 155586, 186090 | 10082 | AGL09831 | 10082 | 40586 | 71090, 101594, 132098, 162602, 193106 |
| 3067 | ACT82512 | 3067 | 33571 | 64075, 94579, 125083, 155587, 186091 | 10083 | AGL09832 | 10083 | 40587 | 71091, 101595, 132099, 162603, 193107 |
| 3068 | ACT82513 | 3068 | 33572 | 64076, 94580, 125084, 155588, 186092 | 10084 | AGL09833 | 10084 | 40588 | 71092, 101596, 132100, 162604, 193108 |
| 3069 | ACT82514 | 3069 | 33573 | 64077, 94581, 125085, 155589, 186093 | 10085 | AGL09881 | 10085 | 40589 | 71093, 101597, 132101, 162605, 193109 |
| 3070 | ACT82515 | 3070 | 33574 | 64078, 94582, 125086, 155590, 186094 | 10086 | AGL09882 | 10086 | 40590 | 71094, 101598, 132102, 162606, 193110 |
| 3071 | ACT82516 | 3071 | 33575 | 64079, 94583, 125087, 155591, 186095 | 10087 | AGL09883 | 10087 | 40591 | 71095, 101599, 132103, 162607, 193111 |

FIG. 1 continued

| | | | | | | | | | |
|---|---|---|---|---|---|---|---|---|---|
| 3072 | ACT83795 | 3072 | 33576 | 64080, 94584, 125088, 155592, 186096 | 10088 | AGL09884 | 10088 | 40592 | 71096, 101600, 132104, 162608, 193112 |
| 3073 | ACT83805 | 3073 | 33577 | 64081, 94585, 125089, 155593, 186097 | 10089 | AGL44438 | 10089 | 40593 | 71097, 101601, 132105, 162609, 193113 |
| 3074 | ACT83815 | 3074 | 33578 | 64082, 94586, 125090, 155594, 186098 | 10090 | AGN69267 | 10090 | 40594 | 71098, 101602, 132106, 162610, 193114 |
| 3075 | ACT83825 | 3075 | 33579 | 64083, 94587, 125091, 155595, 186099 | 10091 | AGN69278 | 10091 | 40595 | 71099, 101603, 132107, 162611, 193115 |
| 3076 | ACT83835 | 3076 | 33580 | 64084, 94588, 125092, 155596, 186100 | 10092 | AGN69302 | 10092 | 40596 | 71100, 101604, 132108, 162612, 193116 |
| 3077 | ACT83845 | 3077 | 33581 | 64085, 94589, 125093, 155597, 186101 | 10093 | AGN69314 | 10093 | 40597 | 71101, 101605, 132109, 162613, 193117 |
| 3078 | ACT83855 | 3078 | 33582 | 64086, 94590, 125094, 155598, 186102 | 10094 | AGN69326 | 10094 | 40598 | 71102, 101606, 132110, 162614, 193118 |
| 3079 | ACT83865 | 3079 | 33583 | 64087, 94591, 125095, 155599, 186103 | 10095 | AGN69338 | 10095 | 40599 | 71103, 101607, 132111, 162615, 193119 |
| 3080 | ACT83875 | 3080 | 33584 | 64088, 94592, 125096, 155600, 186104 | 10096 | AGO00265 | 10096 | 40600 | 71104, 101608, 132112, 162616, 193120 |
| 3081 | ACT85999 | 3081 | 33585 | 64089, 94593, 125097, 155601, 186105 | 10097 | AGO00277 | 10097 | 40601 | 71105, 101609, 132113, 162617, 193121 |
| 3082 | ACT86009 | 3082 | 33586 | 64090, 94594, 125098, 155602, 186106 | 10098 | AGO00289 | 10098 | 40602 | 71106, 101610, 132114, 162618, 193122 |
| 3083 | ACT86019 | 3083 | 33587 | 64091, 94595, 125099, 155603, 186107 | 10099 | AGO00301 | 10099 | 40603 | 71107, 101611, 132115, 162619, 193123 |
| 3084 | ACT86029 | 3084 | 33588 | 64092, 94596, 125100, 155604, 186108 | 10100 | AGO00313 | 10100 | 40604 | 71108, 101612, 132116, 162620, 193124 |
| 3085 | ACT86039 | 3085 | 33589 | 64093, 94597, 125101, 155605, 186109 | 10101 | AGO00325 | 10101 | 40605 | 71109, 101613, 132117, 162621, 193125 |
| 3086 | ACT86059 | 3086 | 33590 | 64094, 94598, 125102, 155606, 186110 | 10102 | AGO00337 | 10102 | 40606 | 71110, 101614, 132118, 162622, 193126 |
| 3087 | ACT86069 | 3087 | 33591 | 64095, 94599, 125103, 155607, 186111 | 10103 | AGO00349 | 10103 | 40607 | 71111, 101615, 132119, 162623, 193127 |
| 3088 | ACT86079 | 3088 | 33592 | 64096, 94600, 125104, 155608, 186112 | 10104 | AGO00373 | 10104 | 40608 | 71112, 101616, 132120, 162624, 193128 |
| 3089 | ACT86089 | 3089 | 33593 | 64097, 94601, 125105, 155609, 186113 | 10105 | AGO00385 | 10105 | 40609 | 71113, 101617, 132121, 162625, 193129 |

FIG. 1 continued

| | | | | | | | | | |
|---|---|---|---|---|---|---|---|---|---|
| 3090 | ACT86099 | 3090 | 33594 | 64098, 94602, 125106, 155610, 186114 | 10106 | AG000397 | 10106 | 40610 | 71114, 101618, 132122, 162626, 193130 |
| 3091 | ACT86109 | 3091 | 33595 | 64099, 94603, 125107, 155611, 186115 | 10107 | AG000409 | 10107 | 40611 | 71115, 101619, 132123, 162627, 193131 |
| 3092 | ACT86119 | 3092 | 33596 | 64100, 94604, 125108, 155612, 186116 | 10108 | AG000421 | 10108 | 40612 | 71116, 101620, 132124, 162628, 193132 |
| 3093 | ACT86129 | 3093 | 33597 | 64101, 94605, 125109, 155613, 186117 | 10109 | AG000433 | 10109 | 40613 | 71117, 101621, 132125, 162629, 193133 |
| 3094 | ACT86139 | 3094 | 33598 | 64102, 94606, 125110, 155614, 186118 | 10110 | AG000445 | 10110 | 40614 | 71118, 101622, 132126, 162630, 193134 |
| 3095 | ACU00932 | 3095 | 33599 | 64103, 94607, 125111, 155615, 186119 | 10111 | AG002696 | 10111 | 40615 | 71119, 101623, 132127, 162631, 193135 |
| 3096 | ACU00942 | 3096 | 33600 | 64104, 94608, 125112, 155616, 186120 | 10112 | AG002697 | 10112 | 40616 | 71120, 101624, 132128, 162632, 193136 |
| 3097 | ACU00952 | 3097 | 33601 | 64105, 94609, 125113, 155617, 186121 | 10113 | AG002698 | 10113 | 40617 | 71121, 101625, 132129, 162633, 193137 |
| 3098 | ACU12494 | 3098 | 33602 | 64106, 94610, 125114, 155618, 186122 | 10114 | AG002699 | 10114 | 40618 | 71122, 101626, 132130, 162634, 193138 |
| 3099 | ACU12505 | 3099 | 33603 | 64107, 94611, 125115, 155619, 186123 | 10115 | AG002700 | 10115 | 40619 | 71123, 101627, 132131, 162635, 193139 |
| 3100 | ACU12516 | 3100 | 33604 | 64108, 94612, 125116, 155620, 186124 | 10116 | AG002701 | 10116 | 40620 | 71124, 101628, 132132, 162636, 193140 |
| 3101 | ACU12527 | 3101 | 33605 | 64109, 94613, 125117, 155621, 186125 | 10117 | AG051374 | 10117 | 40621 | 71125, 101629, 132133, 162637, 193141 |
| 3102 | ACU12538 | 3102 | 33606 | 64110, 94614, 125118, 155622, 186126 | 10118 | AG086686 | 10118 | 40622 | 71126, 101630, 132134, 162638, 193142 |
| 3103 | ACU12549 | 3103 | 33607 | 64111, 94615, 125119, 155623, 186127 | 10119 | AGQ16240 | 10119 | 40623 | 71127, 101631, 132135, 162639, 193143 |
| 3104 | ACU12560 | 3104 | 33608 | 64112, 94616, 125120, 155624, 186128 | 10120 | AGQ16241 | 10120 | 40624 | 71128, 101632, 132136, 162640, 193144 |
| 3105 | ACU12571 | 3105 | 33609 | 64113, 94617, 125121, 155625, 186129 | 10121 | AGQ16242 | 10121 | 40625 | 71129, 101633, 132137, 162641, 193145 |
| 3106 | ACU12582 | 3106 | 33610 | 64114, 94618, 125122, 155626, 186130 | 10122 | AGQ16243 | 10122 | 40626 | 71130, 101634, 132138, 162642, 193146 |
| 3107 | ACU12593 | 3107 | 33611 | 64115, 94619, 125123, 155627, 186131 | 10123 | AGQ16245 | 10123 | 40627 | 71131, 101635, 132139, 162643, 193147 |

FIG. 1 continued

| | | | | | | | | | |
|---|---|---|---|---|---|---|---|---|---|
| 3108 | ACU13090 | 3108 | 33612 | 64116, 94620, 125124, 155628, 186132 | 10124 | AGQ16247 | 10124 | 40628 | 71132, 101636, 132140, 162644, 193148 |
| 3109 | ACU13091 | 3109 | 33613 | 64117, 94621, 125125, 155629, 186133 | 10125 | AGQ16248 | 10125 | 40629 | 71133, 101637, 132141, 162645, 193149 |
| 3110 | ACU13092 | 3110 | 33614 | 64118, 94622, 125126, 155630, 186134 | 10126 | AGQ16329 | 10126 | 40630 | 71134, 101638, 132142, 162646, 193150 |
| 3111 | ACU13093 | 3111 | 33615 | 64119, 94623, 125127, 155631, 186135 | 10127 | AGQ16331 | 10127 | 40631 | 71135, 101639, 132143, 162647, 193151 |
| 3112 | ACU13094 | 3112 | 33616 | 64120, 94624, 125128, 155632, 186136 | 10128 | AGQ16332 | 10128 | 40632 | 71136, 101640, 132144, 162648, 193152 |
| 3113 | ACU13095 | 3113 | 33617 | 64121, 94625, 125129, 155633, 186137 | 10129 | AGQ16333 | 10129 | 40633 | 71137, 101641, 132145, 162649, 193153 |
| 3114 | ACU13096 | 3114 | 33618 | 64122, 94626, 125130, 155634, 186138 | 10130 | AGQ16335 | 10130 | 40634 | 71138, 101642, 132146, 162650, 193154 |
| 3115 | ACU13098 | 3115 | 33619 | 64123, 94627, 125131, 155635, 186139 | 10131 | AGQ16336 | 10131 | 40635 | 71139, 101643, 132147, 162651, 193155 |
| 3116 | ACU13099 | 3116 | 33620 | 64124, 94628, 125132, 155636, 186140 | 10132 | AGQ16337 | 10132 | 40636 | 71140, 101644, 132148, 162652, 193156 |
| 3117 | ACU13129 | 3117 | 33621 | 64125, 94629, 125133, 155637, 186141 | 10133 | AGQ16338 | 10133 | 40637 | 71141, 101645, 132149, 162653, 193157 |
| 3118 | ACU16795 | 3118 | 33622 | 64126, 94630, 125134, 155638, 186142 | 10134 | AGQ16339 | 10134 | 40638 | 71142, 101646, 132150, 162654, 193158 |
| 3119 | ACU16858 | 3119 | 33623 | 64127, 94631, 125135, 155639, 186143 | 10135 | AGQ16340 | 10135 | 40639 | 71143, 101647, 132151, 162655, 193159 |
| 3120 | ACU16930 | 3120 | 33624 | 64128, 94632, 125136, 155640, 186144 | 10136 | AGQ16341 | 10136 | 40640 | 71144, 101648, 132152, 162656, 193160 |
| 3121 | ACU16993 | 3121 | 33625 | 64129, 94633, 125137, 155641, 186145 | 10137 | AGQ16342 | 10137 | 40641 | 71145, 101649, 132153, 162657, 193161 |
| 3122 | ACU17059 | 3122 | 33626 | 64130, 94634, 125138, 155642, 186146 | 10138 | AGQ16343 | 10138 | 40642 | 71146, 101650, 132154, 162658, 193162 |
| 3123 | ACU17126 | 3123 | 33627 | 64131, 94635, 125139, 155643, 186147 | 10139 | AGQ16344 | 10139 | 40643 | 71147, 101651, 132155, 162659, 193163 |
| 3124 | ACU17187 | 3124 | 33628 | 64132, 94636, 125140, 155644, 186148 | 10140 | AGQ16345 | 10140 | 40644 | 71148, 101652, 132156, 162660, 193164 |
| 3125 | ACU17258 | 3125 | 33629 | 64133, 94637, 125141, 155645, 186149 | 10141 | AGQ16346 | 10141 | 40645 | 71149, 101653, 132157, 162661, 193165 |

FIG. 1 continued

| | | | | | | | | | |
|---|---|---|---|---|---|---|---|---|---|
| 3126 | ACU17389 | 3126 | 33630 | 64134, 94638, 125142, 155646, 186150 | 10142 | AGQ16347 | 10142 | 40646 | 71150, 101654, 132158, 162662, 193166 |
| 3127 | ACU17450 | 3127 | 33631 | 64135, 94639, 125143, 155647, 186151 | 10143 | AGQ16348 | 10143 | 40647 | 71151, 101655, 132159, 162663, 193167 |
| 3128 | ACU17521 | 3128 | 33632 | 64136, 94640, 125144, 155648, 186152 | 10144 | AGQ16349 | 10144 | 40648 | 71152, 101656, 132160, 162664, 193168 |
| 3129 | ACU27041 | 3129 | 33633 | 64137, 94641, 125145, 155649, 186153 | 10145 | AGQ16350 | 10145 | 40649 | 71153, 101657, 132161, 162665, 193169 |
| 3130 | ACU27406 | 3130 | 33634 | 64138, 94642, 125146, 155650, 186154 | 10146 | AGQ47719 | 10146 | 40650 | 71154, 101658, 132162, 162666, 193170 |
| 3131 | ACU27407 | 3131 | 33635 | 64139, 94643, 125147, 155651, 186155 | 10147 | AGQ47728 | 10147 | 40651 | 71155, 101659, 132163, 162667, 193171 |
| 3132 | ACU29949 | 3132 | 33636 | 64140, 94644, 125148, 155652, 186156 | 10148 | AGQ47740 | 10148 | 40652 | 71156, 101660, 132164, 162668, 193172 |
| 3133 | ACU29979 | 3133 | 33637 | 64141, 94645, 125149, 155653, 186157 | 10149 | AGQ47752 | 10149 | 40653 | 71157, 101661, 132165, 162669, 193173 |
| 3134 | ACU29989 | 3134 | 33638 | 64142, 94646, 125150, 155654, 186158 | 10150 | AGQ47764 | 10150 | 40654 | 71158, 101662, 132166, 162670, 193174 |
| 3135 | ACU29999 | 3135 | 33639 | 64143, 94647, 125151, 155655, 186159 | 10151 | AGQ47776 | 10151 | 40655 | 71159, 101663, 132167, 162671, 193175 |
| 3136 | ACU30009 | 3136 | 33640 | 64144, 94648, 125152, 155656, 186160 | 10152 | AGQ47788 | 10152 | 40656 | 71160, 101664, 132168, 162672, 193176 |
| 3137 | ACU30019 | 3137 | 33641 | 64145, 94649, 125153, 155657, 186161 | 10153 | AGQ47800 | 10153 | 40657 | 71161, 101665, 132169, 162673, 193177 |
| 3138 | ACU30093 | 3138 | 33642 | 64146, 94650, 125154, 155658, 186162 | 10154 | AGQ47811 | 10154 | 40658 | 71162, 101666, 132170, 162674, 193178 |
| 3139 | ACU30103 | 3139 | 33643 | 64147, 94651, 125155, 155659, 186163 | 10155 | AGQ47823 | 10155 | 40659 | 71163, 101667, 132171, 162675, 193179 |
| 3140 | ACU30112 | 3140 | 33644 | 64148, 94652, 125156, 155660, 186164 | 10156 | AGQ47835 | 10156 | 40660 | 71164, 101668, 132172, 162676, 193180 |
| 3141 | ACU30121 | 3141 | 33645 | 64149, 94653, 125157, 155661, 186165 | 10157 | AGQ47847 | 10157 | 40661 | 71165, 101669, 132173, 162677, 193181 |
| 3142 | ACU31124 | 3142 | 33646 | 64150, 94654, 125158, 155662, 186166 | 10158 | AGQ47870 | 10158 | 40662 | 71166, 101670, 132174, 162678, 193182 |
| 3143 | ACU31143 | 3143 | 33647 | 64151, 94655, 125159, 155663, 186167 | 10159 | AGQ47882 | 10159 | 40663 | 71167, 101671, 132175, 162679, 193183 |

FIG. 1 continued

| | | | | | | | | | |
|---|---|---|---|---|---|---|---|---|---|
| 3144 | ACU31144 | 3144 | 33648 | 64152, 94656, 125160, 155664, 186168 | 10160 | AGQ47894 | 10160 | 40664 | 71168, 101672, 132176, 162680, 193184 |
| 3145 | ACU31145 | 3145 | 33649 | 64153, 94657, 125161, 155665, 186169 | 10161 | AGQ47906 | 10161 | 40665 | 71169, 101673, 132177, 162681, 193185 |
| 3146 | ACU31146 | 3146 | 33650 | 64154, 94658, 125162, 155666, 186170 | 10162 | AGQ47918 | 10162 | 40666 | 71170, 101674, 132178, 162682, 193186 |
| 3147 | ACU31147 | 3147 | 33651 | 64155, 94659, 125163, 155667, 186171 | 10163 | AGQ47930 | 10163 | 40667 | 71171, 101675, 132179, 162683, 193187 |
| 3148 | ACU31148 | 3148 | 33652 | 64156, 94660, 125164, 155668, 186172 | 10164 | AGQ47942 | 10164 | 40668 | 71172, 101676, 132180, 162684, 193188 |
| 3149 | ACU31149 | 3149 | 33653 | 64157, 94661, 125165, 155669, 186173 | 10165 | AGQ47954 | 10165 | 40669 | 71173, 101677, 132181, 162685, 193189 |
| 3150 | ACU31150 | 3150 | 33654 | 64158, 94662, 125166, 155670, 186174 | 10166 | AGQ47966 | 10166 | 40670 | 71174, 101678, 132182, 162686, 193190 |
| 3151 | ACU31151 | 3151 | 33655 | 64159, 94663, 125167, 155671, 186175 | 10167 | AGQ47978 | 10167 | 40671 | 71175, 101679, 132183, 162687, 193191 |
| 3152 | ACU31152 | 3152 | 33656 | 64160, 94664, 125168, 155672, 186176 | 10168 | AGQ47990 | 10168 | 40672 | 71176, 101680, 132184, 162688, 193192 |
| 3153 | ACU46644 | 3153 | 33657 | 64161, 94665, 125169, 155673, 186177 | 10169 | AGQ48002 | 10169 | 40673 | 71177, 101681, 132185, 162689, 193193 |
| 3154 | ACU56924 | 3154 | 33658 | 64162, 94666, 125170, 155674, 186178 | 10170 | AGQ48014 | 10170 | 40674 | 71178, 101682, 132186, 162690, 193194 |
| 3155 | ACU56931 | 3155 | 33659 | 64163, 94667, 125171, 155675, 186179 | 10171 | AGQ48026 | 10171 | 40675 | 71179, 101683, 132187, 162691, 193195 |
| 3156 | ACU64792 | 3156 | 33660 | 64164, 94668, 125172, 155676, 186180 | 10172 | AGQ48038 | 10172 | 40676 | 71180, 101684, 132188, 162692, 193196 |
| 3157 | ACU64801 | 3157 | 33661 | 64165, 94669, 125173, 155677, 186181 | 10173 | AGQ48050 | 10173 | 40677 | 71181, 101685, 132189, 162693, 193197 |
| 3158 | ACU64812 | 3158 | 33662 | 64166, 94670, 125174, 155678, 186182 | 10174 | AGQ80946 | 10174 | 40678 | 71182, 101686, 132190, 162694, 193198 |
| 3159 | ACU79871 | 3159 | 33663 | 64167, 94671, 125175, 155679, 186183 | 10175 | AGQ80947 | 10175 | 40679 | 71183, 101687, 132191, 162695, 193199 |
| 3160 | ACU79882 | 3160 | 33664 | 64168, 94672, 125176, 155680, 186184 | 10176 | AGQ80948 | 10176 | 40680 | 71184, 101688, 132192, 162696, 193200 |
| 3161 | ACU79893 | 3161 | 33665 | 64169, 94673, 125177, 155681, 186185 | 10177 | AGQ80949 | 10177 | 40681 | 71185, 101689, 132193, 162697, 193201 |

FIG. 1 continued

| | | | | | | | | | |
|---|---|---|---|---|---|---|---|---|---|
| 3162 | ACU79904 | 3162 | 33666 | 64170, 94674, 125178, 155682, 186186 | 10178 | AGQ80950 | 10178 | 40682 | 71186, 101690, 132194, 162698, 193202 |
| 3163 | ACU79937 | 3163 | 33667 | 64171, 94675, 125179, 155683, 186187 | 10179 | AGQ80951 | 10179 | 40683 | 71187, 101691, 132195, 162699, 193203 |
| 3164 | ACU79948 | 3164 | 33668 | 64172, 94676, 125180, 155684, 186188 | 10180 | AGQ80953 | 10180 | 40684 | 71188, 101692, 132196, 162700, 193204 |
| 3165 | ACU79959 | 3165 | 33669 | 64173, 94677, 125181, 155685, 186189 | 10181 | AGQ80954 | 10181 | 40685 | 71189, 101693, 132197, 162701, 193205 |
| 3166 | ACU79970 | 3166 | 33670 | 64174, 94678, 125182, 155686, 186190 | 10182 | AGQ80955 | 10182 | 40686 | 71190, 101694, 132198, 162702, 193206 |
| 3167 | ACU79981 | 3167 | 33671 | 64175, 94679, 125183, 155687, 186191 | 10183 | AGQ80956 | 10183 | 40687 | 71191, 101695, 132199, 162703, 193207 |
| 3168 | ACU79992 | 3168 | 33672 | 64176, 94680, 125184, 155688, 186192 | 10184 | AGQ80957 | 10184 | 40688 | 71192, 101696, 132200, 162704, 193208 |
| 3169 | ACU80003 | 3169 | 33673 | 64177, 94681, 125185, 155689, 186193 | 10185 | AGQ80958 | 10185 | 40689 | 71193, 101697, 132201, 162705, 193209 |
| 3170 | ACU80025 | 3170 | 33674 | 64178, 94682, 125186, 155690, 186194 | 10186 | AGQ80959 | 10186 | 40690 | 71194, 101698, 132202, 162706, 193210 |
| 3171 | ACU80036 | 3171 | 33675 | 64179, 94683, 125187, 155691, 186195 | 10187 | AGQ80961 | 10187 | 40691 | 71195, 101699, 132203, 162707, 193211 |
| 3172 | ACU80047 | 3172 | 33676 | 64180, 94684, 125188, 155692, 186196 | 10188 | AGQ80962 | 10188 | 40692 | 71196, 101700, 132204, 162708, 193212 |
| 3173 | ACU80058 | 3173 | 33677 | 64181, 94685, 125189, 155693, 186197 | 10189 | AGQ80964 | 10189 | 40693 | 71197, 101701, 132205, 162709, 193213 |
| 3174 | ACU80069 | 3174 | 33678 | 64182, 94686, 125190, 155694, 186198 | 10190 | AGQ80965 | 10190 | 40694 | 71198, 101702, 132206, 162710, 193214 |
| 3175 | ACU80080 | 3175 | 33679 | 64183, 94687, 125191, 155695, 186199 | 10191 | AGQ80966 | 10191 | 40695 | 71199, 101703, 132207, 162711, 193215 |
| 3176 | ACU80091 | 3176 | 33680 | 64184, 94688, 125192, 155696, 186200 | 10192 | AGQ80968 | 10192 | 40696 | 71200, 101704, 132208, 162712, 193216 |
| 3177 | ACU80102 | 3177 | 33681 | 64185, 94689, 125193, 155697, 186201 | 10193 | AGQ80970 | 10193 | 40697 | 71201, 101705, 132209, 162713, 193217 |
| 3178 | ACU80113 | 3178 | 33682 | 64186, 94690, 125194, 155698, 186202 | 10194 | AGQ80971 | 10194 | 40698 | 71202, 101706, 132210, 162714, 193218 |
| 3179 | ACU80135 | 3179 | 33683 | 64187, 94691, 125195, 155699, 186203 | 10195 | AGQ80974 | 10195 | 40699 | 71203, 101707, 132211, 162715, 193219 |

FIG. 1 continued

| | | | | | | | | | |
|---|---|---|---|---|---|---|---|---|---|
| 3180 | ACU80146 | 3180 | 33684 | 64188, 94692, 125196, 155700, 186204 | 10196 | AGQ80977 | 10196 | 40700 | 71204, 101708, 132212, 162716, 193220 |
| 3181 | ACU80157 | 3181 | 33685 | 64189, 94693, 125197, 155701, 186205 | 10197 | AGQ80978 | 10197 | 40701 | 71205, 101709, 132213, 162717, 193221 |
| 3182 | ACU80168 | 3182 | 33686 | 64190, 94694, 125198, 155702, 186206 | 10198 | AGQ80979 | 10198 | 40702 | 71206, 101710, 132214, 162718, 193222 |
| 3183 | ACU80179 | 3183 | 33687 | 64191, 94695, 125199, 155703, 186207 | 10199 | AGQ80980 | 10199 | 40703 | 71207, 101711, 132215, 162719, 193223 |
| 3184 | ACU80190 | 3184 | 33688 | 64192, 94696, 125200, 155704, 186208 | 10200 | AGQ80981 | 10200 | 40704 | 71208, 101712, 132216, 162720, 193224 |
| 3185 | ACU80201 | 3185 | 33689 | 64193, 94697, 125201, 155705, 186209 | 10201 | AGQ80982 | 10201 | 40705 | 71209, 101713, 132217, 162721, 193225 |
| 3186 | ACU80212 | 3186 | 33690 | 64194, 94698, 125202, 155706, 186210 | 10202 | AGQ80983 | 10202 | 40706 | 71210, 101714, 132218, 162722, 193226 |
| 3187 | ACU80234 | 3187 | 33691 | 64195, 94699, 125203, 155707, 186211 | 10203 | AGQ80984 | 10203 | 40707 | 71211, 101715, 132219, 162723, 193227 |
| 3188 | ACU80245 | 3188 | 33692 | 64196, 94700, 125204, 155708, 186212 | 10204 | AGQ80985 | 10204 | 40708 | 71212, 101716, 132220, 162724, 193228 |
| 3189 | ACU80256 | 3189 | 33693 | 64197, 94701, 125205, 155709, 186213 | 10205 | AGQ80986 | 10205 | 40709 | 71213, 101717, 132221, 162725, 193229 |
| 3190 | ACU80267 | 3190 | 33694 | 64198, 94702, 125206, 155710, 186214 | 10206 | AGQ80987 | 10206 | 40710 | 71214, 101718, 132222, 162726, 193230 |
| 3191 | ACU80278 | 3191 | 33695 | 64199, 94703, 125207, 155711, 186215 | 10207 | AGQ80988 | 10207 | 40711 | 71215, 101719, 132223, 162727, 193231 |
| 3192 | ACU80289 | 3192 | 33696 | 64200, 94704, 125208, 155712, 186216 | 10208 | AGQ80990 | 10208 | 40712 | 71216, 101720, 132224, 162728, 193232 |
| 3193 | ACU80300 | 3193 | 33697 | 64201, 94705, 125209, 155713, 186217 | 10209 | AGQ80991 | 10209 | 40713 | 71217, 101721, 132225, 162729, 193233 |
| 3194 | ACU80311 | 3194 | 33698 | 64202, 94706, 125210, 155714, 186218 | 10210 | AGQ80992 | 10210 | 40714 | 71218, 101722, 132226, 162730, 193234 |
| 3195 | ACU80322 | 3195 | 33699 | 64203, 94707, 125211, 155715, 186219 | 10211 | AGQ80993 | 10211 | 40715 | 71219, 101723, 132227, 162731, 193235 |
| 3196 | ACU80333 | 3196 | 33700 | 64204, 94708, 125212, 155716, 186220 | 10212 | AGQ80994 | 10212 | 40716 | 71220, 101724, 132228, 162732, 193236 |
| 3197 | ACU80344 | 3197 | 33701 | 64205, 94709, 125213, 155717, 186221 | 10213 | AGQ80995 | 10213 | 40717 | 71221, 101725, 132229, 162733, 193237 |

FIG. 1 continued

| | | | | | | | | | |
|---|---|---|---|---|---|---|---|---|---|
| 3198 | ACU80355 | 3198 | 33702 | 64206, 94710, 125214, 155718, 186222 | 10214 | AGQ80996 | 10214 | 40718 | 71222, 101726, 132230, 162734, 193238 |
| 3199 | ACU80366 | 3199 | 33703 | 64207, 94711, 125215, 155719, 186223 | 10215 | AGQ80997 | 10215 | 40719 | 71223, 101727, 132231, 162735, 193239 |
| 3200 | ACU80377 | 3200 | 33704 | 64208, 94712, 125216, 155720, 186224 | 10216 | AGQ81000 | 10216 | 40720 | 71224, 101728, 132232, 162736, 193240 |
| 3201 | ACU80388 | 3201 | 33705 | 64209, 94713, 125217, 155721, 186225 | 10217 | AGQ81001 | 10217 | 40721 | 71225, 101729, 132233, 162737, 193241 |
| 3202 | ACU80399 | 3202 | 33706 | 64210, 94714, 125218, 155722, 186226 | 10218 | AGQ81002 | 10218 | 40722 | 71226, 101730, 132234, 162738, 193242 |
| 3203 | ACU80410 | 3203 | 33707 | 64211, 94715, 125219, 155723, 186227 | 10219 | AGQ81003 | 10219 | 40723 | 71227, 101731, 132235, 162739, 193243 |
| 3204 | ACU80424 | 3204 | 33708 | 64212, 94716, 125220, 155724, 186228 | 10220 | AGQ81004 | 10220 | 40724 | 71228, 101732, 132236, 162740, 193244 |
| 3205 | ACU80435 | 3205 | 33709 | 64213, 94717, 125221, 155725, 186229 | 10221 | AGQ81005 | 10221 | 40725 | 71229, 101733, 132237, 162741, 193245 |
| 3206 | ACU80446 | 3206 | 33710 | 64214, 94718, 125222, 155726, 186230 | 10222 | AGQ81006 | 10222 | 40726 | 71230, 101734, 132238, 162742, 193246 |
| 3207 | ACU80458 | 3207 | 33711 | 64215, 94719, 125223, 155727, 186231 | 10223 | AGQ81007 | 10223 | 40727 | 71231, 101735, 132239, 162743, 193247 |
| 3208 | ACU80470 | 3208 | 33712 | 64216, 94720, 125224, 155728, 186232 | 10224 | AGQ81008 | 10224 | 40728 | 71232, 101736, 132240, 162744, 193248 |
| 3209 | ACU80600 | 3209 | 33713 | 64217, 94721, 125225, 155729, 186233 | 10225 | AGQ81009 | 10225 | 40729 | 71233, 101737, 132241, 162745, 193249 |
| 3210 | ACU80611 | 3210 | 33714 | 64218, 94722, 125226, 155730, 186234 | 10226 | AGQ81011 | 10226 | 40730 | 71234, 101738, 132242, 162746, 193250 |
| 3211 | ACU80622 | 3211 | 33715 | 64219, 94723, 125227, 155731, 186235 | 10227 | AGQ81012 | 10227 | 40731 | 71235, 101739, 132243, 162747, 193251 |
| 3212 | ACU80633 | 3212 | 33716 | 64220, 94724, 125228, 155732, 186236 | 10228 | AGQ81017 | 10228 | 40732 | 71236, 101740, 132244, 162748, 193252 |
| 3213 | ACU80644 | 3213 | 33717 | 64221, 94725, 125229, 155733, 186237 | 10229 | AGQ81018 | 10229 | 40733 | 71237, 101741, 132245, 162749, 193253 |
| 3214 | ACU80655 | 3214 | 33718 | 64222, 94726, 125230, 155734, 186238 | 10230 | AGQ81019 | 10230 | 40734 | 71238, 101742, 132246, 162750, 193254 |
| 3215 | ACU80666 | 3215 | 33719 | 64223, 94727, 125231, 155735, 186239 | 10231 | AGQ81020 | 10231 | 40735 | 71239, 101743, 132247, 162751, 193255 |

FIG. 1 continued

| | | | | | | | | | |
|---|---|---|---|---|---|---|---|---|---|
| 3216 | ACU80677 | 3216 | 33720 | 64224, 94728, 125232, 155736, 186240 | 10232 | AGQ81021 | 10232 | 40736 | 71240, 101744, 132248, 162752, 193256 |
| 3217 | ACU80688 | 3217 | 33721 | 64225, 94729, 125233, 155737, 186241 | 10233 | AGQ81022 | 10233 | 40737 | 71241, 101745, 132249, 162753, 193257 |
| 3218 | ACU80699 | 3218 | 33722 | 64226, 94730, 125234, 155738, 186242 | 10234 | AGQ81023 | 10234 | 40738 | 71242, 101746, 132250, 162754, 193258 |
| 3219 | ACU80710 | 3219 | 33723 | 64227, 94731, 125235, 155739, 186243 | 10235 | AGQ81025 | 10235 | 40739 | 71243, 101747, 132251, 162755, 193259 |
| 3220 | ACU80721 | 3220 | 33724 | 64228, 94732, 125236, 155740, 186244 | 10236 | AGQ81026 | 10236 | 40740 | 71244, 101748, 132252, 162756, 193260 |
| 3221 | ACU80732 | 3221 | 33725 | 64229, 94733, 125237, 155741, 186245 | 10237 | AGQ81027 | 10237 | 40741 | 71245, 101749, 132253, 162757, 193261 |
| 3222 | ACU80743 | 3222 | 33726 | 64230, 94734, 125238, 155742, 186246 | 10238 | AGQ81028 | 10238 | 40742 | 71246, 101750, 132254, 162758, 193262 |
| 3223 | ACU80754 | 3223 | 33727 | 64231, 94735, 125239, 155743, 186247 | 10239 | AGQ81029 | 10239 | 40743 | 71247, 101751, 132255, 162759, 193263 |
| 3224 | ACU80765 | 3224 | 33728 | 64232, 94736, 125240, 155744, 186248 | 10240 | AGQ81031 | 10240 | 40744 | 71248, 101752, 132256, 162760, 193264 |
| 3225 | ACU80787 | 3225 | 33729 | 64233, 94737, 125241, 155745, 186249 | 10241 | AGQ81032 | 10241 | 40745 | 71249, 101753, 132257, 162761, 193265 |
| 3226 | ACU80798 | 3226 | 33730 | 64234, 94738, 125242, 155746, 186250 | 10242 | AGQ81033 | 10242 | 40746 | 71250, 101754, 132258, 162762, 193266 |
| 3227 | ACU81103 | 3227 | 33731 | 64235, 94739, 125243, 155747, 186251 | 10243 | AGQ81034 | 10243 | 40747 | 71251, 101755, 132259, 162763, 193267 |
| 3228 | ACU87270 | 3228 | 33732 | 64236, 94740, 125244, 155748, 186252 | 10244 | AGQ81035 | 10244 | 40748 | 71252, 101756, 132260, 162764, 193268 |
| 3229 | ACV04228 | 3229 | 33733 | 64237, 94741, 125245, 155749, 186253 | 10245 | AGQ81036 | 10245 | 40749 | 71253, 101757, 132261, 162765, 193269 |
| 3230 | ACV04238 | 3230 | 33734 | 64238, 94742, 125246, 155750, 186254 | 10246 | AGQ81037 | 10246 | 40750 | 71254, 101758, 132262, 162766, 193270 |
| 3231 | ACV04248 | 3231 | 33735 | 64239, 94743, 125247, 155751, 186255 | 10247 | AGQ81038 | 10247 | 40751 | 71255, 101759, 132263, 162767, 193271 |
| 3232 | ACV04258 | 3232 | 33736 | 64240, 94744, 125248, 155752, 186256 | 10248 | AGQ81039 | 10248 | 40752 | 71256, 101760, 132264, 162768, 193272 |
| 3233 | ACV04268 | 3233 | 33737 | 64241, 94745, 125249, 155753, 186257 | 10249 | AGQ81040 | 10249 | 40753 | 71257, 101761, 132265, 162769, 193273 |

FIG. 1 continued

| | | | | | | | | | |
|---|---|---|---|---|---|---|---|---|---|
| 3234 | ACV04278 | 3234 | 33738 | 64242, 94746, 125250, 155754, 186258 | 10250 | AGQ81041 | 10250 | 40754 | 71258, 101762, 132266, 162770, 193274 |
| 3235 | ACV04288 | 3235 | 33739 | 64243, 94747, 125251, 155755, 186259 | 10251 | AGQ81042 | 10251 | 40755 | 71259, 101763, 132267, 162771, 193275 |
| 3236 | ACV04298 | 3236 | 33740 | 64244, 94748, 125252, 155756, 186260 | 10252 | AGQ81043 | 10252 | 40756 | 71260, 101764, 132268, 162772, 193276 |
| 3237 | ACV04308 | 3237 | 33741 | 64245, 94749, 125253, 155757, 186261 | 10253 | AGQ81044 | 10253 | 40757 | 71261, 101765, 132269, 162773, 193277 |
| 3238 | ACV04318 | 3238 | 33742 | 64246, 94750, 125254, 155758, 186262 | 10254 | AGQ81045 | 10254 | 40758 | 71262, 101766, 132270, 162774, 193278 |
| 3239 | ACV04328 | 3239 | 33743 | 64247, 94751, 125255, 155759, 186263 | 10255 | AGQ81046 | 10255 | 40759 | 71263, 101767, 132271, 162775, 193279 |
| 3240 | ACV04338 | 3240 | 33744 | 64248, 94752, 125256, 155760, 186264 | 10256 | AGQ81047 | 10256 | 40760 | 71264, 101768, 132272, 162776, 193280 |
| 3241 | ACV04358 | 3241 | 33745 | 64249, 94753, 125257, 155761, 186265 | 10257 | AGQ81049 | 10257 | 40761 | 71265, 101769, 132273, 162777, 193281 |
| 3242 | ACV04368 | 3242 | 33746 | 64250, 94754, 125258, 155762, 186266 | 10258 | AGQ81050 | 10258 | 40762 | 71266, 101770, 132274, 162778, 193282 |
| 3243 | ACV04378 | 3243 | 33747 | 64251, 94755, 125259, 155763, 186267 | 10259 | AGQ81051 | 10259 | 40763 | 71267, 101771, 132275, 162779, 193283 |
| 3244 | ACV04388 | 3244 | 33748 | 64252, 94756, 125260, 155764, 186268 | 10260 | AGQ81052 | 10260 | 40764 | 71268, 101772, 132276, 162780, 193284 |
| 3245 | ACV04398 | 3245 | 33749 | 64253, 94757, 125261, 155765, 186269 | 10261 | AGQ81053 | 10261 | 40765 | 71269, 101773, 132277, 162781, 193285 |
| 3246 | ACV04408 | 3246 | 33750 | 64254, 94758, 125262, 155766, 186270 | 10262 | AGQ81055 | 10262 | 40766 | 71270, 101774, 132278, 162782, 193286 |
| 3247 | ACV04489 | 3247 | 33751 | 64255, 94759, 125263, 155767, 186271 | 10263 | AGQ81056 | 10263 | 40767 | 71271, 101775, 132279, 162783, 193287 |
| 3248 | ACV04499 | 3248 | 33752 | 64256, 94760, 125264, 155768, 186272 | 10264 | AGQ81057 | 10264 | 40768 | 71272, 101776, 132280, 162784, 193288 |
| 3249 | ACV04509 | 3249 | 33753 | 64257, 94761, 125265, 155769, 186273 | 10265 | AGQ81058 | 10265 | 40769 | 71273, 101777, 132281, 162785, 193289 |
| 3250 | ACV04519 | 3250 | 33754 | 64258, 94762, 125266, 155770, 186274 | 10266 | AGQ81059 | 10266 | 40770 | 71274, 101778, 132282, 162786, 193290 |
| 3251 | ACV04529 | 3251 | 33755 | 64259, 94763, 125267, 155771, 186275 | 10267 | AGQ81060 | 10267 | 40771 | 71275, 101779, 132283, 162787, 193291 |

FIG. 1 continued

| | | | | | | | | | |
|---|---|---|---|---|---|---|---|---|---|
| 3252 | ACV04549 | 3252 | 33756 | 64260, 94764, 125268, 155772, 186276 | 10268 | AGQ81061 | 10268 | 40772 | 71276, 101780, 132284, 162788, 193292 |
| 3253 | ACV04559 | 3253 | 33757 | 64261, 94765, 125269, 155773, 186277 | 10269 | AGQ81081 | 10269 | 40773 | 71277, 101781, 132285, 162789, 193293 |
| 3254 | ACV04579 | 3254 | 33758 | 64262, 94766, 125270, 155774, 186278 | 10270 | AGQ81086 | 10270 | 40774 | 71278, 101782, 132286, 162790, 193294 |
| 3255 | ACV04751 | 3255 | 33759 | 64263, 94767, 125271, 155775, 186279 | 10271 | AGQ81087 | 10271 | 40775 | 71279, 101783, 132287, 162791, 193295 |
| 3256 | ACV04752 | 3256 | 33760 | 64264, 94768, 125272, 155776, 186280 | 10272 | AGQ81092 | 10272 | 40776 | 71280, 101784, 132288, 162792, 193296 |
| 3257 | ACV04753 | 3257 | 33761 | 64265, 94769, 125273, 155777, 186281 | 10273 | AGQ81095 | 10273 | 40777 | 71281, 101785, 132289, 162793, 193297 |
| 3258 | ACV04754 | 3258 | 33762 | 64266, 94770, 125274, 155778, 186282 | 10274 | AGQ81099 | 10274 | 40778 | 71282, 101786, 132290, 162794, 193298 |
| 3259 | ACV04755 | 3259 | 33763 | 64267, 94771, 125275, 155779, 186283 | 10275 | AGQ81100 | 10275 | 40779 | 71283, 101787, 132291, 162795, 193299 |
| 3260 | ACV33084 | 3260 | 33764 | 64268, 94772, 125276, 155780, 186284 | 10276 | AGQ81123 | 10276 | 40780 | 71284, 101788, 132292, 162796, 193300 |
| 3261 | ACV33094 | 3261 | 33765 | 64269, 94773, 125277, 155781, 186285 | 10277 | AGQ81124 | 10277 | 40781 | 71285, 101789, 132293, 162797, 193301 |
| 3262 | ACV33104 | 3262 | 33766 | 64270, 94774, 125278, 155782, 186286 | 10278 | AGQ81125 | 10278 | 40782 | 71286, 101790, 132294, 162798, 193302 |
| 3263 | ACV33114 | 3263 | 33767 | 64271, 94775, 125279, 155783, 186287 | 10279 | AGQ81126 | 10279 | 40783 | 71287, 101791, 132295, 162799, 193303 |
| 3264 | ACV33124 | 3264 | 33768 | 64272, 94776, 125280, 155784, 186288 | 10280 | AGQ81127 | 10280 | 40784 | 71288, 101792, 132296, 162800, 193304 |
| 3265 | ACV33134 | 3265 | 33769 | 64273, 94777, 125281, 155785, 186289 | 10281 | AGQ81128 | 10281 | 40785 | 71289, 101793, 132297, 162801, 193305 |
| 3266 | ACV33144 | 3266 | 33770 | 64274, 94778, 125282, 155786, 186290 | 10282 | AGQ81130 | 10282 | 40786 | 71290, 101794, 132298, 162802, 193306 |
| 3267 | ACV33154 | 3267 | 33771 | 64275, 94779, 125283, 155787, 186291 | 10283 | AGQ81132 | 10283 | 40787 | 71291, 101795, 132299, 162803, 193307 |
| 3268 | ACV33164 | 3268 | 33772 | 64276, 94780, 125284, 155788, 186292 | 10284 | AGQ81133 | 10284 | 40788 | 71292, 101796, 132300, 162804, 193308 |
| 3269 | ACV33174 | 3269 | 33773 | 64277, 94781, 125285, 155789, 186293 | 10285 | AGQ81134 | 10285 | 40789 | 71293, 101797, 132301, 162805, 193309 |

FIG. 1 continued

| | | | | | | | | | |
|---|---|---|---|---|---|---|---|---|---|
| 3270 | ACV41981 | 3270 | 33774 | 64278, 94782, 125286, 155790, 186294 | 10286 | AGQ81135 | 10286 | 40790 | 71294, 101798, 132302, 162806, 193310 |
| 3271 | ACV41991 | 3271 | 33775 | 64279, 94783, 125287, 155791, 186295 | 10287 | AGQ81136 | 10287 | 40791 | 71295, 101799, 132303, 162807, 193311 |
| 3272 | ACV42001 | 3272 | 33776 | 64280, 94784, 125288, 155792, 186296 | 10288 | AGQ81137 | 10288 | 40792 | 71296, 101800, 132304, 162808, 193312 |
| 3273 | ACV42008 | 3273 | 33777 | 64281, 94785, 125289, 155793, 186297 | 10289 | AGQ81138 | 10289 | 40793 | 71297, 101801, 132305, 162809, 193313 |
| 3274 | ACV42018 | 3274 | 33778 | 64282, 94786, 125290, 155794, 186298 | 10290 | AGQ81139 | 10290 | 40794 | 71298, 101802, 132306, 162810, 193314 |
| 3275 | ACV49501 | 3275 | 33779 | 64283, 94787, 125291, 155795, 186299 | 10291 | AGQ81141 | 10291 | 40795 | 71299, 101803, 132307, 162811, 193315 |
| 3276 | ACV49512 | 3276 | 33780 | 64284, 94788, 125292, 155796, 186300 | 10292 | AGQ81143 | 10292 | 40796 | 71300, 101804, 132308, 162812, 193316 |
| 3277 | ACV49523 | 3277 | 33781 | 64285, 94789, 125293, 155797, 186301 | 10293 | AGQ81144 | 10293 | 40797 | 71301, 101805, 132309, 162813, 193317 |
| 3278 | ACV49545 | 3278 | 33782 | 64286, 94790, 125294, 155798, 186302 | 10294 | AGQ81146 | 10294 | 40798 | 71302, 101806, 132310, 162814, 193318 |
| 3279 | ACV49556 | 3279 | 33783 | 64287, 94791, 125295, 155799, 186303 | 10295 | AGQ81147 | 10295 | 40799 | 71303, 101807, 132311, 162815, 193319 |
| 3280 | ACV49567 | 3280 | 33784 | 64288, 94792, 125296, 155800, 186304 | 10296 | AGQ81148 | 10296 | 40800 | 71304, 101808, 132312, 162816, 193320 |
| 3281 | ACV49578 | 3281 | 33785 | 64289, 94793, 125297, 155801, 186305 | 10297 | AGQ81149 | 10297 | 40801 | 71305, 101809, 132313, 162817, 193321 |
| 3282 | ACV49589 | 3282 | 33786 | 64290, 94794, 125298, 155802, 186306 | 10298 | AGQ81150 | 10298 | 40802 | 71306, 101810, 132314, 162818, 193322 |
| 3283 | ACV49600 | 3283 | 33787 | 64291, 94795, 125299, 155803, 186307 | 10299 | AGQ81152 | 10299 | 40803 | 71307, 101811, 132315, 162819, 193323 |
| 3284 | ACV49611 | 3284 | 33788 | 64292, 94796, 125300, 155804, 186308 | 10300 | AGQ81153 | 10300 | 40804 | 71308, 101812, 132316, 162820, 193324 |
| 3285 | ACV49633 | 3285 | 33789 | 64293, 94797, 125301, 155805, 186309 | 10301 | AGQ81155 | 10301 | 40805 | 71309, 101813, 132317, 162821, 193325 |
| 3286 | ACV49644 | 3286 | 33790 | 64294, 94798, 125302, 155806, 186310 | 10302 | AGQ81156 | 10302 | 40806 | 71310, 101814, 132318, 162822, 193326 |
| 3287 | ACV49676 | 3287 | 33791 | 64295, 94799, 125303, 155807, 186311 | 10303 | AGQ81157 | 10303 | 40807 | 71311, 101815, 132319, 162823, 193327 |

FIG. 1 continued

| | | | | | | | | | |
|---|---|---|---|---|---|---|---|---|---|
| 3288 | ACV53450 | 3288 | 33792 | 64296, 94800, 125304, 155808, 186312 | 10304 | AGQ81158 | 10304 | 40808 | 71312, 101816, 132320, 162824, 193328 |
| 3289 | ACV53460 | 3289 | 33793 | 64297, 94801, 125305, 155809, 186313 | 10305 | AGQ81159 | 10305 | 40809 | 71313, 101817, 132321, 162825, 193329 |
| 3290 | ACV53480 | 3290 | 33794 | 64298, 94802, 125306, 155810, 186314 | 10306 | AGQ81161 | 10306 | 40810 | 71314, 101818, 132322, 162826, 193330 |
| 3291 | ACV53490 | 3291 | 33795 | 64299, 94803, 125307, 155811, 186315 | 10307 | AGQ81162 | 10307 | 40811 | 71315, 101819, 132323, 162827, 193331 |
| 3292 | ACV53500 | 3292 | 33796 | 64300, 94804, 125308, 155812, 186316 | 10308 | AGQ81164 | 10308 | 40812 | 71316, 101820, 132324, 162828, 193332 |
| 3293 | ACV53880 | 3293 | 33797 | 64301, 94805, 125309, 155813, 186317 | 10309 | AGQ81167 | 10309 | 40813 | 71317, 101821, 132325, 162829, 193333 |
| 3294 | ACV53881 | 3294 | 33798 | 64302, 94806, 125310, 155814, 186318 | 10310 | AGQ81168 | 10310 | 40814 | 71318, 101822, 132326, 162830, 193334 |
| 3295 | ACV53882 | 3295 | 33799 | 64303, 94807, 125311, 155815, 186319 | 10311 | AGQ81169 | 10311 | 40815 | 71319, 101823, 132327, 162831, 193335 |
| 3296 | ACV53883 | 3296 | 33800 | 64304, 94808, 125312, 155816, 186320 | 10312 | AGQ81170 | 10312 | 40816 | 71320, 101824, 132328, 162832, 193336 |
| 3297 | ACV53885 | 3297 | 33801 | 64305, 94809, 125313, 155817, 186321 | 10313 | AGQ81171 | 10313 | 40817 | 71321, 101825, 132329, 162833, 193337 |
| 3298 | ACV53899 | 3298 | 33802 | 64306, 94810, 125314, 155818, 186322 | 10314 | AGQ81172 | 10314 | 40818 | 71322, 101826, 132330, 162834, 193338 |
| 3299 | ACV53909 | 3299 | 33803 | 64307, 94811, 125315, 155819, 186323 | 10315 | AGQ81173 | 10315 | 40819 | 71323, 101827, 132331, 162835, 193339 |
| 3300 | ACV67220 | 3300 | 33804 | 64308, 94812, 125316, 155820, 186324 | 10316 | AGQ81175 | 10316 | 40820 | 71324, 101828, 132332, 162836, 193340 |
| 3301 | ACV67221 | 3301 | 33805 | 64309, 94813, 125317, 155821, 186325 | 10317 | AGQ81177 | 10317 | 40821 | 71325, 101829, 132333, 162837, 193341 |
| 3302 | ACV67222 | 3302 | 33806 | 64310, 94814, 125318, 155822, 186326 | 10318 | AGQ81178 | 10318 | 40822 | 71326, 101830, 132334, 162838, 193342 |
| 3303 | ACV67223 | 3303 | 33807 | 64311, 94815, 125319, 155823, 186327 | 10319 | AGQ81181 | 10319 | 40823 | 71327, 101831, 132335, 162839, 193343 |
| 3304 | ACV67224 | 3304 | 33808 | 64312, 94816, 125320, 155824, 186328 | 10320 | AGQ81183 | 10320 | 40824 | 71328, 101832, 132336, 162840, 193344 |
| 3305 | ACV67225 | 3305 | 33809 | 64313, 94817, 125321, 155825, 186329 | 10321 | AGQ81184 | 10321 | 40825 | 71329, 101833, 132337, 162841, 193345 |

FIG. 1 continued

| | | | | | | | | | |
|---|---|---|---|---|---|---|---|---|---|
| 3306 | ACV67226 | 3306 | 33810 | 64314, 94818, 125322, 155826, 186330 | 10322 | AGQ81185 | 10322 | 40826 | 71330, 101834, 132338, 162842, 193346 |
| 3307 | ACV67227 | 3307 | 33811 | 64315, 94819, 125323, 155827, 186331 | 10323 | AGQ81186 | 10323 | 40827 | 71331, 101835, 132339, 162843, 193347 |
| 3308 | ACV67228 | 3308 | 33812 | 64316, 94820, 125324, 155828, 186332 | 10324 | AGQ81190 | 10324 | 40828 | 71332, 101836, 132340, 162844, 193348 |
| 3309 | ACV67229 | 3309 | 33813 | 64317, 94821, 125325, 155829, 186333 | 10325 | AGQ81191 | 10325 | 40829 | 71333, 101837, 132341, 162845, 193349 |
| 3310 | ACV67230 | 3310 | 33814 | 64318, 94822, 125326, 155830, 186334 | 10326 | AGQ81192 | 10326 | 40830 | 71334, 101838, 132342, 162846, 193350 |
| 3311 | ACV67231 | 3311 | 33815 | 64319, 94823, 125327, 155831, 186335 | 10327 | AGQ81193 | 10327 | 40831 | 71335, 101839, 132343, 162847, 193351 |
| 3312 | ACV67232 | 3312 | 33816 | 64320, 94824, 125328, 155832, 186336 | 10328 | AGQ81194 | 10328 | 40832 | 71336, 101840, 132344, 162848, 193352 |
| 3313 | ACV67233 | 3313 | 33817 | 64321, 94825, 125329, 155833, 186337 | 10329 | AGQ81195 | 10329 | 40833 | 71337, 101841, 132345, 162849, 193353 |
| 3314 | ACV67234 | 3314 | 33818 | 64322, 94826, 125330, 155834, 186338 | 10330 | AGQ81196 | 10330 | 40834 | 71338, 101842, 132346, 162850, 193354 |
| 3315 | ACV67235 | 3315 | 33819 | 64323, 94827, 125331, 155835, 186339 | 10331 | AGQ81198 | 10331 | 40835 | 71339, 101843, 132347, 162851, 193355 |
| 3316 | ACV67236 | 3316 | 33820 | 64324, 94828, 125332, 155836, 186340 | 10332 | AGQ81199 | 10332 | 40836 | 71340, 101844, 132348, 162852, 193356 |
| 3317 | ACV67238 | 3317 | 33821 | 64325, 94829, 125333, 155837, 186341 | 10333 | AGQ81200 | 10333 | 40837 | 71341, 101845, 132349, 162853, 193357 |
| 3318 | ACV67239 | 3318 | 33822 | 64326, 94830, 125334, 155838, 186342 | 10334 | AGQ81202 | 10334 | 40838 | 71342, 101846, 132350, 162854, 193358 |
| 3319 | ACV67240 | 3319 | 33823 | 64327, 94831, 125335, 155839, 186343 | 10335 | AGQ81203 | 10335 | 40839 | 71343, 101847, 132351, 162855, 193359 |
| 3320 | ACV67241 | 3320 | 33824 | 64328, 94832, 125336, 155840, 186344 | 10336 | AGQ81204 | 10336 | 40840 | 71344, 101848, 132352, 162856, 193360 |
| 3321 | ACV67242 | 3321 | 33825 | 64329, 94833, 125337, 155841, 186345 | 10337 | AGQ81205 | 10337 | 40841 | 71345, 101849, 132353, 162857, 193361 |
| 3322 | ACV67244 | 3322 | 33826 | 64330, 94834, 125338, 155842, 186346 | 10338 | AGQ81206 | 10338 | 40842 | 71346, 101850, 132354, 162858, 193362 |
| 3323 | ACV67246 | 3323 | 33827 | 64331, 94835, 125339, 155843, 186347 | 10339 | AGQ81209 | 10339 | 40843 | 71347, 101851, 132355, 162859, 193363 |

FIG. 1 continued

| | | | | | | | | | |
|---|---|---|---|---|---|---|---|---|---|
| 3324 | ACV67247 | 3324 | 33828 | 64332, 94836, 125340, 155844, 186348 | 10340 | AGQ81211 | 10340 | 40844 | 71348, 101852, 132356, 162860, 193364 |
| 3325 | ACV70073 | 3325 | 33829 | 64333, 94837, 125341, 155845, 186349 | 10341 | AGQ81213 | 10341 | 40845 | 71349, 101853, 132357, 162861, 193365 |
| 3326 | ACV70093 | 3326 | 33830 | 64334, 94838, 125342, 155846, 186350 | 10342 | AGQ81214 | 10342 | 40846 | 71350, 101854, 132358, 162862, 193366 |
| 3327 | ACV70103 | 3327 | 33831 | 64335, 94839, 125343, 155847, 186351 | 10343 | AGQ81215 | 10343 | 40847 | 71351, 101855, 132359, 162863, 193367 |
| 3328 | ACV70113 | 3328 | 33832 | 64336, 94840, 125344, 155848, 186352 | 10344 | AGQ81216 | 10344 | 40848 | 71352, 101856, 132360, 162864, 193368 |
| 3329 | ACV70123 | 3329 | 33833 | 64337, 94841, 125345, 155849, 186353 | 10345 | AGQ81217 | 10345 | 40849 | 71353, 101857, 132361, 162865, 193369 |
| 3330 | ACV70154 | 3330 | 33834 | 64338, 94842, 125346, 155850, 186354 | 10346 | AGQ88499 | 10346 | 40850 | 71354, 101858, 132362, 162866, 193370 |
| 3331 | ACV70164 | 3331 | 33835 | 64339, 94843, 125347, 155851, 186355 | 10347 | AGR33888 | 10347 | 40851 | 71355, 101859, 132363, 162867, 193371 |
| 3332 | ACV70174 | 3332 | 33836 | 64340, 94844, 125348, 155852, 186356 | 10348 | AGR33889 | 10348 | 40852 | 71356, 101860, 132364, 162868, 193372 |
| 3333 | ACV70184 | 3333 | 33837 | 64341, 94845, 125349, 155853, 186357 | 10349 | AGR33890 | 10349 | 40853 | 71357, 101861, 132365, 162869, 193373 |
| 3334 | ACV70194 | 3334 | 33838 | 64342, 94846, 125350, 155854, 186358 | 10350 | AGR33892 | 10350 | 40854 | 71358, 101862, 132366, 162870, 193374 |
| 3335 | ACV70204 | 3335 | 33839 | 64343, 94847, 125351, 155855, 186359 | 10351 | AGR33895 | 10351 | 40855 | 71359, 101863, 132367, 162871, 193375 |
| 3336 | ACV70214 | 3336 | 33840 | 64344, 94848, 125352, 155856, 186360 | 10352 | AGR33897 | 10352 | 40856 | 71360, 101864, 132368, 162872, 193376 |
| 3337 | ACV70224 | 3337 | 33841 | 64345, 94849, 125353, 155857, 186361 | 10353 | AGR33899 | 10353 | 40857 | 71361, 101865, 132369, 162873, 193377 |
| 3338 | ACV70234 | 3338 | 33842 | 64346, 94850, 125354, 155858, 186362 | 10354 | AGR33900 | 10354 | 40858 | 71362, 101866, 132370, 162874, 193378 |
| 3339 | ACV70254 | 3339 | 33843 | 64347, 94851, 125355, 155859, 186363 | 10355 | AGR33902 | 10355 | 40859 | 71363, 101867, 132371, 162875, 193379 |
| 3340 | ACV70264 | 3340 | 33844 | 64348, 94852, 125356, 155860, 186364 | 10356 | AGR49817 | 10356 | 40860 | 71364, 101868, 132372, 162876, 193380 |
| 3341 | ACV70274 | 3341 | 33845 | 64349, 94853, 125357, 155861, 186365 | 10357 | AGR49841 | 10357 | 40861 | 71365, 101869, 132373, 162877, 193381 |

FIG. 1 continued

| | | | | | | | | | |
|---|---|---|---|---|---|---|---|---|---|
| 3342 | ACV70284 | 3342 | 33846 | 64350, 94854, 125358, 155862, 186366 | 10358 | AGR49853 | 10358 | 40862 | 71366, 101870, 132374, 162878, 193382 |
| 3343 | ACV70294 | 3343 | 33847 | 64351, 94855, 125359, 155863, 186367 | 10359 | AGR49865 | 10359 | 40863 | 71367, 101871, 132375, 162879, 193383 |
| 3344 | ACV70304 | 3344 | 33848 | 64352, 94856, 125360, 155864, 186368 | 10360 | AGR49877 | 10360 | 40864 | 71368, 101872, 132376, 162880, 193384 |
| 3345 | ACV70314 | 3345 | 33849 | 64353, 94857, 125361, 155865, 186369 | 10361 | AGR49888 | 10361 | 40865 | 71369, 101873, 132377, 162881, 193385 |
| 3346 | ACV70324 | 3346 | 33850 | 64354, 94858, 125362, 155866, 186370 | 10362 | AGR49900 | 10362 | 40866 | 71370, 101874, 132378, 162882, 193386 |
| 3347 | ACV70334 | 3347 | 33851 | 64355, 94859, 125363, 155867, 186371 | 10363 | AGR49912 | 10363 | 40867 | 71371, 101875, 132379, 162883, 193387 |
| 3348 | ACV70344 | 3348 | 33852 | 64356, 94860, 125364, 155868, 186372 | 10364 | AGR49924 | 10364 | 40868 | 71372, 101876, 132380, 162884, 193388 |
| 3349 | ACV70354 | 3349 | 33853 | 64357, 94861, 125365, 155869, 186373 | 10365 | AGR49936 | 10365 | 40869 | 71373, 101877, 132381, 162885, 193389 |
| 3350 | ACV70364 | 3350 | 33854 | 64358, 94862, 125366, 155870, 186374 | 10366 | AGR49948 | 10366 | 40870 | 71374, 101878, 132382, 162886, 193390 |
| 3351 | ACV70374 | 3351 | 33855 | 64359, 94863, 125367, 155871, 186375 | 10367 | AGR49960 | 10367 | 40871 | 71375, 101879, 132383, 162887, 193391 |
| 3352 | ACV70384 | 3352 | 33856 | 64360, 94864, 125368, 155872, 186376 | 10368 | AGR49972 | 10368 | 40872 | 71376, 101880, 132384, 162888, 193392 |
| 3353 | ACV70394 | 3353 | 33857 | 64361, 94865, 125369, 155873, 186377 | 10369 | AGR49983 | 10369 | 40873 | 71377, 101881, 132385, 162889, 193393 |
| 3354 | ACV70404 | 3354 | 33858 | 64362, 94866, 125370, 155874, 186378 | 10370 | AGR49995 | 10370 | 40874 | 71378, 101882, 132386, 162890, 193394 |
| 3355 | ACV70414 | 3355 | 33859 | 64363, 94867, 125371, 155875, 186379 | 10371 | AGR50007 | 10371 | 40875 | 71379, 101883, 132387, 162891, 193395 |
| 3356 | ACV70424 | 3356 | 33860 | 64364, 94868, 125372, 155876, 186380 | 10372 | AGR50018 | 10372 | 40876 | 71380, 101884, 132388, 162892, 193396 |
| 3357 | ACV70434 | 3357 | 33861 | 64365, 94869, 125373, 155877, 186381 | 10373 | AGR50029 | 10373 | 40877 | 71381, 101885, 132389, 162893, 193397 |
| 3358 | ACV70444 | 3358 | 33862 | 64366, 94870, 125374, 155878, 186382 | 10374 | AGR50040 | 10374 | 40878 | 71382, 101886, 132390, 162894, 193398 |
| 3359 | ACV70454 | 3359 | 33863 | 64367, 94871, 125375, 155879, 186383 | 10375 | AGR50052 | 10375 | 40879 | 71383, 101887, 132391, 162895, 193399 |

FIG. 1 continued

| | | | | | | | | | |
|---|---|---|---|---|---|---|---|---|---|
| 3360 | ACV70464 | 3360 | 33864 | 64368, 94872, 125376, 155880, 186384 | 10376 | AGR50063 | 10376 | 40880 | 71384, 101888, 132392, 162896, 193400 |
| 3361 | ACV70474 | 3361 | 33865 | 64369, 94873, 125377, 155881, 186385 | 10377 | AGR50074 | 10377 | 40881 | 71385, 101889, 132393, 162897, 193401 |
| 3362 | ACV70484 | 3362 | 33866 | 64370, 94874, 125378, 155882, 186386 | 10378 | AGR50085 | 10378 | 40882 | 71386, 101890, 132394, 162898, 193402 |
| 3363 | ACV70494 | 3363 | 33867 | 64371, 94875, 125379, 155883, 186387 | 10379 | AGR50096 | 10379 | 40883 | 71387, 101891, 132395, 162899, 193403 |
| 3364 | ACV70504 | 3364 | 33868 | 64372, 94876, 125380, 155884, 186388 | 10380 | AGR50107 | 10380 | 40884 | 71388, 101892, 132396, 162900, 193404 |
| 3365 | ACV70514 | 3365 | 33869 | 64373, 94877, 125381, 155885, 186389 | 10381 | AGR50118 | 10381 | 40885 | 71389, 101893, 132397, 162901, 193405 |
| 3366 | ACV70524 | 3366 | 33870 | 64374, 94878, 125382, 155886, 186390 | 10382 | AGR50129 | 10382 | 40886 | 71390, 101894, 132398, 162902, 193406 |
| 3367 | ACV70534 | 3367 | 33871 | 64375, 94879, 125383, 155887, 186391 | 10383 | AGR50140 | 10383 | 40887 | 71391, 101895, 132399, 162903, 193407 |
| 3368 | ACV70544 | 3368 | 33872 | 64376, 94880, 125384, 155888, 186392 | 10384 | AGR50151 | 10384 | 40888 | 71392, 101896, 132400, 162904, 193408 |
| 3369 | ACV70564 | 3369 | 33873 | 64377, 94881, 125385, 155889, 186393 | 10385 | AGR50162 | 10385 | 40889 | 71393, 101897, 132401, 162905, 193409 |
| 3370 | ACV70584 | 3370 | 33874 | 64378, 94882, 125386, 155890, 186394 | 10386 | AGR50174 | 10386 | 40890 | 71394, 101898, 132402, 162906, 193410 |
| 3371 | ACV70594 | 3371 | 33875 | 64379, 94883, 125387, 155891, 186395 | 10387 | AGR50185 | 10387 | 40891 | 71395, 101899, 132403, 162907, 193411 |
| 3372 | ACV70604 | 3372 | 33876 | 64380, 94884, 125388, 155892, 186396 | 10388 | AGR50196 | 10388 | 40892 | 71396, 101900, 132404, 162908, 193412 |
| 3373 | ACV70614 | 3373 | 33877 | 64381, 94885, 125389, 155893, 186397 | 10389 | AGR50207 | 10389 | 40893 | 71397, 101901, 132405, 162909, 193413 |
| 3374 | ACV70624 | 3374 | 33878 | 64382, 94886, 125390, 155894, 186398 | 10390 | AGR50218 | 10390 | 40894 | 71398, 101902, 132406, 162910, 193414 |
| 3375 | ACV70634 | 3375 | 33879 | 64383, 94887, 125391, 155895, 186399 | 10391 | AGR50229 | 10391 | 40895 | 71399, 101903, 132407, 162911, 193415 |
| 3376 | ACV70644 | 3376 | 33880 | 64384, 94888, 125392, 155896, 186400 | 10392 | AGR50240 | 10392 | 40896 | 71400, 101904, 132408, 162912, 193416 |
| 3377 | ACV70654 | 3377 | 33881 | 64385, 94889, 125393, 155897, 186401 | 10393 | AGR50251 | 10393 | 40897 | 71401, 101905, 132409, 162913, 193417 |

FIG. 1 continued

| | | | | | | | | | |
|---|---|---|---|---|---|---|---|---|---|
| 3378 | ACV70664 | 3378 | 33882 | 64386, 94890, 125394, 155898, 186402 | 10394 | AGR50262 | 10394 | 40898 | 71402, 101906, 132410, 162914, 193418 |
| 3379 | ACV70674 | 3379 | 33883 | 64387, 94891, 125395, 155899, 186403 | 10395 | AGR50273 | 10395 | 40899 | 71403, 101907, 132411, 162915, 193419 |
| 3380 | ACV70684 | 3380 | 33884 | 64388, 94892, 125396, 155900, 186404 | 10396 | AGR50284 | 10396 | 40900 | 71404, 101908, 132412, 162916, 193420 |
| 3381 | ACV70694 | 3381 | 33885 | 64389, 94893, 125397, 155901, 186405 | 10397 | AGR50295 | 10397 | 40901 | 71405, 101909, 132413, 162917, 193421 |
| 3382 | ACV70704 | 3382 | 33886 | 64390, 94894, 125398, 155902, 186406 | 10398 | AGR50306 | 10398 | 40902 | 71406, 101910, 132414, 162918, 193422 |
| 3383 | ACV70714 | 3383 | 33887 | 64391, 94895, 125399, 155903, 186407 | 10399 | AGR50317 | 10399 | 40903 | 71407, 101911, 132415, 162919, 193423 |
| 3384 | ACV70724 | 3384 | 33888 | 64392, 94896, 125400, 155904, 186408 | 10400 | AGR50328 | 10400 | 40904 | 71408, 101912, 132416, 162920, 193424 |
| 3385 | ACV70734 | 3385 | 33889 | 64393, 94897, 125401, 155905, 186409 | 10401 | AGR50339 | 10401 | 40905 | 71409, 101913, 132417, 162921, 193425 |
| 3386 | ACV70744 | 3386 | 33890 | 64394, 94898, 125402, 155906, 186410 | 10402 | AGR50350 | 10402 | 40906 | 71410, 101914, 132418, 162922, 193426 |
| 3387 | ACV70754 | 3387 | 33891 | 64395, 94899, 125403, 155907, 186411 | 10403 | AGR50361 | 10403 | 40907 | 71411, 101915, 132419, 162923, 193427 |
| 3388 | ACV70764 | 3388 | 33892 | 64396, 94900, 125404, 155908, 186412 | 10404 | AGT18718 | 10404 | 40908 | 71412, 101916, 132420, 162924, 193428 |
| 3389 | ACV70784 | 3389 | 33893 | 64397, 94901, 125405, 155909, 186413 | 10405 | AGT18720 | 10405 | 40909 | 71413, 101917, 132421, 162925, 193429 |
| 3390 | ACV70794 | 3390 | 33894 | 64398, 94902, 125406, 155910, 186414 | 10406 | AGT18721 | 10406 | 40910 | 71414, 101918, 132422, 162926, 193430 |
| 3391 | ACV70804 | 3391 | 33895 | 64399, 94903, 125407, 155911, 186415 | 10407 | AGT18722 | 10407 | 40911 | 71415, 101919, 132423, 162927, 193431 |
| 3392 | ACV70824 | 3392 | 33896 | 64400, 94904, 125408, 155912, 186416 | 10408 | AGT18723 | 10408 | 40912 | 71416, 101920, 132424, 162928, 193432 |
| 3393 | ACV70834 | 3393 | 33897 | 64401, 94905, 125409, 155913, 186417 | 10409 | AGT18724 | 10409 | 40913 | 71417, 101921, 132425, 162929, 193433 |
| 3394 | ACV70844 | 3394 | 33898 | 64402, 94906, 125410, 155914, 186418 | 10410 | AGT18725 | 10410 | 40914 | 71418, 101922, 132426, 162930, 193434 |
| 3395 | ACV70854 | 3395 | 33899 | 64403, 94907, 125411, 155915, 186419 | 10411 | AGT18734 | 10411 | 40915 | 71419, 101923, 132427, 162931, 193435 |

FIG. 1 continued

| | | | | | | | | | |
|---|---|---|---|---|---|---|---|---|---|
| 3396 | ACV70864 | 3396 | 33900 | 64404, 94908, 125412, 155916, 186420 | 10412 | AGT18735 | 10412 | 40916 | 71420, 101924, 132428, 162932, 193436 |
| 3397 | ACV70874 | 3397 | 33901 | 64405, 94909, 125413, 155917, 186421 | 10413 | AGT18748 | 10413 | 40917 | 71421, 101925, 132429, 162933, 193437 |
| 3398 | ACV70884 | 3398 | 33902 | 64406, 94910, 125414, 155918, 186422 | 10414 | AGT18749 | 10414 | 40918 | 71422, 101926, 132430, 162934, 193438 |
| 3399 | ACV70904 | 3399 | 33903 | 64407, 94911, 125415, 155919, 186423 | 10415 | AGT18751 | 10415 | 40919 | 71423, 101927, 132431, 162935, 193439 |
| 3400 | ACV70914 | 3400 | 33904 | 64408, 94912, 125416, 155920, 186424 | 10416 | AGT18752 | 10416 | 40920 | 71424, 101928, 132432, 162936, 193440 |
| 3401 | ACV70924 | 3401 | 33905 | 64409, 94913, 125417, 155921, 186425 | 10417 | AGT18753 | 10417 | 40921 | 71425, 101929, 132433, 162937, 193441 |
| 3402 | ACV70934 | 3402 | 33906 | 64410, 94914, 125418, 155922, 186426 | 10418 | AGT18754 | 10418 | 40922 | 71426, 101930, 132434, 162938, 193442 |
| 3403 | ACV70944 | 3403 | 33907 | 64411, 94915, 125419, 155923, 186427 | 10419 | AGT18756 | 10419 | 40923 | 71427, 101931, 132435, 162939, 193443 |
| 3404 | ACV70954 | 3404 | 33908 | 64412, 94916, 125420, 155924, 186428 | 10420 | AGT18757 | 10420 | 40924 | 71428, 101932, 132436, 162940, 193444 |
| 3405 | ACV70964 | 3405 | 33909 | 64413, 94917, 125421, 155925, 186429 | 10421 | AGT18758 | 10421 | 40925 | 71429, 101933, 132437, 162941, 193445 |
| 3406 | ACV70974 | 3406 | 33910 | 64414, 94918, 125422, 155926, 186430 | 10422 | AGT18759 | 10422 | 40926 | 71430, 101934, 132438, 162942, 193446 |
| 3407 | ACV70984 | 3407 | 33911 | 64415, 94919, 125423, 155927, 186431 | 10423 | AGT18760 | 10423 | 40927 | 71431, 101935, 132439, 162943, 193447 |
| 3408 | ACV70994 | 3408 | 33912 | 64416, 94920, 125424, 155928, 186432 | 10424 | AGT18761 | 10424 | 40928 | 71432, 101936, 132440, 162944, 193448 |
| 3409 | ACV71004 | 3409 | 33913 | 64417, 94921, 125425, 155929, 186433 | 10425 | AGT37102 | 10425 | 40929 | 71433, 101937, 132441, 162945, 193449 |
| 3410 | ACV82230 | 3410 | 33914 | 64418, 94922, 125426, 155930, 186434 | 10426 | AGU01877 | 10426 | 40930 | 71434, 101938, 132442, 162946, 193450 |
| 3411 | ACV82232 | 3411 | 33915 | 64419, 94923, 125427, 155931, 186435 | 10427 | AGU01878 | 10427 | 40931 | 71435, 101939, 132443, 162947, 193451 |
| 3412 | ACV82233 | 3412 | 33916 | 64420, 94924, 125428, 155932, 186436 | 10428 | AGU01879 | 10428 | 40932 | 71436, 101940, 132444, 162948, 193452 |
| 3413 | ACV83662 | 3413 | 33917 | 64421, 94925, 125429, 155933, 186437 | 10429 | AGU01881 | 10429 | 40933 | 71437, 101941, 132445, 162949, 193453 |

FIG. 1 continued

| | | | | | | | | | |
|---|---|---|---|---|---|---|---|---|---|
| 3414 | ACV83663 | 3414 | 33918 | 64422, 94926, 125430, 155934, 186438 | 10430 | AGU01883 | 10430 | 40934 | 71438, 101942, 132446, 162950, 193454 |
| 3415 | ACV83664 | 3415 | 33919 | 64423, 94927, 125431, 155935, 186439 | 10431 | AGU01884 | 10431 | 40935 | 71439, 101943, 132447, 162951, 193455 |
| 3416 | ACV83665 | 3416 | 33920 | 64424, 94928, 125432, 155936, 186440 | 10432 | AGU01885 | 10432 | 40936 | 71440, 101944, 132448, 162952, 193456 |
| 3417 | ACV83667 | 3417 | 33921 | 64425, 94929, 125433, 155937, 186441 | 10433 | AGU01887 | 10433 | 40937 | 71441, 101945, 132449, 162953, 193457 |
| 3418 | ACV83668 | 3418 | 33922 | 64426, 94930, 125434, 155938, 186442 | 10434 | AGU01888 | 10434 | 40938 | 71442, 101946, 132450, 162954, 193458 |
| 3419 | ACV83670 | 3419 | 33923 | 64427, 94931, 125435, 155939, 186443 | 10435 | AGU01889 | 10435 | 40939 | 71443, 101947, 132451, 162955, 193459 |
| 3420 | ACV83671 | 3420 | 33924 | 64428, 94932, 125436, 155940, 186444 | 10436 | AGU01890 | 10436 | 40940 | 71444, 101948, 132452, 162956, 193460 |
| 3421 | ACV88399 | 3421 | 33925 | 64429, 94933, 125437, 155941, 186445 | 10437 | AGU92645 | 10437 | 40941 | 71445, 101949, 132453, 162957, 193461 |
| 3422 | ACV88409 | 3422 | 33926 | 64430, 94934, 125438, 155942, 186446 | 10438 | AGU92667 | 10438 | 40942 | 71446, 101950, 132454, 162958, 193462 |
| 3423 | ACV88419 | 3423 | 33927 | 64431, 94935, 125439, 155943, 186447 | 10439 | AGU92678 | 10439 | 40943 | 71447, 101951, 132455, 162959, 193463 |
| 3424 | ACV89502 | 3424 | 33928 | 64432, 94936, 125440, 155944, 186448 | 10440 | AGU92711 | 10440 | 40944 | 71448, 101952, 132456, 162960, 193464 |
| 3425 | ACV89516 | 3425 | 33929 | 64433, 94937, 125441, 155945, 186449 | 10441 | AGU92722 | 10441 | 40945 | 71449, 101953, 132457, 162961, 193465 |
| 3426 | ACV90512 | 3426 | 33930 | 64434, 94938, 125442, 155946, 186450 | 10442 | AGU92733 | 10442 | 40946 | 71450, 101954, 132458, 162962, 193466 |
| 3427 | ACV91672 | 3427 | 33931 | 64435, 94939, 125443, 155947, 186451 | 10443 | AGU92744 | 10443 | 40947 | 71451, 101955, 132459, 162963, 193467 |
| 3428 | ACV91676 | 3428 | 33932 | 64436, 94940, 125444, 155948, 186452 | 10444 | AGU92755 | 10444 | 40948 | 71452, 101956, 132460, 162964, 193468 |
| 3429 | ACV91680 | 3429 | 33933 | 64437, 94941, 125445, 155949, 186453 | 10445 | AGU92766 | 10445 | 40949 | 71453, 101957, 132461, 162965, 193469 |
| 3430 | ACX31591 | 3430 | 33934 | 64438, 94942, 125446, 155950, 186454 | 10446 | AGU92777 | 10446 | 40950 | 71454, 101958, 132462, 162966, 193470 |
| 3431 | ACX31933 | 3431 | 33935 | 64439, 94943, 125447, 155951, 186455 | 10447 | AGU92788 | 10447 | 40951 | 71455, 101959, 132463, 162967, 193471 |

FIG. 1 continued

| | | | | | | | | | |
|---|---|---|---|---|---|---|---|---|---|
| 3432 | ACX31934 | 3432 | 33936 | 64440, 94944, 125448, 155952, 186456 | 10448 | AGU92799 | 10448 | 40952 | 71456, 101960, 132464, 162968, 193472 |
| 3433 | ACX31935 | 3433 | 33937 | 64441, 94945, 125449, 155953, 186457 | 10449 | AGU92821 | 10449 | 40953 | 71457, 101961, 132465, 162969, 193473 |
| 3434 | ACX31936 | 3434 | 33938 | 64442, 94946, 125450, 155954, 186458 | 10450 | AGU92843 | 10450 | 40954 | 71458, 101962, 132466, 162970, 193474 |
| 3435 | ACX31939 | 3435 | 33939 | 64443, 94947, 125451, 155955, 186459 | 10451 | AGU92854 | 10451 | 40955 | 71459, 101963, 132467, 162971, 193475 |
| 3436 | ACX31940 | 3436 | 33940 | 64444, 94948, 125452, 155956, 186460 | 10452 | AGU92887 | 10452 | 40956 | 71460, 101964, 132468, 162972, 193476 |
| 3437 | ACX31943 | 3437 | 33941 | 64445, 94949, 125453, 155957, 186461 | 10453 | AGU92898 | 10453 | 40957 | 71461, 101965, 132469, 162973, 193477 |
| 3438 | ACX31946 | 3438 | 33942 | 64446, 94950, 125454, 155958, 186462 | 10454 | AGU92909 | 10454 | 40958 | 71462, 101966, 132470, 162974, 193478 |
| 3439 | ACX31947 | 3439 | 33943 | 64447, 94951, 125455, 155959, 186463 | 10455 | AGU92931 | 10455 | 40959 | 71463, 101967, 132471, 162975, 193479 |
| 3440 | ACX31948 | 3440 | 33944 | 64448, 94952, 125456, 155960, 186464 | 10456 | AGU92942 | 10456 | 40960 | 71464, 101968, 132472, 162976, 193480 |
| 3441 | ACX31949 | 3441 | 33945 | 64449, 94953, 125457, 155961, 186465 | 10457 | AGU92953 | 10457 | 40961 | 71465, 101969, 132473, 162977, 193481 |
| 3442 | ACX31950 | 3442 | 33946 | 64450, 94954, 125458, 155962, 186466 | 10458 | AGU92964 | 10458 | 40962 | 71466, 101970, 132474, 162978, 193482 |
| 3443 | ACX31951 | 3443 | 33947 | 64451, 94955, 125459, 155963, 186467 | 10459 | AGU92975 | 10459 | 40963 | 71467, 101971, 132475, 162979, 193483 |
| 3444 | ACX31954 | 3444 | 33948 | 64452, 94956, 125460, 155964, 186468 | 10460 | AGU92986 | 10460 | 40964 | 71468, 101972, 132476, 162980, 193484 |
| 3445 | ACX31955 | 3445 | 33949 | 64453, 94957, 125461, 155965, 186469 | 10461 | AGU92997 | 10461 | 40965 | 71469, 101973, 132477, 162981, 193485 |
| 3446 | ACX31956 | 3446 | 33950 | 64454, 94958, 125462, 155966, 186470 | 10462 | AGU93008 | 10462 | 40966 | 71470, 101974, 132478, 162982, 193486 |
| 3447 | ACX31957 | 3447 | 33951 | 64455, 94959, 125463, 155967, 186471 | 10463 | AGU93019 | 10463 | 40967 | 71471, 101975, 132479, 162983, 193487 |
| 3448 | ACX31958 | 3448 | 33952 | 64456, 94960, 125464, 155968, 186472 | 10464 | AGU93031 | 10464 | 40968 | 71472, 101976, 132480, 162984, 193488 |
| 3449 | ACX31960 | 3449 | 33953 | 64457, 94961, 125465, 155969, 186473 | 10465 | AGU93042 | 10465 | 40969 | 71473, 101977, 132481, 162985, 193489 |

FIG. 1 continued

| | | | | | | | | | |
|---|---|---|---|---|---|---|---|---|---|
| 3450 | ACX31961 | 3450 | 33954 | 64458, 94962, 125466, 155970, 186474 | 10466 | AGU93053 | 10466 | 40970 | 71474, 101978, 132482, 162986, 193490 |
| 3451 | ACX31962 | 3451 | 33955 | 64459, 94963, 125467, 155971, 186475 | 10467 | AGV99014 | 10467 | 40971 | 71475, 101979, 132483, 162987, 193491 |
| 3452 | ACX31964 | 3452 | 33956 | 64460, 94964, 125468, 155972, 186476 | 10468 | AGV99037 | 10468 | 40972 | 71476, 101980, 132484, 162988, 193492 |
| 3453 | ACX35237 | 3453 | 33957 | 64461, 94965, 125469, 155973, 186477 | 10469 | AGV99049 | 10469 | 40973 | 71477, 101981, 132485, 162989, 193493 |
| 3454 | ACX35247 | 3454 | 33958 | 64462, 94966, 125470, 155974, 186478 | 10470 | AGV99073 | 10470 | 40974 | 71478, 101982, 132486, 162990, 193494 |
| 3455 | ACX35257 | 3455 | 33959 | 64463, 94967, 125471, 155975, 186479 | 10471 | AGV99085 | 10471 | 40975 | 71479, 101983, 132487, 162991, 193495 |
| 3456 | ACX35267 | 3456 | 33960 | 64464, 94968, 125472, 155976, 186480 | 10472 | AGV99097 | 10472 | 40976 | 71480, 101984, 132488, 162992, 193496 |
| 3457 | ACX35277 | 3457 | 33961 | 64465, 94969, 125473, 155977, 186481 | 10473 | AGV99121 | 10473 | 40977 | 71481, 101985, 132489, 162993, 193497 |
| 3458 | ACX35287 | 3458 | 33962 | 64466, 94970, 125474, 155978, 186482 | 10474 | AGV99133 | 10474 | 40978 | 71482, 101986, 132490, 162994, 193498 |
| 3459 | ACX35297 | 3459 | 33963 | 64467, 94971, 125475, 155979, 186483 | 10475 | AGV99145 | 10475 | 40979 | 71483, 101987, 132491, 162995, 193499 |
| 3460 | ACX35307 | 3460 | 33964 | 64468, 94972, 125476, 155980, 186484 | 10476 | AGV99157 | 10476 | 40980 | 71484, 101988, 132492, 162996, 193500 |
| 3461 | ACX35317 | 3461 | 33965 | 64469, 94973, 125477, 155981, 186485 | 10477 | AGV99169 | 10477 | 40981 | 71485, 101989, 132493, 162997, 193501 |
| 3462 | ACX35327 | 3462 | 33966 | 64470, 94974, 125478, 155982, 186486 | 10478 | AGV99181 | 10478 | 40982 | 71486, 101990, 132494, 162998, 193502 |
| 3463 | ACX36501 | 3463 | 33967 | 64471, 94975, 125479, 155983, 186487 | 10479 | AGV99193 | 10479 | 40983 | 71487, 101991, 132495, 162999, 193503 |
| 3464 | ACX36502 | 3464 | 33968 | 64472, 94976, 125480, 155984, 186488 | 10480 | AGV99956 | 10480 | 40984 | 71488, 101992, 132496, 163000, 193504 |
| 3465 | ACX36503 | 3465 | 33969 | 64473, 94977, 125481, 155985, 186489 | 10481 | AGV99986 | 10481 | 40985 | 71489, 101993, 132497, 163001, 193505 |
| 3466 | ACX47367 | 3466 | 33970 | 64474, 94978, 125482, 155986, 186490 | 10482 | AGW00065 | 10482 | 40986 | 71490, 101994, 132498, 163002, 193506 |
| 3467 | ACX47368 | 3467 | 33971 | 64475, 94979, 125483, 155987, 186491 | 10483 | AGW00077 | 10483 | 40987 | 71491, 101995, 132499, 163003, 193507 |

FIG. 1 continued

| | | | | | | | | | |
|---|---|---|---|---|---|---|---|---|---|
| 3468 | ACX47369 | 3468 | 33972 | 64476, 94980, 125484, 155988, 186492 | 10484 | AGW00089 | 10484 | 40988 | 71492, 101996, 132500, 163004, 193508 |
| 3469 | ACX47370 | 3469 | 33973 | 64477, 94981, 125485, 155989, 186493 | 10485 | AGW00101 | 10485 | 40989 | 71493, 101997, 132501, 163005, 193509 |
| 3470 | ACX47371 | 3470 | 33974 | 64478, 94982, 125486, 155990, 186494 | 10486 | AGW00113 | 10486 | 40990 | 71494, 101998, 132502, 163006, 193510 |
| 3471 | ACX47372 | 3471 | 33975 | 64479, 94983, 125487, 155991, 186495 | 10487 | AGW00125 | 10487 | 40991 | 71495, 101999, 132503, 163007, 193511 |
| 3472 | ACX47373 | 3472 | 33976 | 64480, 94984, 125488, 155992, 186496 | 10488 | AGW00137 | 10488 | 40992 | 71496, 102000, 132504, 163008, 193512 |
| 3473 | ACX47374 | 3473 | 33977 | 64481, 94985, 125489, 155993, 186497 | 10489 | AGW00149 | 10489 | 40993 | 71497, 102001, 132505, 163009, 193513 |
| 3474 | ACX47375 | 3474 | 33978 | 64482, 94986, 125490, 155994, 186498 | 10490 | AGW00161 | 10490 | 40994 | 71498, 102002, 132506, 163010, 193514 |
| 3475 | ACX47376 | 3475 | 33979 | 64483, 94987, 125491, 155995, 186499 | 10491 | AGW00173 | 10491 | 40995 | 71499, 102003, 132507, 163011, 193515 |
| 3476 | ACX47377 | 3476 | 33980 | 64484, 94988, 125492, 155996, 186500 | 10492 | AGW00185 | 10492 | 40996 | 71500, 102004, 132508, 163012, 193516 |
| 3477 | ACX47380 | 3477 | 33981 | 64485, 94989, 125493, 155997, 186501 | 10493 | AGW00709 | 10493 | 40997 | 71501, 102005, 132509, 163013, 193517 |
| 3478 | ACX47381 | 3478 | 33982 | 64486, 94990, 125494, 155998, 186502 | 10494 | AGW00721 | 10494 | 40998 | 71502, 102006, 132510, 163014, 193518 |
| 3479 | ACX47382 | 3479 | 33983 | 64487, 94991, 125495, 155999, 186503 | 10495 | AGW00733 | 10495 | 40999 | 71503, 102007, 132511, 163015, 193519 |
| 3480 | ACX47383 | 3480 | 33984 | 64488, 94992, 125496, 156000, 186504 | 10496 | AGW00745 | 10496 | 41000 | 71504, 102008, 132512, 163016, 193520 |
| 3481 | ACX47384 | 3481 | 33985 | 64489, 94993, 125497, 156001, 186505 | 10497 | AGW00757 | 10497 | 41001 | 71505, 102009, 132513, 163017, 193521 |
| 3482 | ACX47385 | 3482 | 33986 | 64490, 94994, 125498, 156002, 186506 | 10498 | AGW00769 | 10498 | 41002 | 71506, 102010, 132514, 163018, 193522 |
| 3483 | ACX47387 | 3483 | 33987 | 64491, 94995, 125499, 156003, 186507 | 10499 | AGW00781 | 10499 | 41003 | 71507, 102011, 132515, 163019, 193523 |
| 3484 | ACX55834 | 3484 | 33988 | 64492, 94996, 125500, 156004, 186508 | 10500 | AGW00793 | 10500 | 41004 | 71508, 102012, 132516, 163020, 193524 |
| 3485 | ACX61574 | 3485 | 33989 | 64493, 94997, 125501, 156005, 186509 | 10501 | AGW00805 | 10501 | 41005 | 71509, 102013, 132517, 163021, 193525 |

FIG. 1 continued

| | | | | | | | | | |
|---|---|---|---|---|---|---|---|---|---|
| 3486 | ACX61575 | 3486 | 33990 | 64494, 94998, 125502, 156006, 186510 | 10502 | AGW00817 | 10502 | 41006 | 71510, 102014, 132518, 163022, 193526 |
| 3487 | ACX83577 | 3487 | 33991 | 64495, 94999, 125503, 156007, 186511 | 10503 | AGW00829 | 10503 | 41007 | 71511, 102015, 132519, 163023, 193527 |
| 3488 | ACX94091 | 3488 | 33992 | 64496, 95000, 125504, 156008, 186512 | 10504 | AGW00841 | 10504 | 41008 | 71512, 102016, 132520, 163024, 193528 |
| 3489 | ACY26192 | 3489 | 33993 | 64497, 95001, 125505, 156009, 186513 | 10505 | AGW00853 | 10505 | 41009 | 71513, 102017, 132521, 163025, 193529 |
| 3490 | ACY26202 | 3490 | 33994 | 64498, 95002, 125506, 156010, 186514 | 10506 | AGW00865 | 10506 | 41010 | 71514, 102018, 132522, 163026, 193530 |
| 3491 | ACY46103 | 3491 | 33995 | 64499, 95003, 125507, 156011, 186515 | 10507 | AGW00877 | 10507 | 41011 | 71515, 102019, 132523, 163027, 193531 |
| 3492 | ACY46113 | 3492 | 33996 | 64500, 95004, 125508, 156012, 186516 | 10508 | AGW00889 | 10508 | 41012 | 71516, 102020, 132524, 163028, 193532 |
| 3493 | ACY46123 | 3493 | 33997 | 64501, 95005, 125509, 156013, 186517 | 10509 | AGW00901 | 10509 | 41013 | 71517, 102021, 132525, 163029, 193533 |
| 3494 | ACY46133 | 3494 | 33998 | 64502, 95006, 125510, 156014, 186518 | 10510 | AGW00913 | 10510 | 41014 | 71518, 102022, 132526, 163030, 193534 |
| 3495 | ACY46163 | 3495 | 33999 | 64503, 95007, 125511, 156015, 186519 | 10511 | AGW00931 | 10511 | 41015 | 71519, 102023, 132527, 163031, 193535 |
| 3496 | ACY46173 | 3496 | 34000 | 64504, 95008, 125512, 156016, 186520 | 10512 | AGW01244 | 10512 | 41016 | 71520, 102024, 132528, 163032, 193536 |
| 3497 | ACY46213 | 3497 | 34001 | 64505, 95009, 125513, 156017, 186521 | 10513 | AGW01256 | 10513 | 41017 | 71521, 102025, 132529, 163033, 193537 |
| 3498 | ACY46223 | 3498 | 34002 | 64506, 95010, 125514, 156018, 186522 | 10514 | AGW01295 | 10514 | 41018 | 71522, 102026, 132530, 163034, 193538 |
| 3499 | ACY46233 | 3499 | 34003 | 64507, 95011, 125515, 156019, 186523 | 10515 | AGW01307 | 10515 | 41019 | 71523, 102027, 132531, 163035, 193539 |
| 3500 | ACY46243 | 3500 | 34004 | 64508, 95012, 125516, 156020, 186524 | 10516 | AGW01319 | 10516 | 41020 | 71524, 102028, 132532, 163036, 193540 |
| 3501 | ACY46253 | 3501 | 34005 | 64509, 95013, 125517, 156021, 186525 | 10517 | AGW01331 | 10517 | 41021 | 71525, 102029, 132533, 163037, 193541 |
| 3502 | ACY46263 | 3502 | 34006 | 64510, 95014, 125518, 156022, 186526 | 10518 | AGW01343 | 10518 | 41022 | 71526, 102030, 132534, 163038, 193542 |
| 3503 | ACY46273 | 3503 | 34007 | 64511, 95015, 125519, 156023, 186527 | 10519 | AGW01355 | 10519 | 41023 | 71527, 102031, 132535, 163039, 193543 |

FIG. 1 continued

| | | | | | | | | | |
|---|---|---|---|---|---|---|---|---|---|
| 3504 | ACY46283 | 3504 | 34008 | 64512, 95016, 125520, 156024, 186528 | 10520 | AGW01367 | 10520 | 41024 | 71528, 102032, 132536, 163040, 193544 |
| 3505 | ACY46293 | 3505 | 34009 | 64513, 95017, 125521, 156025, 186529 | 10521 | AGW01391 | 10521 | 41025 | 71529, 102033, 132537, 163041, 193545 |
| 3506 | ACY46303 | 3506 | 34010 | 64514, 95018, 125522, 156026, 186530 | 10522 | AGW01403 | 10522 | 41026 | 71530, 102034, 132538, 163042, 193546 |
| 3507 | ACY46313 | 3507 | 34011 | 64515, 95019, 125523, 156027, 186531 | 10523 | AGW01415 | 10523 | 41027 | 71531, 102035, 132539, 163043, 193547 |
| 3508 | ACY46323 | 3508 | 34012 | 64516, 95020, 125524, 156028, 186532 | 10524 | AGW01427 | 10524 | 41028 | 71532, 102036, 132540, 163044, 193548 |
| 3509 | ACY46343 | 3509 | 34013 | 64517, 95021, 125525, 156029, 186533 | 10525 | AGW01439 | 10525 | 41029 | 71533, 102037, 132541, 163045, 193549 |
| 3510 | ACY46353 | 3510 | 34014 | 64518, 95022, 125526, 156030, 186534 | 10526 | AGW01451 | 10526 | 41030 | 71534, 102038, 132542, 163046, 193550 |
| 3511 | ACY46373 | 3511 | 34015 | 64519, 95023, 125527, 156031, 186535 | 10527 | AGW01463 | 10527 | 41031 | 71535, 102039, 132543, 163047, 193551 |
| 3512 | ACY46383 | 3512 | 34016 | 64520, 95024, 125528, 156032, 186536 | 10528 | AGW01475 | 10528 | 41032 | 71536, 102040, 132544, 163048, 193552 |
| 3513 | ACY46393 | 3513 | 34017 | 64521, 95025, 125529, 156033, 186537 | 10529 | AGW01487 | 10529 | 41033 | 71537, 102041, 132545, 163049, 193553 |
| 3514 | ACY46403 | 3514 | 34018 | 64522, 95026, 125530, 156034, 186538 | 10530 | AGW01499 | 10530 | 41034 | 71538, 102042, 132546, 163050, 193554 |
| 3515 | ACY46413 | 3515 | 34019 | 64523, 95027, 125531, 156035, 186539 | 10531 | AGW01511 | 10531 | 41035 | 71539, 102043, 132547, 163051, 193555 |
| 3516 | ACY46433 | 3516 | 34020 | 64524, 95028, 125532, 156036, 186540 | 10532 | AGW01535 | 10532 | 41036 | 71540, 102044, 132548, 163052, 193556 |
| 3517 | ACY46443 | 3517 | 34021 | 64525, 95029, 125533, 156037, 186541 | 10533 | AGW01547 | 10533 | 41037 | 71541, 102045, 132549, 163053, 193557 |
| 3518 | ACY46453 | 3518 | 34022 | 64526, 95030, 125534, 156038, 186542 | 10534 | AGW01559 | 10534 | 41038 | 71542, 102046, 132550, 163054, 193558 |
| 3519 | ACY46463 | 3519 | 34023 | 64527, 95031, 125535, 156039, 186543 | 10535 | AGW01571 | 10535 | 41039 | 71543, 102047, 132551, 163055, 193559 |
| 3520 | ACY46473 | 3520 | 34024 | 64528, 95032, 125536, 156040, 186544 | 10536 | AGW01583 | 10536 | 41040 | 71544, 102048, 132552, 163056, 193560 |
| 3521 | ACY46493 | 3521 | 34025 | 64529, 95033, 125537, 156041, 186545 | 10537 | AGW01595 | 10537 | 41041 | 71545, 102049, 132553, 163057, 193561 |

FIG. 1 continued

| | | | | | | | | | |
|---|---|---|---|---|---|---|---|---|---|
| 3522 | ACY46513 | 3522 | 34026 | 64530, 95034, 125538, 156042, 186546 | 10538 | AGW01607 | 10538 | 41042 | 71546, 102050, 132554, 163058, 193562 |
| 3523 | ACY46523 | 3523 | 34027 | 64531, 95035, 125539, 156043, 186547 | 10539 | AGW01619 | 10539 | 41043 | 71547, 102051, 132555, 163059, 193563 |
| 3524 | ACY46533 | 3524 | 34028 | 64532, 95036, 125540, 156044, 186548 | 10540 | AGW01631 | 10540 | 41044 | 71548, 102052, 132556, 163060, 193564 |
| 3525 | ACY46562 | 3525 | 34029 | 64533, 95037, 125541, 156045, 186549 | 10541 | AGW01643 | 10541 | 41045 | 71549, 102053, 132557, 163061, 193565 |
| 3526 | ACY46572 | 3526 | 34030 | 64534, 95038, 125542, 156046, 186550 | 10542 | AGW01655 | 10542 | 41046 | 71550, 102054, 132558, 163062, 193566 |
| 3527 | ACY46582 | 3527 | 34031 | 64535, 95039, 125543, 156047, 186551 | 10543 | AGW01667 | 10543 | 41047 | 71551, 102055, 132559, 163063, 193567 |
| 3528 | ACY46592 | 3528 | 34032 | 64536, 95040, 125544, 156048, 186552 | 10544 | AGW01679 | 10544 | 41048 | 71552, 102056, 132560, 163064, 193568 |
| 3529 | ACY46622 | 3529 | 34033 | 64537, 95041, 125545, 156049, 186553 | 10545 | AGW01691 | 10545 | 41049 | 71553, 102057, 132561, 163065, 193569 |
| 3530 | ACY46672 | 3530 | 34034 | 64538, 95042, 125546, 156050, 186554 | 10546 | AGW01701 | 10546 | 41050 | 71554, 102058, 132562, 163066, 193570 |
| 3531 | ACY46682 | 3531 | 34035 | 64539, 95043, 125547, 156051, 186555 | 10547 | AGW01713 | 10547 | 41051 | 71555, 102059, 132563, 163067, 193571 |
| 3532 | ACY46692 | 3532 | 34036 | 64540, 95044, 125548, 156052, 186556 | 10548 | AGW01725 | 10548 | 41052 | 71556, 102060, 132564, 163068, 193572 |
| 3533 | ACY46712 | 3533 | 34037 | 64541, 95045, 125549, 156053, 186557 | 10549 | AGW01737 | 10549 | 41053 | 71557, 102061, 132565, 163069, 193573 |
| 3534 | ACY46722 | 3534 | 34038 | 64542, 95046, 125550, 156054, 186558 | 10550 | AGW01749 | 10550 | 41054 | 71558, 102062, 132566, 163070, 193574 |
| 3535 | ACY46742 | 3535 | 34039 | 64543, 95047, 125551, 156055, 186559 | 10551 | AGW01761 | 10551 | 41055 | 71559, 102063, 132567, 163071, 193575 |
| 3536 | ACY46762 | 3536 | 34040 | 64544, 95048, 125552, 156056, 186560 | 10552 | AGW01773 | 10552 | 41056 | 71560, 102064, 132568, 163072, 193576 |
| 3537 | ACY46772 | 3537 | 34041 | 64545, 95049, 125553, 156057, 186561 | 10553 | AGW01785 | 10553 | 41057 | 71561, 102065, 132569, 163073, 193577 |
| 3538 | ACY46903 | 3538 | 34042 | 64546, 95050, 125554, 156058, 186562 | 10554 | AGW01797 | 10554 | 41058 | 71562, 102066, 132570, 163074, 193578 |
| 3539 | ACY77534 | 3539 | 34043 | 64547, 95051, 125555, 156059, 186563 | 10555 | AGW01809 | 10555 | 41059 | 71563, 102067, 132571, 163075, 193579 |

FIG. 1 continued

| | | | | | | | | | |
|---|---|---|---|---|---|---|---|---|---|
| 3540 | ACY77544 | 3540 | 34044 | 64548, 95052, 125556, 156060, 186564 | 10556 | AGW01821 | 10556 | 41060 | 71564, 102068, 132572, 163076, 193580 |
| 3541 | ACY77554 | 3541 | 34045 | 64549, 95053, 125557, 156061, 186565 | 10557 | AGW01833 | 10557 | 41061 | 71565, 102069, 132573, 163077, 193581 |
| 3542 | ACY77573 | 3542 | 34046 | 64550, 95054, 125558, 156062, 186566 | 10558 | AGW01845 | 10558 | 41062 | 71566, 102070, 132574, 163078, 193582 |
| 3543 | ACY77593 | 3543 | 34047 | 64551, 95055, 125559, 156063, 186567 | 10559 | AGW01857 | 10559 | 41063 | 71567, 102071, 132575, 163079, 193583 |
| 3544 | ACY77603 | 3544 | 34048 | 64552, 95056, 125560, 156064, 186568 | 10560 | AGW01869 | 10560 | 41064 | 71568, 102072, 132576, 163080, 193584 |
| 3545 | ACY77613 | 3545 | 34049 | 64553, 95057, 125561, 156065, 186569 | 10561 | AGW01881 | 10561 | 41065 | 71569, 102073, 132577, 163081, 193585 |
| 3546 | ACY77623 | 3546 | 34050 | 64554, 95058, 125562, 156066, 186570 | 10562 | AGW01893 | 10562 | 41066 | 71570, 102074, 132578, 163082, 193586 |
| 3547 | ACY77653 | 3547 | 34051 | 64555, 95059, 125563, 156067, 186571 | 10563 | AGW01905 | 10563 | 41067 | 71571, 102075, 132579, 163083, 193587 |
| 3548 | ACY77663 | 3548 | 34052 | 64556, 95060, 125564, 156068, 186572 | 10564 | AGW01917 | 10564 | 41068 | 71572, 102076, 132580, 163084, 193588 |
| 3549 | ACY77683 | 3549 | 34053 | 64557, 95061, 125565, 156069, 186573 | 10565 | AGW01929 | 10565 | 41069 | 71573, 102077, 132581, 163085, 193589 |
| 3550 | ACY77693 | 3550 | 34054 | 64558, 95062, 125566, 156070, 186574 | 10566 | AGW01941 | 10566 | 41070 | 71574, 102078, 132582, 163086, 193590 |
| 3551 | ACY77703 | 3551 | 34055 | 64559, 95063, 125567, 156071, 186575 | 10567 | AGW01953 | 10567 | 41071 | 71575, 102079, 132583, 163087, 193591 |
| 3552 | ACY77713 | 3552 | 34056 | 64560, 95064, 125568, 156072, 186576 | 10568 | AGW01965 | 10568 | 41072 | 71576, 102080, 132584, 163088, 193592 |
| 3553 | ACY77723 | 3553 | 34057 | 64561, 95065, 125569, 156073, 186577 | 10569 | AGW01977 | 10569 | 41073 | 71577, 102081, 132585, 163089, 193593 |
| 3554 | ACY77733 | 3554 | 34058 | 64562, 95066, 125570, 156074, 186578 | 10570 | AGW01989 | 10570 | 41074 | 71578, 102082, 132586, 163090, 193594 |
| 3555 | ACY77743 | 3555 | 34059 | 64563, 95067, 125571, 156075, 186579 | 10571 | AGW02001 | 10571 | 41075 | 71579, 102083, 132587, 163091, 193595 |
| 3556 | ACY77753 | 3556 | 34060 | 64564, 95068, 125572, 156076, 186580 | 10572 | AGW02013 | 10572 | 41076 | 71580, 102084, 132588, 163092, 193596 |
| 3557 | ACY77783 | 3557 | 34061 | 64565, 95069, 125573, 156077, 186581 | 10573 | AGW02025 | 10573 | 41077 | 71581, 102085, 132589, 163093, 193597 |

FIG. 1 continued

| | | | | | | | | | |
|---|---|---|---|---|---|---|---|---|---|
| 3558 | ACY77813 | 3558 | 34062 | 64566, 95070, 125574, 156078, 186582 | 10574 | AGW02037 | 10574 | 41078 | 71582, 102086, 132590, 163094, 193598 |
| 3559 | ACY77823 | 3559 | 34063 | 64567, 95071, 125575, 156079, 186583 | 10575 | AGW02061 | 10575 | 41079 | 71583, 102087, 132591, 163095, 193599 |
| 3560 | ACY77833 | 3560 | 34064 | 64568, 95072, 125576, 156080, 186584 | 10576 | AGW02073 | 10576 | 41080 | 71584, 102088, 132592, 163096, 193600 |
| 3561 | ACY77843 | 3561 | 34065 | 64569, 95073, 125577, 156081, 186585 | 10577 | AGW02085 | 10577 | 41081 | 71585, 102089, 132593, 163097, 193601 |
| 3562 | ACY77863 | 3562 | 34066 | 64570, 95074, 125578, 156082, 186586 | 10578 | AGW02097 | 10578 | 41082 | 71586, 102090, 132594, 163098, 193602 |
| 3563 | ACY77874 | 3563 | 34067 | 64571, 95075, 125579, 156083, 186587 | 10579 | AGW02109 | 10579 | 41083 | 71587, 102091, 132595, 163099, 193603 |
| 3564 | ACY77884 | 3564 | 34068 | 64572, 95076, 125580, 156084, 186588 | 10580 | AGW02133 | 10580 | 41084 | 71588, 102092, 132596, 163100, 193604 |
| 3565 | ACY77904 | 3565 | 34069 | 64573, 95077, 125581, 156085, 186589 | 10581 | AGW02157 | 10581 | 41085 | 71589, 102093, 132597, 163101, 193605 |
| 3566 | ACY77914 | 3566 | 34070 | 64574, 95078, 125582, 156086, 186590 | 10582 | AGW02169 | 10582 | 41086 | 71590, 102094, 132598, 163102, 193606 |
| 3567 | ACY77924 | 3567 | 34071 | 64575, 95079, 125583, 156087, 186591 | 10583 | AGW02181 | 10583 | 41087 | 71591, 102095, 132599, 163103, 193607 |
| 3568 | ACY77934 | 3568 | 34072 | 64576, 95080, 125584, 156088, 186592 | 10584 | AGW02193 | 10584 | 41088 | 71592, 102096, 132600, 163104, 193608 |
| 3569 | ACY77944 | 3569 | 34073 | 64577, 95081, 125585, 156089, 186593 | 10585 | AGW04171 | 10585 | 41089 | 71593, 102097, 132601, 163105, 193609 |
| 3570 | ACY77954 | 3570 | 34074 | 64578, 95082, 125586, 156090, 186594 | 10586 | AGW27061 | 10586 | 41090 | 71594, 102098, 132602, 163106, 193610 |
| 3571 | ACY77964 | 3571 | 34075 | 64579, 95083, 125587, 156091, 186595 | 10587 | AGY14471 | 10587 | 41091 | 71595, 102099, 132603, 163107, 193611 |
| 3572 | ACY77974 | 3572 | 34076 | 64580, 95084, 125588, 156092, 186596 | 10588 | AGY14477 | 10588 | 41092 | 71596, 102100, 132604, 163108, 193612 |
| 3573 | ACY77984 | 3573 | 34077 | 64581, 95085, 125589, 156093, 186597 | 10589 | AHC57459 | 10589 | 41093 | 71597, 102101, 132605, 163109, 193613 |
| 3574 | ACY77994 | 3574 | 34078 | 64582, 95086, 125590, 156094, 186598 | 10590 | AHC57465 | 10590 | 41094 | 71598, 102102, 132606, 163110, 193614 |
| 3575 | ACY79633 | 3575 | 34079 | 64583, 95087, 125591, 156095, 186599 | 10591 | AHC57487 | 10591 | 41095 | 71599, 102103, 132607, 163111, 193615 |

FIG. 1 continued

| | | | | | | | | | |
|---|---|---|---|---|---|---|---|---|---|
| 3576 | ACZ01953 | 3576 | 34080 | 64584, 95088, 125592, 156096, 186600 | 10592 | AHC57499 | 10592 | 41096 | 71600, 102104, 132608, 163112, 193616 |
| 3577 | ACZ05050 | 3577 | 34081 | 64585, 95089, 125593, 156097, 186601 | 10593 | AHC57511 | 10593 | 41097 | 71601, 102105, 132609, 163113, 193617 |
| 3578 | ACZ05061 | 3578 | 34082 | 64586, 95090, 125594, 156098, 186602 | 10594 | AHC57523 | 10594 | 41098 | 71602, 102106, 132610, 163114, 193618 |
| 3579 | ACZ05071 | 3579 | 34083 | 64587, 95091, 125595, 156099, 186603 | 10595 | AHC57675 | 10595 | 41099 | 71603, 102107, 132611, 163115, 193619 |
| 3580 | ACZ05081 | 3580 | 34084 | 64588, 95092, 125596, 156100, 186604 | 10596 | AHC57827 | 10596 | 41100 | 71604, 102108, 132612, 163116, 193620 |
| 3581 | ACZ05091 | 3581 | 34085 | 64589, 95093, 125597, 156101, 186605 | 10597 | AHC57956 | 10597 | 41101 | 71605, 102109, 132613, 163117, 193621 |
| 3582 | ACZ05101 | 3582 | 34086 | 64590, 95094, 125598, 156102, 186606 | 10598 | AHC57981 | 10598 | 41102 | 71606, 102110, 132614, 163118, 193622 |
| 3583 | ACZ05111 | 3583 | 34087 | 64591, 95095, 125599, 156103, 186607 | 10599 | AHC57993 | 10599 | 41103 | 71607, 102111, 132615, 163119, 193623 |
| 3584 | ACZ05121 | 3584 | 34088 | 64592, 95096, 125600, 156104, 186608 | 10600 | AHC58005 | 10600 | 41104 | 71608, 102112, 132616, 163120, 193624 |
| 3585 | ACZ05131 | 3585 | 34089 | 64593, 95097, 125601, 156105, 186609 | 10601 | AHC58017 | 10601 | 41105 | 71609, 102113, 132617, 163121, 193625 |
| 3586 | ACZ05141 | 3586 | 34090 | 64594, 95098, 125602, 156106, 186610 | 10602 | AHC58029 | 10602 | 41106 | 71610, 102114, 132618, 163122, 193626 |
| 3587 | ACZ05151 | 3587 | 34091 | 64595, 95099, 125603, 156107, 186611 | 10603 | AHC58050 | 10603 | 41107 | 71611, 102115, 132619, 163123, 193627 |
| 3588 | ACZ05172 | 3588 | 34092 | 64596, 95100, 125604, 156108, 186612 | 10604 | AHC58074 | 10604 | 41108 | 71612, 102116, 132620, 163124, 193628 |
| 3589 | ACZ05194 | 3589 | 34093 | 64597, 95101, 125605, 156109, 186613 | 10605 | AHC58098 | 10605 | 41109 | 71613, 102117, 132621, 163125, 193629 |
| 3590 | ACZ05205 | 3590 | 34094 | 64598, 95102, 125606, 156110, 186614 | 10606 | AHC58110 | 10606 | 41110 | 71614, 102118, 132622, 163126, 193630 |
| 3591 | ACZ05216 | 3591 | 34095 | 64599, 95103, 125607, 156111, 186615 | 10607 | AHC58126 | 10607 | 41111 | 71615, 102119, 132623, 163127, 193631 |
| 3592 | ACZ05227 | 3592 | 34096 | 64600, 95104, 125608, 156112, 186616 | 10608 | AHC58138 | 10608 | 41112 | 71616, 102120, 132624, 163128, 193632 |
| 3593 | ACZ05238 | 3593 | 34097 | 64601, 95105, 125609, 156113, 186617 | 10609 | AHC58162 | 10609 | 41113 | 71617, 102121, 132625, 163129, 193633 |

FIG. 1 continued

| | | | | | | | | | |
|---|---|---|---|---|---|---|---|---|---|
| 3594 | ACZ05249 | 3594 | 34098 | 64602, 95106, 125610, 156114, 186618 | 10610 | AHC58186 | 10610 | 41114 | 71618, 102122, 132626, 163130, 193634 |
| 3595 | ACZ05260 | 3595 | 34099 | 64603, 95107, 125611, 156115, 186619 | 10611 | AHC58198 | 10611 | 41115 | 71619, 102123, 132627, 163131, 193635 |
| 3596 | ACZ05271 | 3596 | 34100 | 64604, 95108, 125612, 156116, 186620 | 10612 | AHC58210 | 10612 | 41116 | 71620, 102124, 132628, 163132, 193636 |
| 3597 | ACZ05282 | 3597 | 34101 | 64605, 95109, 125613, 156117, 186621 | 10613 | AHC58234 | 10613 | 41117 | 71621, 102125, 132629, 163133, 193637 |
| 3598 | ACZ05304 | 3598 | 34102 | 64606, 95110, 125614, 156118, 186622 | 10614 | AHC58246 | 10614 | 41118 | 71622, 102126, 132630, 163134, 193638 |
| 3599 | ACZ05315 | 3599 | 34103 | 64607, 95111, 125615, 156119, 186623 | 10615 | AHC58258 | 10615 | 41119 | 71623, 102127, 132631, 163135, 193639 |
| 3600 | ACZ05326 | 3600 | 34104 | 64608, 95112, 125616, 156120, 186624 | 10616 | AHC58270 | 10616 | 41120 | 71624, 102128, 132632, 163136, 193640 |
| 3601 | ACZ05337 | 3601 | 34105 | 64609, 95113, 125617, 156121, 186625 | 10617 | AHC58372 | 10617 | 41121 | 71625, 102129, 132633, 163137, 193641 |
| 3602 | ACZ05348 | 3602 | 34106 | 64610, 95114, 125618, 156122, 186626 | 10618 | AHC58396 | 10618 | 41122 | 71626, 102130, 132634, 163138, 193642 |
| 3603 | ACZ05359 | 3603 | 34107 | 64611, 95115, 125619, 156123, 186627 | 10619 | AHC58408 | 10619 | 41123 | 71627, 102131, 132635, 163139, 193643 |
| 3604 | ACZ05370 | 3604 | 34108 | 64612, 95116, 125620, 156124, 186628 | 10620 | AHC58420 | 10620 | 41124 | 71628, 102132, 132636, 163140, 193644 |
| 3605 | ACZ05392 | 3605 | 34109 | 64613, 95117, 125621, 156125, 186629 | 10621 | AHC58432 | 10621 | 41125 | 71629, 102133, 132637, 163141, 193645 |
| 3606 | ACZ05403 | 3606 | 34110 | 64614, 95118, 125622, 156126, 186630 | 10622 | AHC58444 | 10622 | 41126 | 71630, 102134, 132638, 163142, 193646 |
| 3607 | ACZ05436 | 3607 | 34111 | 64615, 95119, 125623, 156127, 186631 | 10623 | AHC58456 | 10623 | 41127 | 71631, 102135, 132639, 163143, 193647 |
| 3608 | ACZ05458 | 3608 | 34112 | 64616, 95120, 125624, 156128, 186632 | 10624 | AHC58468 | 10624 | 41128 | 71632, 102136, 132640, 163144, 193648 |
| 3609 | ACZ05469 | 3609 | 34113 | 64617, 95121, 125625, 156129, 186633 | 10625 | AHC58479 | 10625 | 41129 | 71633, 102137, 132641, 163145, 193649 |
| 3610 | ACZ05480 | 3610 | 34114 | 64618, 95122, 125626, 156130, 186634 | 10626 | AHC58491 | 10626 | 41130 | 71634, 102138, 132642, 163146, 193650 |
| 3611 | ACZ05513 | 3611 | 34115 | 64619, 95123, 125627, 156131, 186635 | 10627 | AHC58515 | 10627 | 41131 | 71635, 102139, 132643, 163147, 193651 |

FIG. 1 continued

| | | | | | | | | | |
|---|---|---|---|---|---|---|---|---|---|
| 3612 | ACZ05524 | 3612 | 34116 | 64620, 95124, 125628, 156132, 186636 | 10628 | AHC58527 | 10628 | 41132 | 71636, 102140, 132644, 163148, 193652 |
| 3613 | ACZ05535 | 3613 | 34117 | 64621, 95125, 125629, 156133, 186637 | 10629 | AHC58563 | 10629 | 41133 | 71637, 102141, 132645, 163149, 193653 |
| 3614 | ACZ05546 | 3614 | 34118 | 64622, 95126, 125630, 156134, 186638 | 10630 | AHC58575 | 10630 | 41134 | 71638, 102142, 132646, 163150, 193654 |
| 3615 | ACZ05557 | 3615 | 34119 | 64623, 95127, 125631, 156135, 186639 | 10631 | AHC58587 | 10631 | 41135 | 71639, 102143, 132647, 163151, 193655 |
| 3616 | ACZ05579 | 3616 | 34120 | 64624, 95128, 125632, 156136, 186640 | 10632 | AHC58599 | 10632 | 41136 | 71640, 102144, 132648, 163152, 193656 |
| 3617 | ACZ05590 | 3617 | 34121 | 64625, 95129, 125633, 156137, 186641 | 10633 | AHC58611 | 10633 | 41137 | 71641, 102145, 132649, 163153, 193657 |
| 3618 | ACZ05950 | 3618 | 34122 | 64626, 95130, 125634, 156138, 186642 | 10634 | AHC58623 | 10634 | 41138 | 71642, 102146, 132650, 163154, 193658 |
| 3619 | ACZ05961 | 3619 | 34123 | 64627, 95131, 125635, 156139, 186643 | 10635 | AHC58647 | 10635 | 41139 | 71643, 102147, 132651, 163155, 193659 |
| 3620 | ACZ05972 | 3620 | 34124 | 64628, 95132, 125636, 156140, 186644 | 10636 | AHC58659 | 10636 | 41140 | 71644, 102148, 132652, 163156, 193660 |
| 3621 | ACZ05983 | 3621 | 34125 | 64629, 95133, 125637, 156141, 186645 | 10637 | AHC58671 | 10637 | 41141 | 71645, 102149, 132653, 163157, 193661 |
| 3622 | ACZ05994 | 3622 | 34126 | 64630, 95134, 125638, 156142, 186646 | 10638 | AHC58683 | 10638 | 41142 | 71646, 102150, 132654, 163158, 193662 |
| 3623 | ACZ06005 | 3623 | 34127 | 64631, 95135, 125639, 156143, 186647 | 10639 | AHC58695 | 10639 | 41143 | 71647, 102151, 132655, 163159, 193663 |
| 3624 | ACZ06016 | 3624 | 34128 | 64632, 95136, 125640, 156144, 186648 | 10640 | AHC58707 | 10640 | 41144 | 71648, 102152, 132656, 163160, 193664 |
| 3625 | ACZ16013 | 3625 | 34129 | 64633, 95137, 125641, 156145, 186649 | 10641 | AHC58719 | 10641 | 41145 | 71649, 102153, 132657, 163161, 193665 |
| 3626 | ACZ16023 | 3626 | 34130 | 64634, 95138, 125642, 156146, 186650 | 10642 | AHC58731 | 10642 | 41146 | 71650, 102154, 132658, 163162, 193666 |
| 3627 | ACZ16033 | 3627 | 34131 | 64635, 95139, 125643, 156147, 186651 | 10643 | AHC58743 | 10643 | 41147 | 71651, 102155, 132659, 163163, 193667 |
| 3628 | ACZ16040 | 3628 | 34132 | 64636, 95140, 125644, 156148, 186652 | 10644 | AHC58755 | 10644 | 41148 | 71652, 102156, 132660, 163164, 193668 |
| 3629 | ACZ16050 | 3629 | 34133 | 64637, 95141, 125645, 156149, 186653 | 10645 | AHC58779 | 10645 | 41149 | 71653, 102157, 132661, 163165, 193669 |

FIG. 1 continued

| | | | | | | | | | |
|---|---|---|---|---|---|---|---|---|---|
| 3630 | ACZ16060 | 3630 | 34134 | 64638, 95142, 125646, 156150, 186654 | 10646 | AHC58791 | 10646 | 41150 | 71654, 102158, 132662, 163166, 193670 |
| 3631 | ACZ16070 | 3631 | 34135 | 64639, 95143, 125647, 156151, 186655 | 10647 | AHC58803 | 10647 | 41151 | 71655, 102159, 132663, 163167, 193671 |
| 3632 | ACZ16080 | 3632 | 34136 | 64640, 95144, 125648, 156152, 186656 | 10648 | AHC58815 | 10648 | 41152 | 71656, 102160, 132664, 163168, 193672 |
| 3633 | ACZ16090 | 3633 | 34137 | 64641, 95145, 125649, 156153, 186657 | 10649 | AHC58827 | 10649 | 41153 | 71657, 102161, 132665, 163169, 193673 |
| 3634 | ACZ16100 | 3634 | 34138 | 64642, 95146, 125650, 156154, 186658 | 10650 | AHC58839 | 10650 | 41154 | 71658, 102162, 132666, 163170, 193674 |
| 3635 | ACZ16110 | 3635 | 34139 | 64643, 95147, 125651, 156155, 186659 | 10651 | AHC58863 | 10651 | 41155 | 71659, 102163, 132667, 163171, 193675 |
| 3636 | ACZ16120 | 3636 | 34140 | 64644, 95148, 125652, 156156, 186660 | 10652 | AHC58875 | 10652 | 41156 | 71660, 102164, 132668, 163172, 193676 |
| 3637 | ACZ16130 | 3637 | 34141 | 64645, 95149, 125653, 156157, 186661 | 10653 | AHC58887 | 10653 | 41157 | 71661, 102165, 132669, 163173, 193677 |
| 3638 | ACZ16140 | 3638 | 34142 | 64646, 95150, 125654, 156158, 186662 | 10654 | AHC58899 | 10654 | 41158 | 71662, 102166, 132670, 163174, 193678 |
| 3639 | ACZ16150 | 3639 | 34143 | 64647, 95151, 125655, 156159, 186663 | 10655 | AHC58981 | 10655 | 41159 | 71663, 102167, 132671, 163175, 193679 |
| 3640 | ACZ16160 | 3640 | 34144 | 64648, 95152, 125656, 156160, 186664 | 10656 | AHC58993 | 10656 | 41160 | 71664, 102168, 132672, 163176, 193680 |
| 3641 | ACZ16170 | 3641 | 34145 | 64649, 95153, 125657, 156161, 186665 | 10657 | AHC59005 | 10657 | 41161 | 71665, 102169, 132673, 163177, 193681 |
| 3642 | ACZ16180 | 3642 | 34146 | 64650, 95154, 125658, 156162, 186666 | 10658 | AHC59017 | 10658 | 41162 | 71666, 102170, 132674, 163178, 193682 |
| 3643 | ACZ16190 | 3643 | 34147 | 64651, 95155, 125659, 156163, 186667 | 10659 | AHC59029 | 10659 | 41163 | 71667, 102171, 132675, 163179, 193683 |
| 3644 | ACZ16200 | 3644 | 34148 | 64652, 95156, 125660, 156164, 186668 | 10660 | AHC59041 | 10660 | 41164 | 71668, 102172, 132676, 163180, 193684 |
| 3645 | ACZ16210 | 3645 | 34149 | 64653, 95157, 125661, 156165, 186669 | 10661 | AHC59053 | 10661 | 41165 | 71669, 102173, 132677, 163181, 193685 |
| 3646 | ACZ16220 | 3646 | 34150 | 64654, 95158, 125662, 156166, 186670 | 10662 | AHC59077 | 10662 | 41166 | 71670, 102174, 132678, 163182, 193686 |
| 3647 | ACZ16230 | 3647 | 34151 | 64655, 95159, 125663, 156167, 186671 | 10663 | AHC59089 | 10663 | 41167 | 71671, 102175, 132679, 163183, 193687 |

FIG. 1 continued

| | | | | | | | | | |
|---|---|---|---|---|---|---|---|---|---|
| 3648 | ACZ16240 | 3648 | 34152 | 64656, 95160, 125664, 156168, 186672 | 10664 | AHC59101 | 10664 | 41168 | 71672, 102176, 132680, 163184, 193688 |
| 3649 | ACZ16260 | 3649 | 34153 | 64657, 95161, 125665, 156169, 186673 | 10665 | AHC59113 | 10665 | 41169 | 71673, 102177, 132681, 163185, 193689 |
| 3650 | ACZ16270 | 3650 | 34154 | 64658, 95162, 125666, 156170, 186674 | 10666 | AHC59125 | 10666 | 41170 | 71674, 102178, 132682, 163186, 193690 |
| 3651 | ACZ16280 | 3651 | 34155 | 64659, 95163, 125667, 156171, 186675 | 10667 | AHC59137 | 10667 | 41171 | 71675, 102179, 132683, 163187, 193691 |
| 3652 | ACZ16290 | 3652 | 34156 | 64660, 95164, 125668, 156172, 186676 | 10668 | AHC59149 | 10668 | 41172 | 71676, 102180, 132684, 163188, 193692 |
| 3653 | ACZ16300 | 3653 | 34157 | 64661, 95165, 125669, 156173, 186677 | 10669 | AHC59185 | 10669 | 41173 | 71677, 102181, 132685, 163189, 193693 |
| 3654 | ACZ16310 | 3654 | 34158 | 64662, 95166, 125670, 156174, 186678 | 10670 | AHC59197 | 10670 | 41174 | 71678, 102182, 132686, 163190, 193694 |
| 3655 | ACZ16320 | 3655 | 34159 | 64663, 95167, 125671, 156175, 186679 | 10671 | AHC59209 | 10671 | 41175 | 71679, 102183, 132687, 163191, 193695 |
| 3656 | ACZ16330 | 3656 | 34160 | 64664, 95168, 125672, 156176, 186680 | 10672 | AHC59221 | 10672 | 41176 | 71680, 102184, 132688, 163192, 193696 |
| 3657 | ACZ16340 | 3657 | 34161 | 64665, 95169, 125673, 156177, 186681 | 10673 | AHC59245 | 10673 | 41177 | 71681, 102185, 132689, 163193, 193697 |
| 3658 | ACZ16350 | 3658 | 34162 | 64666, 95170, 125674, 156178, 186682 | 10674 | AHC59257 | 10674 | 41178 | 71682, 102186, 132690, 163194, 193698 |
| 3659 | ACZ16360 | 3659 | 34163 | 64667, 95171, 125675, 156179, 186683 | 10675 | AHC59269 | 10675 | 41179 | 71683, 102187, 132691, 163195, 193699 |
| 3660 | ACZ16370 | 3660 | 34164 | 64668, 95172, 125676, 156180, 186684 | 10676 | AHC59281 | 10676 | 41180 | 71684, 102188, 132692, 163196, 193700 |
| 3661 | ACZ16380 | 3661 | 34165 | 64669, 95173, 125677, 156181, 186685 | 10677 | AHC59293 | 10677 | 41181 | 71685, 102189, 132693, 163197, 193701 |
| 3662 | ACZ16390 | 3662 | 34166 | 64670, 95174, 125678, 156182, 186686 | 10678 | AHC59305 | 10678 | 41182 | 71686, 102190, 132694, 163198, 193702 |
| 3663 | ACZ16400 | 3663 | 34167 | 64671, 95175, 125679, 156183, 186687 | 10679 | AHC59329 | 10679 | 41183 | 71687, 102191, 132695, 163199, 193703 |
| 3664 | ACZ16410 | 3664 | 34168 | 64672, 95176, 125680, 156184, 186688 | 10680 | AHC59341 | 10680 | 41184 | 71688, 102192, 132696, 163200, 193704 |
| 3665 | ACZ16420 | 3665 | 34169 | 64673, 95177, 125681, 156185, 186689 | 10681 | AHC59365 | 10681 | 41185 | 71689, 102193, 132697, 163201, 193705 |

FIG. 1 continued

| | | | | | | | | | |
|---|---|---|---|---|---|---|---|---|---|
| 3666 | ACZ16430 | 3666 | 34170 | 64674, 95178, 125682, 156186, 186690 | 10682 | AHC59377 | 10682 | 41186 | 71690, 102194, 132698, 163202, 193706 |
| 3667 | ACZ16440 | 3667 | 34171 | 64675, 95179, 125683, 156187, 186691 | 10683 | AHC59413 | 10683 | 41187 | 71691, 102195, 132699, 163203, 193707 |
| 3668 | ACZ16450 | 3668 | 34172 | 64676, 95180, 125684, 156188, 186692 | 10684 | AHC59425 | 10684 | 41188 | 71692, 102196, 132700, 163204, 193708 |
| 3669 | ACZ16460 | 3669 | 34173 | 64677, 95181, 125685, 156189, 186693 | 10685 | AHC59437 | 10685 | 41189 | 71693, 102197, 132701, 163205, 193709 |
| 3670 | ACZ16470 | 3670 | 34174 | 64678, 95182, 125686, 156190, 186694 | 10686 | AHC59449 | 10686 | 41190 | 71694, 102198, 132702, 163206, 193710 |
| 3671 | ACZ16480 | 3671 | 34175 | 64679, 95183, 125687, 156191, 186695 | 10687 | AHC59461 | 10687 | 41191 | 71695, 102199, 132703, 163207, 193711 |
| 3672 | ACZ16490 | 3672 | 34176 | 64680, 95184, 125688, 156192, 186696 | 10688 | AHC59473 | 10688 | 41192 | 71696, 102200, 132704, 163208, 193712 |
| 3673 | ACZ16500 | 3673 | 34177 | 64681, 95185, 125689, 156193, 186697 | 10689 | AHC59485 | 10689 | 41193 | 71697, 102201, 132705, 163209, 193713 |
| 3674 | ACZ16510 | 3674 | 34178 | 64682, 95186, 125690, 156194, 186698 | 10690 | AHC59497 | 10690 | 41194 | 71698, 102202, 132706, 163210, 193714 |
| 3675 | ACZ16530 | 3675 | 34179 | 64683, 95187, 125691, 156195, 186699 | 10691 | AHC59509 | 10691 | 41195 | 71699, 102203, 132707, 163211, 193715 |
| 3676 | ACZ16540 | 3676 | 34180 | 64684, 95188, 125692, 156196, 186700 | 10692 | AHC59521 | 10692 | 41196 | 71700, 102204, 132708, 163212, 193716 |
| 3677 | ACZ16550 | 3677 | 34181 | 64685, 95189, 125693, 156197, 186701 | 10693 | AHC59533 | 10693 | 41197 | 71701, 102205, 132709, 163213, 193717 |
| 3678 | ACZ16583 | 3678 | 34182 | 64686, 95190, 125694, 156198, 186702 | 10694 | AHC59545 | 10694 | 41198 | 71702, 102206, 132710, 163214, 193718 |
| 3679 | ACZ16593 | 3679 | 34183 | 64687, 95191, 125695, 156199, 186703 | 10695 | AHC59557 | 10695 | 41199 | 71703, 102207, 132711, 163215, 193719 |
| 3680 | ACZ16603 | 3680 | 34184 | 64688, 95192, 125696, 156200, 186704 | 10696 | AHC59569 | 10696 | 41200 | 71704, 102208, 132712, 163216, 193720 |
| 3681 | ACZ16630 | 3681 | 34185 | 64689, 95193, 125697, 156201, 186705 | 10697 | AHC59581 | 10697 | 41201 | 71705, 102209, 132713, 163217, 193721 |
| 3682 | ACZ16640 | 3682 | 34186 | 64690, 95194, 125698, 156202, 186706 | 10698 | AHC59593 | 10698 | 41202 | 71706, 102210, 132714, 163218, 193722 |
| 3683 | ACZ16650 | 3683 | 34187 | 64691, 95195, 125699, 156203, 186707 | 10699 | AHC59605 | 10699 | 41203 | 71707, 102211, 132715, 163219, 193723 |

FIG. 1 continued

| | | | | | | | | | |
|---|---|---|---|---|---|---|---|---|---|
| 3684 | ACZ16660 | 3684 | 34188 | 64692, 95196, 125700, 156204, 186708 | 10700 | AHC59617 | 10700 | 41204 | 71708, 102212, 132716, 163220, 193724 |
| 3685 | ACZ16670 | 3685 | 34189 | 64693, 95197, 125701, 156205, 186709 | 10701 | AHC59629 | 10701 | 41205 | 71709, 102213, 132717, 163221, 193725 |
| 3686 | ACZ16680 | 3686 | 34190 | 64694, 95198, 125702, 156206, 186710 | 10702 | AHC59641 | 10702 | 41206 | 71710, 102214, 132718, 163222, 193726 |
| 3687 | ACZ16690 | 3687 | 34191 | 64695, 95199, 125703, 156207, 186711 | 10703 | AHC59653 | 10703 | 41207 | 71711, 102215, 132719, 163223, 193727 |
| 3688 | ACZ16700 | 3688 | 34192 | 64696, 95200, 125704, 156208, 186712 | 10704 | AHC59665 | 10704 | 41208 | 71712, 102216, 132720, 163224, 193728 |
| 3689 | ACZ16710 | 3689 | 34193 | 64697, 95201, 125705, 156209, 186713 | 10705 | AHC59677 | 10705 | 41209 | 71713, 102217, 132721, 163225, 193729 |
| 3690 | ACZ16720 | 3690 | 34194 | 64698, 95202, 125706, 156210, 186714 | 10706 | AHC59689 | 10706 | 41210 | 71714, 102218, 132722, 163226, 193730 |
| 3691 | ACZ16730 | 3691 | 34195 | 64699, 95203, 125707, 156211, 186715 | 10707 | AHC59701 | 10707 | 41211 | 71715, 102219, 132723, 163227, 193731 |
| 3692 | ACZ16740 | 3692 | 34196 | 64700, 95204, 125708, 156212, 186716 | 10708 | AHC59713 | 10708 | 41212 | 71716, 102220, 132724, 163228, 193732 |
| 3693 | ACZ16750 | 3693 | 34197 | 64701, 95205, 125709, 156213, 186717 | 10709 | AHC59737 | 10709 | 41213 | 71717, 102221, 132725, 163229, 193733 |
| 3694 | ACZ16760 | 3694 | 34198 | 64702, 95206, 125710, 156214, 186718 | 10710 | AHC59749 | 10710 | 41214 | 71718, 102222, 132726, 163230, 193734 |
| 3695 | ACZ16770 | 3695 | 34199 | 64703, 95207, 125711, 156215, 186719 | 10711 | AHC59761 | 10711 | 41215 | 71719, 102223, 132727, 163231, 193735 |
| 3696 | ACZ16780 | 3696 | 34200 | 64704, 95208, 125712, 156216, 186720 | 10712 | AHC59773 | 10712 | 41216 | 71720, 102224, 132728, 163232, 193736 |
| 3697 | ACZ16790 | 3697 | 34201 | 64705, 95209, 125713, 156217, 186721 | 10713 | AHC59785 | 10713 | 41217 | 71721, 102225, 132729, 163233, 193737 |
| 3698 | ACZ16800 | 3698 | 34202 | 64706, 95210, 125714, 156218, 186722 | 10714 | AHC59797 | 10714 | 41218 | 71722, 102226, 132730, 163234, 193738 |
| 3699 | ACZ16810 | 3699 | 34203 | 64707, 95211, 125715, 156219, 186723 | 10715 | AHC59809 | 10715 | 41219 | 71723, 102227, 132731, 163235, 193739 |
| 3700 | ACZ16820 | 3700 | 34204 | 64708, 95212, 125716, 156220, 186724 | 10716 | AHC59821 | 10716 | 41220 | 71724, 102228, 132732, 163236, 193740 |
| 3701 | ACZ16830 | 3701 | 34205 | 64709, 95213, 125717, 156221, 186725 | 10717 | AHC59833 | 10717 | 41221 | 71725, 102229, 132733, 163237, 193741 |

FIG. 1 continued

| | | | | | | | | | |
|---|---|---|---|---|---|---|---|---|---|
| 3702 | ACZ16840 | 3702 | 34206 | 64710, 95214, 125718, 156222, 186726 | 10718 | AHC59845 | 10718 | 41222 | 71726, 102230, 132734, 163238, 193742 |
| 3703 | ACZ16850 | 3703 | 34207 | 64711, 95215, 125719, 156223, 186727 | 10719 | AHC59857 | 10719 | 41223 | 71727, 102231, 132735, 163239, 193743 |
| 3704 | ACZ16860 | 3704 | 34208 | 64712, 95216, 125720, 156224, 186728 | 10720 | AHC59869 | 10720 | 41224 | 71728, 102232, 132736, 163240, 193744 |
| 3705 | ACZ16870 | 3705 | 34209 | 64713, 95217, 125721, 156225, 186729 | 10721 | AHC59881 | 10721 | 41225 | 71729, 102233, 132737, 163241, 193745 |
| 3706 | ACZ16880 | 3706 | 34210 | 64714, 95218, 125722, 156226, 186730 | 10722 | AHC59892 | 10722 | 41226 | 71730, 102234, 132738, 163242, 193746 |
| 3707 | ACZ16890 | 3707 | 34211 | 64715, 95219, 125723, 156227, 186731 | 10723 | AHC59904 | 10723 | 41227 | 71731, 102235, 132739, 163243, 193747 |
| 3708 | ACZ16900 | 3708 | 34212 | 64716, 95220, 125724, 156228, 186732 | 10724 | AHC59915 | 10724 | 41228 | 71732, 102236, 132740, 163244, 193748 |
| 3709 | ACZ16910 | 3709 | 34213 | 64717, 95221, 125725, 156229, 186733 | 10725 | AHC59939 | 10725 | 41229 | 71733, 102237, 132741, 163245, 193749 |
| 3710 | ACZ16920 | 3710 | 34214 | 64718, 95222, 125726, 156230, 186734 | 10726 | AHC59963 | 10726 | 41230 | 71734, 102238, 132742, 163246, 193750 |
| 3711 | ACZ16930 | 3711 | 34215 | 64719, 95223, 125727, 156231, 186735 | 10727 | AHC59987 | 10727 | 41231 | 71735, 102239, 132743, 163247, 193751 |
| 3712 | ACZ16940 | 3712 | 34216 | 64720, 95224, 125728, 156232, 186736 | 10728 | AHC59999 | 10728 | 41232 | 71736, 102240, 132744, 163248, 193752 |
| 3713 | ACZ16950 | 3713 | 34217 | 64721, 95225, 125729, 156233, 186737 | 10729 | AHC60011 | 10729 | 41233 | 71737, 102241, 132745, 163249, 193753 |
| 3714 | ACZ16960 | 3714 | 34218 | 64722, 95226, 125730, 156234, 186738 | 10730 | AHC60023 | 10730 | 41234 | 71738, 102242, 132746, 163250, 193754 |
| 3715 | ACZ16970 | 3715 | 34219 | 64723, 95227, 125731, 156235, 186739 | 10731 | AHC60035 | 10731 | 41235 | 71739, 102243, 132747, 163251, 193755 |
| 3716 | ACZ16980 | 3716 | 34220 | 64724, 95228, 125732, 156236, 186740 | 10732 | AHC60047 | 10732 | 41236 | 71740, 102244, 132748, 163252, 193756 |
| 3717 | ACZ17000 | 3717 | 34221 | 64725, 95229, 125733, 156237, 186741 | 10733 | AHC60059 | 10733 | 41237 | 71741, 102245, 132749, 163253, 193757 |
| 3718 | ACZ17010 | 3718 | 34222 | 64726, 95230, 125734, 156238, 186742 | 10734 | AHC60071 | 10734 | 41238 | 71742, 102246, 132750, 163254, 193758 |
| 3719 | ACZ17020 | 3719 | 34223 | 64727, 95231, 125735, 156239, 186743 | 10735 | AHC60083 | 10735 | 41239 | 71743, 102247, 132751, 163255, 193759 |

FIG. 1 continued

| | | | | | | | | | |
|---|---|---|---|---|---|---|---|---|---|
| 3720 | ACZ17030 | 3720 | 34224 | 64728, 95232, 125736, 156240, 186744 | 10736 | AHC60095 | 10736 | 41240 | 71744, 102248, 132752, 163256, 193760 |
| 3721 | ACZ17040 | 3721 | 34225 | 64729, 95233, 125737, 156241, 186745 | 10737 | AHC60107 | 10737 | 41241 | 71745, 102249, 132753, 163257, 193761 |
| 3722 | ACZ17050 | 3722 | 34226 | 64730, 95234, 125738, 156242, 186746 | 10738 | AHC60119 | 10738 | 41242 | 71746, 102250, 132754, 163258, 193762 |
| 3723 | ACZ17060 | 3723 | 34227 | 64731, 95235, 125739, 156243, 186747 | 10739 | AHC60131 | 10739 | 41243 | 71747, 102251, 132755, 163259, 193763 |
| 3724 | ACZ17070 | 3724 | 34228 | 64732, 95236, 125740, 156244, 186748 | 10740 | AHC60143 | 10740 | 41244 | 71748, 102252, 132756, 163260, 193764 |
| 3725 | ACZ17080 | 3725 | 34229 | 64733, 95237, 125741, 156245, 186749 | 10741 | AHC60155 | 10741 | 41245 | 71749, 102253, 132757, 163261, 193765 |
| 3726 | ACZ17090 | 3726 | 34230 | 64734, 95238, 125742, 156246, 186750 | 10742 | AHC60167 | 10742 | 41246 | 71750, 102254, 132758, 163262, 193766 |
| 3727 | ACZ17100 | 3727 | 34231 | 64735, 95239, 125743, 156247, 186751 | 10743 | AHC60179 | 10743 | 41247 | 71751, 102255, 132759, 163263, 193767 |
| 3728 | ACZ17110 | 3728 | 34232 | 64736, 95240, 125744, 156248, 186752 | 10744 | AHC60191 | 10744 | 41248 | 71752, 102256, 132760, 163264, 193768 |
| 3729 | ACZ17120 | 3729 | 34233 | 64737, 95241, 125745, 156249, 186753 | 10745 | AHC60203 | 10745 | 41249 | 71753, 102257, 132761, 163265, 193769 |
| 3730 | ACZ17130 | 3730 | 34234 | 64738, 95242, 125746, 156250, 186754 | 10746 | AHC60215 | 10746 | 41250 | 71754, 102258, 132762, 163266, 193770 |
| 3731 | ACZ17140 | 3731 | 34235 | 64739, 95243, 125747, 156251, 186755 | 10747 | AHC60239 | 10747 | 41251 | 71755, 102259, 132763, 163267, 193771 |
| 3732 | ACZ17150 | 3732 | 34236 | 64740, 95244, 125748, 156252, 186756 | 10748 | AHC60251 | 10748 | 41252 | 71756, 102260, 132764, 163268, 193772 |
| 3733 | ACZ17160 | 3733 | 34237 | 64741, 95245, 125749, 156253, 186757 | 10749 | AHC60263 | 10749 | 41253 | 71757, 102261, 132765, 163269, 193773 |
| 3734 | ACZ17170 | 3734 | 34238 | 64742, 95246, 125750, 156254, 186758 | 10750 | AHC60275 | 10750 | 41254 | 71758, 102262, 132766, 163270, 193774 |
| 3735 | ACZ17190 | 3735 | 34239 | 64743, 95247, 125751, 156255, 186759 | 10751 | AHC60287 | 10751 | 41255 | 71759, 102263, 132767, 163271, 193775 |
| 3736 | ACZ17200 | 3736 | 34240 | 64744, 95248, 125752, 156256, 186760 | 10752 | AHC60299 | 10752 | 41256 | 71760, 102264, 132768, 163272, 193776 |
| 3737 | ACZ17220 | 3737 | 34241 | 64745, 95249, 125753, 156257, 186761 | 10753 | AHC60311 | 10753 | 41257 | 71761, 102265, 132769, 163273, 193777 |

FIG. 1 continued

| | | | | | | | | | |
|---|---|---|---|---|---|---|---|---|---|
| 3738 | ACZ17230 | 3738 | 34242 | 64746, 95250, 125754, 156258, 186762 | 10754 | AHC60323 | 10754 | 41258 | 71762, 102266, 132770, 163274, 193778 |
| 3739 | ACZ17240 | 3739 | 34243 | 64747, 95251, 125755, 156259, 186763 | 10755 | AHC60335 | 10755 | 41259 | 71763, 102267, 132771, 163275, 193779 |
| 3740 | ACZ17250 | 3740 | 34244 | 64748, 95252, 125756, 156260, 186764 | 10756 | AHC60347 | 10756 | 41260 | 71764, 102268, 132772, 163276, 193780 |
| 3741 | ACZ17260 | 3741 | 34245 | 64749, 95253, 125757, 156261, 186765 | 10757 | AHC60359 | 10757 | 41261 | 71765, 102269, 132773, 163277, 193781 |
| 3742 | ACZ17270 | 3742 | 34246 | 64750, 95254, 125758, 156262, 186766 | 10758 | AHC60371 | 10758 | 41262 | 71766, 102270, 132774, 163278, 193782 |
| 3743 | ACZ17290 | 3743 | 34247 | 64751, 95255, 125759, 156263, 186767 | 10759 | AHC60383 | 10759 | 41263 | 71767, 102271, 132775, 163279, 193783 |
| 3744 | ACZ17300 | 3744 | 34248 | 64752, 95256, 125760, 156264, 186768 | 10760 | AHC60395 | 10760 | 41264 | 71768, 102272, 132776, 163280, 193784 |
| 3745 | ACZ17310 | 3745 | 34249 | 64753, 95257, 125761, 156265, 186769 | 10761 | AHC60407 | 10761 | 41265 | 71769, 102273, 132777, 163281, 193785 |
| 3746 | ACZ17398 | 3746 | 34250 | 64754, 95258, 125762, 156266, 186770 | 10762 | AHC60419 | 10762 | 41266 | 71770, 102274, 132778, 163282, 193786 |
| 3747 | ACZ17408 | 3747 | 34251 | 64755, 95259, 125763, 156267, 186771 | 10763 | AHC60431 | 10763 | 41267 | 71771, 102275, 132779, 163283, 193787 |
| 3748 | ACZ17418 | 3748 | 34252 | 64756, 95260, 125764, 156268, 186772 | 10764 | AHC60455 | 10764 | 41268 | 71772, 102276, 132780, 163284, 193788 |
| 3749 | ACZ17438 | 3749 | 34253 | 64757, 95261, 125765, 156269, 186773 | 10765 | AHC60467 | 10765 | 41269 | 71773, 102277, 132781, 163285, 193789 |
| 3750 | ACZ17448 | 3750 | 34254 | 64758, 95262, 125766, 156270, 186774 | 10766 | AHC60479 | 10766 | 41270 | 71774, 102278, 132782, 163286, 193790 |
| 3751 | ACZ17458 | 3751 | 34255 | 64759, 95263, 125767, 156271, 186775 | 10767 | AHC60491 | 10767 | 41271 | 71775, 102279, 132783, 163287, 193791 |
| 3752 | ACZ17478 | 3752 | 34256 | 64760, 95264, 125768, 156272, 186776 | 10768 | AHC60503 | 10768 | 41272 | 71776, 102280, 132784, 163288, 193792 |
| 3753 | ACZ17488 | 3753 | 34257 | 64761, 95265, 125769, 156273, 186777 | 10769 | AHC60515 | 10769 | 41273 | 71777, 102281, 132785, 163289, 193793 |
| 3754 | ACZ18240 | 3754 | 34258 | 64762, 95266, 125770, 156274, 186778 | 10770 | AHC60527 | 10770 | 41274 | 71778, 102282, 132786, 163290, 193794 |
| 3755 | ACZ18241 | 3755 | 34259 | 64763, 95267, 125771, 156275, 186779 | 10771 | AHC60539 | 10771 | 41275 | 71779, 102283, 132787, 163291, 193795 |

FIG. 1 continued

| | | | | | | | | | |
|---|---|---|---|---|---|---|---|---|---|
| 3756 | ACZ27800 | 3756 | 34260 | 64764, 95268, 125772, 156276, 186780 | 10772 | AHC60551 | 10772 | 41276 | 71780, 102284, 132788, 163292, 193796 |
| 3757 | ACZ27810 | 3757 | 34261 | 64765, 95269, 125773, 156277, 186781 | 10773 | AHC60563 | 10773 | 41277 | 71781, 102285, 132789, 163293, 193797 |
| 3758 | ACZ27820 | 3758 | 34262 | 64766, 95270, 125774, 156278, 186782 | 10774 | AHC60575 | 10774 | 41278 | 71782, 102286, 132790, 163294, 193798 |
| 3759 | ACZ27830 | 3759 | 34263 | 64767, 95271, 125775, 156279, 186783 | 10775 | AHC60587 | 10775 | 41279 | 71783, 102287, 132791, 163295, 193799 |
| 3760 | ACZ27840 | 3760 | 34264 | 64768, 95272, 125776, 156280, 186784 | 10776 | AHC60599 | 10776 | 41280 | 71784, 102288, 132792, 163296, 193800 |
| 3761 | ACZ45006 | 3761 | 34265 | 64769, 95273, 125777, 156281, 186785 | 10777 | AHC60611 | 10777 | 41281 | 71785, 102289, 132793, 163297, 193801 |
| 3762 | ACZ45007 | 3762 | 34266 | 64770, 95274, 125778, 156282, 186786 | 10778 | AHC60623 | 10778 | 41282 | 71786, 102290, 132794, 163298, 193802 |
| 3763 | ACZ45008 | 3763 | 34267 | 64771, 95275, 125779, 156283, 186787 | 10779 | AHC60635 | 10779 | 41283 | 71787, 102291, 132795, 163299, 193803 |
| 3764 | ACZ45009 | 3764 | 34268 | 64772, 95276, 125780, 156284, 186788 | 10780 | AHC60647 | 10780 | 41284 | 71788, 102292, 132796, 163300, 193804 |
| 3765 | ACZ45010 | 3765 | 34269 | 64773, 95277, 125781, 156285, 186789 | 10781 | AHC60659 | 10781 | 41285 | 71789, 102293, 132797, 163301, 193805 |
| 3766 | ACZ45012 | 3766 | 34270 | 64774, 95278, 125782, 156286, 186790 | 10782 | AHC60671 | 10782 | 41286 | 71790, 102294, 132798, 163302, 193806 |
| 3767 | ACZ45013 | 3767 | 34271 | 64775, 95279, 125783, 156287, 186791 | 10783 | AHC60683 | 10783 | 41287 | 71791, 102295, 132799, 163303, 193807 |
| 3768 | ACZ45014 | 3768 | 34272 | 64776, 95280, 125784, 156288, 186792 | 10784 | AHC60695 | 10784 | 41288 | 71792, 102296, 132800, 163304, 193808 |
| 3769 | ACZ45016 | 3769 | 34273 | 64777, 95281, 125785, 156289, 186793 | 10785 | AHC60707 | 10785 | 41289 | 71793, 102297, 132801, 163305, 193809 |
| 3770 | ACZ45028 | 3770 | 34274 | 64778, 95282, 125786, 156290, 186794 | 10786 | AHC60719 | 10786 | 41290 | 71794, 102298, 132802, 163306, 193810 |
| 3771 | ACZ45029 | 3771 | 34275 | 64779, 95283, 125787, 156291, 186795 | 10787 | AHC60731 | 10787 | 41291 | 71795, 102299, 132803, 163307, 193811 |
| 3772 | ACZ45030 | 3772 | 34276 | 64780, 95284, 125788, 156292, 186796 | 10788 | AHC60743 | 10788 | 41292 | 71796, 102300, 132804, 163308, 193812 |
| 3773 | ACZ45031 | 3773 | 34277 | 64781, 95285, 125789, 156293, 186797 | 10789 | AHC60767 | 10789 | 41293 | 71797, 102301, 132805, 163309, 193813 |

FIG. 1 continued

| | | | | | | | | | |
|---|---|---|---|---|---|---|---|---|---|
| 3774 | ACZ45034 | 3774 | 34278 | 64782, 95286, 125790, 156294, 186798 | 10790 | AHC60779 | 10790 | 41294 | 71798, 102302, 132806, 163310, 193814 |
| 3775 | ACZ45036 | 3775 | 34279 | 64783, 95287, 125791, 156295, 186799 | 10791 | AHC60791 | 10791 | 41295 | 71799, 102303, 132807, 163311, 193815 |
| 3776 | ACZ45037 | 3776 | 34280 | 64784, 95288, 125792, 156296, 186800 | 10792 | AHC60803 | 10792 | 41296 | 71800, 102304, 132808, 163312, 193816 |
| 3777 | ACZ45038 | 3777 | 34281 | 64785, 95289, 125793, 156297, 186801 | 10793 | AHC60815 | 10793 | 41297 | 71801, 102305, 132809, 163313, 193817 |
| 3778 | ACZ45039 | 3778 | 34282 | 64786, 95290, 125794, 156298, 186802 | 10794 | AHC60827 | 10794 | 41298 | 71802, 102306, 132810, 163314, 193818 |
| 3779 | ACZ45040 | 3779 | 34283 | 64787, 95291, 125795, 156299, 186803 | 10795 | AHC60839 | 10795 | 41299 | 71803, 102307, 132811, 163315, 193819 |
| 3780 | ACZ52567 | 3780 | 34284 | 64788, 95292, 125796, 156300, 186804 | 10796 | AHC60851 | 10796 | 41300 | 71804, 102308, 132812, 163316, 193820 |
| 3781 | ACZ52568 | 3781 | 34285 | 64789, 95293, 125797, 156301, 186805 | 10797 | AHC60863 | 10797 | 41301 | 71805, 102309, 132813, 163317, 193821 |
| 3782 | ACZ52569 | 3782 | 34286 | 64790, 95294, 125798, 156302, 186806 | 10798 | AHC60875 | 10798 | 41302 | 71806, 102310, 132814, 163318, 193822 |
| 3783 | ACZ53956 | 3783 | 34287 | 64791, 95295, 125799, 156303, 186807 | 10799 | AHC60887 | 10799 | 41303 | 71807, 102311, 132815, 163319, 193823 |
| 3784 | ACZ53967 | 3784 | 34288 | 64792, 95296, 125800, 156304, 186808 | 10800 | AHC60899 | 10800 | 41304 | 71808, 102312, 132816, 163320, 193824 |
| 3785 | ACZ53978 | 3785 | 34289 | 64793, 95297, 125801, 156305, 186809 | 10801 | AHC60911 | 10801 | 41305 | 71809, 102313, 132817, 163321, 193825 |
| 3786 | ACZ56080 | 3786 | 34290 | 64794, 95298, 125802, 156306, 186810 | 10802 | AHC60923 | 10802 | 41306 | 71810, 102314, 132818, 163322, 193826 |
| 3787 | ACZ61118 | 3787 | 34291 | 64795, 95299, 125803, 156307, 186811 | 10803 | AHC60935 | 10803 | 41307 | 71811, 102315, 132819, 163323, 193827 |
| 3788 | ACZ61119 | 3788 | 34292 | 64796, 95300, 125804, 156308, 186812 | 10804 | AHC60947 | 10804 | 41308 | 71812, 102316, 132820, 163324, 193828 |
| 3789 | ACZ61122 | 3789 | 34293 | 64797, 95301, 125805, 156309, 186813 | 10805 | AHC60959 | 10805 | 41309 | 71813, 102317, 132821, 163325, 193829 |
| 3790 | ACZ61123 | 3790 | 34294 | 64798, 95302, 125806, 156310, 186814 | 10806 | AHC60971 | 10806 | 41310 | 71814, 102318, 132822, 163326, 193830 |
| 3791 | ACZ74627 | 3791 | 34295 | 64799, 95303, 125807, 156311, 186815 | 10807 | AHC60983 | 10807 | 41311 | 71815, 102319, 132823, 163327, 193831 |

FIG. 1 continued

| | | | | | | | | | |
|---|---|---|---|---|---|---|---|---|---|
| 3792 | ACZ81554 | 3792 | 34296 | 64800, 95304, 125808, 156312, 186816 | 10808 | AHC61007 | 10808 | 41312 | 71816, 102320, 132824, 163328, 193832 |
| 3793 | ACZ81555 | 3793 | 34297 | 64801, 95305, 125809, 156313, 186817 | 10809 | AHC61019 | 10809 | 41313 | 71817, 102321, 132825, 163329, 193833 |
| 3794 | ACZ81556 | 3794 | 34298 | 64802, 95306, 125810, 156314, 186818 | 10810 | AHC61031 | 10810 | 41314 | 71818, 102322, 132826, 163330, 193834 |
| 3795 | ACZ81557 | 3795 | 34299 | 64803, 95307, 125811, 156315, 186819 | 10811 | AHC61043 | 10811 | 41315 | 71819, 102323, 132827, 163331, 193835 |
| 3796 | ACZ81558 | 3796 | 34300 | 64804, 95308, 125812, 156316, 186820 | 10812 | AHC61055 | 10812 | 41316 | 71820, 102324, 132828, 163332, 193836 |
| 3797 | ACZ81559 | 3797 | 34301 | 64805, 95309, 125813, 156317, 186821 | 10813 | AHC61067 | 10813 | 41317 | 71821, 102325, 132829, 163333, 193837 |
| 3798 | ACZ81632 | 3798 | 34302 | 64806, 95310, 125814, 156318, 186822 | 10814 | AHC61079 | 10814 | 41318 | 71822, 102326, 132830, 163334, 193838 |
| 3799 | ACZ81642 | 3799 | 34303 | 64807, 95311, 125815, 156319, 186823 | 10815 | AHC61103 | 10815 | 41319 | 71823, 102327, 132831, 163335, 193839 |
| 3800 | ACZ81652 | 3800 | 34304 | 64808, 95312, 125816, 156320, 186824 | 10816 | AHC61115 | 10816 | 41320 | 71824, 102328, 132832, 163336, 193840 |
| 3801 | ACZ92130 | 3801 | 34305 | 64809, 95313, 125817, 156321, 186825 | 10817 | AHC61127 | 10817 | 41321 | 71825, 102329, 132833, 163337, 193841 |
| 3802 | ACZ92131 | 3802 | 34306 | 64810, 95314, 125818, 156322, 186826 | 10818 | AHC61139 | 10818 | 41322 | 71826, 102330, 132834, 163338, 193842 |
| 3803 | ACZ92132 | 3803 | 34307 | 64811, 95315, 125819, 156323, 186827 | 10819 | AHC61151 | 10819 | 41323 | 71827, 102331, 132835, 163339, 193843 |
| 3804 | ACZ92133 | 3804 | 34308 | 64812, 95316, 125820, 156324, 186828 | 10820 | AHC61163 | 10820 | 41324 | 71828, 102332, 132836, 163340, 193844 |
| 3805 | ACZ92134 | 3805 | 34309 | 64813, 95317, 125821, 156325, 186829 | 10821 | AHC61175 | 10821 | 41325 | 71829, 102333, 132837, 163341, 193845 |
| 3806 | ACZ95465 | 3806 | 34310 | 64814, 95318, 125822, 156326, 186830 | 10822 | AHC61187 | 10822 | 41326 | 71830, 102334, 132838, 163342, 193846 |
| 3807 | ACZ95837 | 3807 | 34311 | 64815, 95319, 125823, 156327, 186831 | 10823 | AHC61199 | 10823 | 41327 | 71831, 102335, 132839, 163343, 193847 |
| 3808 | ACZ95847 | 3808 | 34312 | 64816, 95320, 125824, 156328, 186832 | 10824 | AHC61211 | 10824 | 41328 | 71832, 102336, 132840, 163344, 193848 |
| 3809 | ACZ95857 | 3809 | 34313 | 64817, 95321, 125825, 156329, 186833 | 10825 | AHC61223 | 10825 | 41329 | 71833, 102337, 132841, 163345, 193849 |

FIG. 1 continued

| | | | | | | | | | |
|---|---|---|---|---|---|---|---|---|---|
| 3810 | ACZ95867 | 3810 | 34314 | 64818, 95322, 125826, 156330, 186834 | 10826 | AHC61235 | 10826 | 41330 | 71834, 102338, 132842, 163346, 193850 |
| 3811 | ACZ95887 | 3811 | 34315 | 64819, 95323, 125827, 156331, 186835 | 10827 | AHC61247 | 10827 | 41331 | 71835, 102339, 132843, 163347, 193851 |
| 3812 | ACZ95897 | 3812 | 34316 | 64820, 95324, 125828, 156332, 186836 | 10828 | AHC61259 | 10828 | 41332 | 71836, 102340, 132844, 163348, 193852 |
| 3813 | ACZ95907 | 3813 | 34317 | 64821, 95325, 125829, 156333, 186837 | 10829 | AHC61271 | 10829 | 41333 | 71837, 102341, 132845, 163349, 193853 |
| 3814 | ACZ95927 | 3814 | 34318 | 64822, 95326, 125830, 156334, 186838 | 10830 | AHC61283 | 10830 | 41334 | 71838, 102342, 132846, 163350, 193854 |
| 3815 | ACZ95937 | 3815 | 34319 | 64823, 95327, 125831, 156335, 186839 | 10831 | AHC61295 | 10831 | 41335 | 71839, 102343, 132847, 163351, 193855 |
| 3816 | ACZ95947 | 3816 | 34320 | 64824, 95328, 125832, 156336, 186840 | 10832 | AHC61307 | 10832 | 41336 | 71840, 102344, 132848, 163352, 193856 |
| 3817 | ACZ95957 | 3817 | 34321 | 64825, 95329, 125833, 156337, 186841 | 10833 | AHC61319 | 10833 | 41337 | 71841, 102345, 132849, 163353, 193857 |
| 3818 | ACZ95967 | 3818 | 34322 | 64826, 95330, 125834, 156338, 186842 | 10834 | AHC61331 | 10834 | 41338 | 71842, 102346, 132850, 163354, 193858 |
| 3819 | ACZ95977 | 3819 | 34323 | 64827, 95331, 125835, 156339, 186843 | 10835 | AHC61343 | 10835 | 41339 | 71843, 102347, 132851, 163355, 193859 |
| 3820 | ACZ95987 | 3820 | 34324 | 64828, 95332, 125836, 156340, 186844 | 10836 | AHC61355 | 10836 | 41340 | 71844, 102348, 132852, 163356, 193860 |
| 3821 | ACZ95997 | 3821 | 34325 | 64829, 95333, 125837, 156341, 186845 | 10837 | AHC61367 | 10837 | 41341 | 71845, 102349, 132853, 163357, 193861 |
| 3822 | ACZ96007 | 3822 | 34326 | 64830, 95334, 125838, 156342, 186846 | 10838 | AHC61379 | 10838 | 41342 | 71846, 102350, 132854, 163358, 193862 |
| 3823 | ACZ96017 | 3823 | 34327 | 64831, 95335, 125839, 156343, 186847 | 10839 | AHC61391 | 10839 | 41343 | 71847, 102351, 132855, 163359, 193863 |
| 3824 | ACZ96027 | 3824 | 34328 | 64832, 95336, 125840, 156344, 186848 | 10840 | AHC61403 | 10840 | 41344 | 71848, 102352, 132856, 163360, 193864 |
| 3825 | ACZ96047 | 3825 | 34329 | 64833, 95337, 125841, 156345, 186849 | 10841 | AHC61415 | 10841 | 41345 | 71849, 102353, 132857, 163361, 193865 |
| 3826 | ACZ96057 | 3826 | 34330 | 64834, 95338, 125842, 156346, 186850 | 10842 | AHC61427 | 10842 | 41346 | 71850, 102354, 132858, 163362, 193866 |
| 3827 | ACZ96069 | 3827 | 34331 | 64835, 95339, 125843, 156347, 186851 | 10843 | AHC61439 | 10843 | 41347 | 71851, 102355, 132859, 163363, 193867 |

FIG. 1 continued

| | | | | | | | | | |
|---|---|---|---|---|---|---|---|---|---|
| 3828 | ACZ96089 | 3828 | 34332 | 64836, 95340, 125844, 156348, 186852 | 10844 | AHC61451 | 10844 | 41348 | 71852, 102356, 132860, 163364, 193868 |
| 3829 | ACZ96119 | 3829 | 34333 | 64837, 95341, 125845, 156349, 186853 | 10845 | AHC61463 | 10845 | 41349 | 71853, 102357, 132861, 163365, 193869 |
| 3830 | ACZ96129 | 3830 | 34334 | 64838, 95342, 125846, 156350, 186854 | 10846 | AHC61475 | 10846 | 41350 | 71854, 102358, 132862, 163366, 193870 |
| 3831 | ACZ96149 | 3831 | 34335 | 64839, 95343, 125847, 156351, 186855 | 10847 | AHC61487 | 10847 | 41351 | 71855, 102359, 132863, 163367, 193871 |
| 3832 | ACZ96159 | 3832 | 34336 | 64840, 95344, 125848, 156352, 186856 | 10848 | AHC61499 | 10848 | 41352 | 71856, 102360, 132864, 163368, 193872 |
| 3833 | ACZ96179 | 3833 | 34337 | 64841, 95345, 125849, 156353, 186857 | 10849 | AHC61511 | 10849 | 41353 | 71857, 102361, 132865, 163369, 193873 |
| 3834 | ACZ96189 | 3834 | 34338 | 64842, 95346, 125850, 156354, 186858 | 10850 | AHC61523 | 10850 | 41354 | 71858, 102362, 132866, 163370, 193874 |
| 3835 | ACZ96199 | 3835 | 34339 | 64843, 95347, 125851, 156355, 186859 | 10851 | AHC61535 | 10851 | 41355 | 71859, 102363, 132867, 163371, 193875 |
| 3836 | ACZ96209 | 3836 | 34340 | 64844, 95348, 125852, 156356, 186860 | 10852 | AHC61547 | 10852 | 41356 | 71860, 102364, 132868, 163372, 193876 |
| 3837 | ACZ96219 | 3837 | 34341 | 64845, 95349, 125853, 156357, 186861 | 10853 | AHC61559 | 10853 | 41357 | 71861, 102365, 132869, 163373, 193877 |
| 3838 | ACZ96229 | 3838 | 34342 | 64846, 95350, 125854, 156358, 186862 | 10854 | AHC61571 | 10854 | 41358 | 71862, 102366, 132870, 163374, 193878 |
| 3839 | ACZ96239 | 3839 | 34343 | 64847, 95351, 125855, 156359, 186863 | 10855 | AHC61583 | 10855 | 41359 | 71863, 102367, 132871, 163375, 193879 |
| 3840 | ACZ96249 | 3840 | 34344 | 64848, 95352, 125856, 156360, 186864 | 10856 | AHC61595 | 10856 | 41360 | 71864, 102368, 132872, 163376, 193880 |
| 3841 | ACZ96269 | 3841 | 34345 | 64849, 95353, 125857, 156361, 186865 | 10857 | AHC61607 | 10857 | 41361 | 71865, 102369, 132873, 163377, 193881 |
| 3842 | ACZ96299 | 3842 | 34346 | 64850, 95354, 125858, 156362, 186866 | 10858 | AHC61619 | 10858 | 41362 | 71866, 102370, 132874, 163378, 193882 |
| 3843 | ACZ96309 | 3843 | 34347 | 64851, 95355, 125859, 156363, 186867 | 10859 | AHC61631 | 10859 | 41363 | 71867, 102371, 132875, 163379, 193883 |
| 3844 | ACZ96319 | 3844 | 34348 | 64852, 95356, 125860, 156364, 186868 | 10860 | AHC61643 | 10860 | 41364 | 71868, 102372, 132876, 163380, 193884 |
| 3845 | ACZ96329 | 3845 | 34349 | 64853, 95357, 125861, 156365, 186869 | 10861 | AHC61655 | 10861 | 41365 | 71869, 102373, 132877, 163381, 193885 |

FIG. 1 continued

| | | | | | | | | | |
|---|---|---|---|---|---|---|---|---|---|
| 3846 | ACZ96339 | 3846 | 34350 | 64854, 95358, 125862, 156366, 186870 | 10862 | AHC61667 | 10862 | 41366 | 71870, 102374, 132878, 163382, 193886 |
| 3847 | ACZ96349 | 3847 | 34351 | 64855, 95359, 125863, 156367, 186871 | 10863 | AHC61679 | 10863 | 41367 | 71871, 102375, 132879, 163383, 193887 |
| 3848 | ACZ96359 | 3848 | 34352 | 64856, 95360, 125864, 156368, 186872 | 10864 | AHC61691 | 10864 | 41368 | 71872, 102376, 132880, 163384, 193888 |
| 3849 | ACZ96372 | 3849 | 34353 | 64857, 95361, 125865, 156369, 186873 | 10865 | AHC61703 | 10865 | 41369 | 71873, 102377, 132881, 163385, 193889 |
| 3850 | ACZ96382 | 3850 | 34354 | 64858, 95362, 125866, 156370, 186874 | 10866 | AHC61715 | 10866 | 41370 | 71874, 102378, 132882, 163386, 193890 |
| 3851 | ACZ96392 | 3851 | 34355 | 64859, 95363, 125867, 156371, 186875 | 10867 | AHC61727 | 10867 | 41371 | 71875, 102379, 132883, 163387, 193891 |
| 3852 | ACZ96405 | 3852 | 34356 | 64860, 95364, 125868, 156372, 186876 | 10868 | AHC61739 | 10868 | 41372 | 71876, 102380, 132884, 163388, 193892 |
| 3853 | ACZ96415 | 3853 | 34357 | 64861, 95365, 125869, 156373, 186877 | 10869 | AHC61751 | 10869 | 41373 | 71877, 102381, 132885, 163389, 193893 |
| 3854 | ACZ96425 | 3854 | 34358 | 64862, 95366, 125870, 156374, 186878 | 10870 | AHC61763 | 10870 | 41374 | 71878, 102382, 132886, 163390, 193894 |
| 3855 | ACZ96435 | 3855 | 34359 | 64863, 95367, 125871, 156375, 186879 | 10871 | AHC61775 | 10871 | 41375 | 71879, 102383, 132887, 163391, 193895 |
| 3856 | ACZ96445 | 3856 | 34360 | 64864, 95368, 125872, 156376, 186880 | 10872 | AHC61787 | 10872 | 41376 | 71880, 102384, 132888, 163392, 193896 |
| 3857 | ACZ96476 | 3857 | 34361 | 64865, 95369, 125873, 156377, 186881 | 10873 | AHC61799 | 10873 | 41377 | 71881, 102385, 132889, 163393, 193897 |
| 3858 | ACZ96496 | 3858 | 34362 | 64866, 95370, 125874, 156378, 186882 | 10874 | AHC61823 | 10874 | 41378 | 71882, 102386, 132890, 163394, 193898 |
| 3859 | ACZ96506 | 3859 | 34363 | 64867, 95371, 125875, 156379, 186883 | 10875 | AHC61835 | 10875 | 41379 | 71883, 102387, 132891, 163395, 193899 |
| 3860 | ACZ96526 | 3860 | 34364 | 64868, 95372, 125876, 156380, 186884 | 10876 | AHC61847 | 10876 | 41380 | 71884, 102388, 132892, 163396, 193900 |
| 3861 | ACZ96536 | 3861 | 34365 | 64869, 95373, 125877, 156381, 186885 | 10877 | AHC61859 | 10877 | 41381 | 71885, 102389, 132893, 163397, 193901 |
| 3862 | ACZ96549 | 3862 | 34366 | 64870, 95374, 125878, 156382, 186886 | 10878 | AHC61871 | 10878 | 41382 | 71886, 102390, 132894, 163398, 193902 |
| 3863 | ACZ96559 | 3863 | 34367 | 64871, 95375, 125879, 156383, 186887 | 10879 | AHC61883 | 10879 | 41383 | 71887, 102391, 132895, 163399, 193903 |

FIG. 1 continued

| | | | | | | | | | |
|---|---|---|---|---|---|---|---|---|---|
| 3864 | ACZ96569 | 3864 | 34368 | 64872, 95376, 125880, 156384, 186888 | 10880 | AHC61895 | 10880 | 41384 | 71888, 102392, 132896, 163400, 193904 |
| 3865 | ACZ96579 | 3865 | 34369 | 64873, 95377, 125881, 156385, 186889 | 10881 | AHC61907 | 10881 | 41385 | 71889, 102393, 132897, 163401, 193905 |
| 3866 | ACZ96589 | 3866 | 34370 | 64874, 95378, 125882, 156386, 186890 | 10882 | AHC61931 | 10882 | 41386 | 71890, 102394, 132898, 163402, 193906 |
| 3867 | ACZ96599 | 3867 | 34371 | 64875, 95379, 125883, 156387, 186891 | 10883 | AHC61943 | 10883 | 41387 | 71891, 102395, 132899, 163403, 193907 |
| 3868 | ACZ96609 | 3868 | 34372 | 64876, 95380, 125884, 156388, 186892 | 10884 | AHC61955 | 10884 | 41388 | 71892, 102396, 132900, 163404, 193908 |
| 3869 | ACZ96619 | 3869 | 34373 | 64877, 95381, 125885, 156389, 186893 | 10885 | AHC61967 | 10885 | 41389 | 71893, 102397, 132901, 163405, 193909 |
| 3870 | ACZ96629 | 3870 | 34374 | 64878, 95382, 125886, 156390, 186894 | 10886 | AHC61979 | 10886 | 41390 | 71894, 102398, 132902, 163406, 193910 |
| 3871 | ACZ96639 | 3871 | 34375 | 64879, 95383, 125887, 156391, 186895 | 10887 | AHC61991 | 10887 | 41391 | 71895, 102399, 132903, 163407, 193911 |
| 3872 | ACZ96649 | 3872 | 34376 | 64880, 95384, 125888, 156392, 186896 | 10888 | AHC62003 | 10888 | 41392 | 71896, 102400, 132904, 163408, 193912 |
| 3873 | ACZ96659 | 3873 | 34377 | 64881, 95385, 125889, 156393, 186897 | 10889 | AHC62015 | 10889 | 41393 | 71897, 102401, 132905, 163409, 193913 |
| 3874 | ACZ96669 | 3874 | 34378 | 64882, 95386, 125890, 156394, 186898 | 10890 | AHC62027 | 10890 | 41394 | 71898, 102402, 132906, 163410, 193914 |
| 3875 | ACZ96679 | 3875 | 34379 | 64883, 95387, 125891, 156395, 186899 | 10891 | AHC62039 | 10891 | 41395 | 71899, 102403, 132907, 163411, 193915 |
| 3876 | ACZ96689 | 3876 | 34380 | 64884, 95388, 125892, 156396, 186900 | 10892 | AHC62050 | 10892 | 41396 | 71900, 102404, 132908, 163412, 193916 |
| 3877 | ACZ96699 | 3877 | 34381 | 64885, 95389, 125893, 156397, 186901 | 10893 | AHC62062 | 10893 | 41397 | 71901, 102405, 132909, 163413, 193917 |
| 3878 | ACZ96719 | 3878 | 34382 | 64886, 95390, 125894, 156398, 186902 | 10894 | AHC62074 | 10894 | 41398 | 71902, 102406, 132910, 163414, 193918 |
| 3879 | ACZ96729 | 3879 | 34383 | 64887, 95391, 125895, 156399, 186903 | 10895 | AHC62086 | 10895 | 41399 | 71903, 102407, 132911, 163415, 193919 |
| 3880 | ACZ96739 | 3880 | 34384 | 64888, 95392, 125896, 156400, 186904 | 10896 | AHC62098 | 10896 | 41400 | 71904, 102408, 132912, 163416, 193920 |
| 3881 | ACZ96749 | 3881 | 34385 | 64889, 95393, 125897, 156401, 186905 | 10897 | AHC62110 | 10897 | 41401 | 71905, 102409, 132913, 163417, 193921 |

FIG. 1 continued

| | | | | | | | | | |
|---|---|---|---|---|---|---|---|---|---|
| 3882 | ACZ96759 | 3882 | 34386 | 64890, 95394, 125898, 156402, 186906 | 10898 | AHC62122 | 10898 | 41402 | 71906, 102410, 132914, 163418, 193922 |
| 3883 | ACZ96769 | 3883 | 34387 | 64891, 95395, 125899, 156403, 186907 | 10899 | AHC62134 | 10899 | 41403 | 71907, 102411, 132915, 163419, 193923 |
| 3884 | ACZ96779 | 3884 | 34388 | 64892, 95396, 125900, 156404, 186908 | 10900 | AHC62146 | 10900 | 41404 | 71908, 102412, 132916, 163420, 193924 |
| 3885 | ACZ96789 | 3885 | 34389 | 64893, 95397, 125901, 156405, 186909 | 10901 | AHC62158 | 10901 | 41405 | 71909, 102413, 132917, 163421, 193925 |
| 3886 | ACZ96809 | 3886 | 34390 | 64894, 95398, 125902, 156406, 186910 | 10902 | AHC62170 | 10902 | 41406 | 71910, 102414, 132918, 163422, 193926 |
| 3887 | ACZ96819 | 3887 | 34391 | 64895, 95399, 125903, 156407, 186911 | 10903 | AHC62182 | 10903 | 41407 | 71911, 102415, 132919, 163423, 193927 |
| 3888 | ACZ96829 | 3888 | 34392 | 64896, 95400, 125904, 156408, 186912 | 10904 | AHC62194 | 10904 | 41408 | 71912, 102416, 132920, 163424, 193928 |
| 3889 | ACZ96839 | 3889 | 34393 | 64897, 95401, 125905, 156409, 186913 | 10905 | AHC62206 | 10905 | 41409 | 71913, 102417, 132921, 163425, 193929 |
| 3890 | ACZ96849 | 3890 | 34394 | 64898, 95402, 125906, 156410, 186914 | 10906 | AHC62218 | 10906 | 41410 | 71914, 102418, 132922, 163426, 193930 |
| 3891 | ACZ96859 | 3891 | 34395 | 64899, 95403, 125907, 156411, 186915 | 10907 | AHC62242 | 10907 | 41411 | 71915, 102419, 132923, 163427, 193931 |
| 3892 | ACZ96869 | 3892 | 34396 | 64900, 95404, 125908, 156412, 186916 | 10908 | AHC62254 | 10908 | 41412 | 71916, 102420, 132924, 163428, 193932 |
| 3893 | ACZ96879 | 3893 | 34397 | 64901, 95405, 125909, 156413, 186917 | 10909 | AHC62266 | 10909 | 41413 | 71917, 102421, 132925, 163429, 193933 |
| 3894 | ACZ96899 | 3894 | 34398 | 64902, 95406, 125910, 156414, 186918 | 10910 | AHC62278 | 10910 | 41414 | 71918, 102422, 132926, 163430, 193934 |
| 3895 | ACZ96909 | 3895 | 34399 | 64903, 95407, 125911, 156415, 186919 | 10911 | AHC62290 | 10911 | 41415 | 71919, 102423, 132927, 163431, 193935 |
| 3896 | ACZ96919 | 3896 | 34400 | 64904, 95408, 125912, 156416, 186920 | 10912 | AHC62302 | 10912 | 41416 | 71920, 102424, 132928, 163432, 193936 |
| 3897 | ACZ96929 | 3897 | 34401 | 64905, 95409, 125913, 156417, 186921 | 10913 | AHC62314 | 10913 | 41417 | 71921, 102425, 132929, 163433, 193937 |
| 3898 | ACZ96939 | 3898 | 34402 | 64906, 95410, 125914, 156418, 186922 | 10914 | AHC62326 | 10914 | 41418 | 71922, 102426, 132930, 163434, 193938 |
| 3899 | ACZ96949 | 3899 | 34403 | 64907, 95411, 125915, 156419, 186923 | 10915 | AHC62338 | 10915 | 41419 | 71923, 102427, 132931, 163435, 193939 |

FIG. 1 continued

| | | | | | | | | | |
|---|---|---|---|---|---|---|---|---|---|
| 3900 | ACZ97021 | 3900 | 34404 | 64908, 95412, 125916, 156420, 186924 | 10916 | AHC62350 | 10916 | 41420 | 71924, 102428, 132932, 163436, 193940 |
| 3901 | ACZ97343 | 3901 | 34405 | 64909, 95413, 125917, 156421, 186925 | 10917 | AHC62362 | 10917 | 41421 | 71925, 102429, 132933, 163437, 193941 |
| 3902 | ACZ97353 | 3902 | 34406 | 64910, 95414, 125918, 156422, 186926 | 10918 | AHC62374 | 10918 | 41422 | 71926, 102430, 132934, 163438, 193942 |
| 3903 | ACZ97363 | 3903 | 34407 | 64911, 95415, 125919, 156423, 186927 | 10919 | AHC62386 | 10919 | 41423 | 71927, 102431, 132935, 163439, 193943 |
| 3904 | ACZ97383 | 3904 | 34408 | 64912, 95416, 125920, 156424, 186928 | 10920 | AHC62398 | 10920 | 41424 | 71928, 102432, 132936, 163440, 193944 |
| 3905 | ACZ97393 | 3905 | 34409 | 64913, 95417, 125921, 156425, 186929 | 10921 | AHC62410 | 10921 | 41425 | 71929, 102433, 132937, 163441, 193945 |
| 3906 | ACZ98178 | 3906 | 34410 | 64914, 95418, 125922, 156426, 186930 | 10922 | AHC62422 | 10922 | 41426 | 71930, 102434, 132938, 163442, 193946 |
| 3907 | ACZ98188 | 3907 | 34411 | 64915, 95419, 125923, 156427, 186931 | 10923 | AHC62434 | 10923 | 41427 | 71931, 102435, 132939, 163443, 193947 |
| 3908 | ACZ98198 | 3908 | 34412 | 64916, 95420, 125924, 156428, 186932 | 10924 | AHC62446 | 10924 | 41428 | 71932, 102436, 132940, 163444, 193948 |
| 3909 | ACZ98208 | 3909 | 34413 | 64917, 95421, 125925, 156429, 186933 | 10925 | AHC62458 | 10925 | 41429 | 71933, 102437, 132941, 163445, 193949 |
| 3910 | ACZ98218 | 3910 | 34414 | 64918, 95422, 125926, 156430, 186934 | 10926 | AHC62470 | 10926 | 41430 | 71934, 102438, 132942, 163446, 193950 |
| 3911 | ACZ98228 | 3911 | 34415 | 64919, 95423, 125927, 156431, 186935 | 10927 | AHC62482 | 10927 | 41431 | 71935, 102439, 132943, 163447, 193951 |
| 3912 | ACZ98238 | 3912 | 34416 | 64920, 95424, 125928, 156432, 186936 | 10928 | AHC62506 | 10928 | 41432 | 71936, 102440, 132944, 163448, 193952 |
| 3913 | ACZ98248 | 3913 | 34417 | 64921, 95425, 125929, 156433, 186937 | 10929 | AHC62518 | 10929 | 41433 | 71937, 102441, 132945, 163449, 193953 |
| 3914 | ACZ98258 | 3914 | 34418 | 64922, 95426, 125930, 156434, 186938 | 10930 | AHC62530 | 10930 | 41434 | 71938, 102442, 132946, 163450, 193954 |
| 3915 | ACZ98268 | 3915 | 34419 | 64923, 95427, 125931, 156435, 186939 | 10931 | AHC62542 | 10931 | 41435 | 71939, 102443, 132947, 163451, 193955 |
| 3916 | ACZ98278 | 3916 | 34420 | 64924, 95428, 125932, 156436, 186940 | 10932 | AHC62554 | 10932 | 41436 | 71940, 102444, 132948, 163452, 193956 |
| 3917 | ACZ98288 | 3917 | 34421 | 64925, 95429, 125933, 156437, 186941 | 10933 | AHC62566 | 10933 | 41437 | 71941, 102445, 132949, 163453, 193957 |

FIG. 1 continued

| | | | | | | | | | |
|---|---|---|---|---|---|---|---|---|---|
| 3918 | ACZ98298 | 3918 | 34422 | 64926, 95430, 125934, 156438, 186942 | 10934 | AHC62578 | 10934 | 41438 | 71942, 102446, 132950, 163454, 193958 |
| 3919 | ACZ98318 | 3919 | 34423 | 64927, 95431, 125935, 156439, 186943 | 10935 | AHC62590 | 10935 | 41439 | 71943, 102447, 132951, 163455, 193959 |
| 3920 | ACZ98328 | 3920 | 34424 | 64928, 95432, 125936, 156440, 186944 | 10936 | AHC62602 | 10936 | 41440 | 71944, 102448, 132952, 163456, 193960 |
| 3921 | ACZ98338 | 3921 | 34425 | 64929, 95433, 125937, 156441, 186945 | 10937 | AHC62614 | 10937 | 41441 | 71945, 102449, 132953, 163457, 193961 |
| 3922 | ACZ98348 | 3922 | 34426 | 64930, 95434, 125938, 156442, 186946 | 10938 | AHC62626 | 10938 | 41442 | 71946, 102450, 132954, 163458, 193962 |
| 3923 | ACZ98358 | 3923 | 34427 | 64931, 95435, 125939, 156443, 186947 | 10939 | AHC62638 | 10939 | 41443 | 71947, 102451, 132955, 163459, 193963 |
| 3924 | ACZ98368 | 3924 | 34428 | 64932, 95436, 125940, 156444, 186948 | 10940 | AHC62650 | 10940 | 41444 | 71948, 102452, 132956, 163460, 193964 |
| 3925 | ACZ98388 | 3925 | 34429 | 64933, 95437, 125941, 156445, 186949 | 10941 | AHC62662 | 10941 | 41445 | 71949, 102453, 132957, 163461, 193965 |
| 3926 | ACZ98398 | 3926 | 34430 | 64934, 95438, 125942, 156446, 186950 | 10942 | AHC62674 | 10942 | 41446 | 71950, 102454, 132958, 163462, 193966 |
| 3927 | ACZ98408 | 3927 | 34431 | 64935, 95439, 125943, 156447, 186951 | 10943 | AHE37972 | 10943 | 41447 | 71951, 102455, 132959, 163463, 193967 |
| 3928 | ACZ98418 | 3928 | 34432 | 64936, 95440, 125944, 156448, 186952 | 10944 | AHE37973 | 10944 | 41448 | 71952, 102456, 132960, 163464, 193968 |
| 3929 | ACZ98428 | 3929 | 34433 | 64937, 95441, 125945, 156449, 186953 | 10945 | AHE37974 | 10945 | 41449 | 71953, 102457, 132961, 163465, 193969 |
| 3930 | ACZ98438 | 3930 | 34434 | 64938, 95442, 125946, 156450, 186954 | 10946 | AHE37975 | 10946 | 41450 | 71954, 102458, 132962, 163466, 193970 |
| 3931 | ACZ98448 | 3931 | 34435 | 64939, 95443, 125947, 156451, 186955 | 10947 | AHE37976 | 10947 | 41451 | 71955, 102459, 132963, 163467, 193971 |
| 3932 | ACZ98458 | 3932 | 34436 | 64940, 95444, 125948, 156452, 186956 | 10948 | AHE37977 | 10948 | 41452 | 71956, 102460, 132964, 163468, 193972 |
| 3933 | ACZ98546 | 3933 | 34437 | 64941, 95445, 125949, 156453, 186957 | 10949 | AHE37978 | 10949 | 41453 | 71957, 102461, 132965, 163469, 193973 |
| 3934 | ACZ98560 | 3934 | 34438 | 64942, 95446, 125950, 156454, 186958 | 10950 | AHE37979 | 10950 | 41454 | 71958, 102462, 132966, 163470, 193974 |
| 3935 | ACZ98567 | 3935 | 34439 | 64943, 95447, 125951, 156455, 186959 | 10951 | AHE37980 | 10951 | 41455 | 71959, 102463, 132967, 163471, 193975 |

FIG. 1 continued

| | | | | | | | | | |
|---|---|---|---|---|---|---|---|---|---|
| 3936 | ACZ98671 | 3936 | 34440 | 64944, 95448, 125952, 156456, 186960 | 10952 | AHE37981 | 10952 | 41456 | 71960, 102464, 132968, 163472, 193976 |
| 3937 | ACZ98681 | 3937 | 34441 | 64945, 95449, 125953, 156457, 186961 | 10953 | AHE37982 | 10953 | 41457 | 71961, 102465, 132969, 163473, 193977 |
| 3938 | ACZ98691 | 3938 | 34442 | 64946, 95450, 125954, 156458, 186962 | 10954 | AHE37983 | 10954 | 41458 | 71962, 102466, 132970, 163474, 193978 |
| 3939 | ADA60799 | 3939 | 34443 | 64947, 95451, 125955, 156459, 186963 | 10955 | AHE37984 | 10955 | 41459 | 71963, 102467, 132971, 163475, 193979 |
| 3940 | ADA69302 | 3940 | 34444 | 64948, 95452, 125956, 156460, 186964 | 10956 | AHE37985 | 10956 | 41460 | 71964, 102468, 132972, 163476, 193980 |
| 3941 | ADA69312 | 3941 | 34445 | 64949, 95453, 125957, 156461, 186965 | 10957 | AHE37986 | 10957 | 41461 | 71965, 102469, 132973, 163477, 193981 |
| 3942 | ADA69322 | 3942 | 34446 | 64950, 95454, 125958, 156462, 186966 | 10958 | AHE37987 | 10958 | 41462 | 71966, 102470, 132974, 163478, 193982 |
| 3943 | ADA69332 | 3943 | 34447 | 64951, 95455, 125959, 156463, 186967 | 10959 | AHE37988 | 10959 | 41463 | 71967, 102471, 132975, 163479, 193983 |
| 3944 | ADA70329 | 3944 | 34448 | 64952, 95456, 125960, 156464, 186968 | 10960 | AHE37989 | 10960 | 41464 | 71968, 102472, 132976, 163480, 193984 |
| 3945 | ADA71150 | 3945 | 34449 | 64953, 95457, 125961, 156465, 186969 | 10961 | AHE37990 | 10961 | 41465 | 71969, 102473, 132977, 163481, 193985 |
| 3946 | ADA71152 | 3946 | 34450 | 64954, 95458, 125962, 156466, 186970 | 10962 | AHE37991 | 10962 | 41466 | 71970, 102474, 132978, 163482, 193986 |
| 3947 | ADA71154 | 3947 | 34451 | 64955, 95459, 125963, 156467, 186971 | 10963 | AHE37992 | 10963 | 41467 | 71971, 102475, 132979, 163483, 193987 |
| 3948 | ADA71158 | 3948 | 34452 | 64956, 95460, 125964, 156468, 186972 | 10964 | AHE38023 | 10964 | 41468 | 71972, 102476, 132980, 163484, 193988 |
| 3949 | ADA71162 | 3949 | 34453 | 64957, 95461, 125965, 156469, 186973 | 10965 | AHE38024 | 10965 | 41469 | 71973, 102477, 132981, 163485, 193989 |
| 3950 | ADA71164 | 3950 | 34454 | 64958, 95462, 125966, 156470, 186974 | 10966 | AHE38026 | 10966 | 41470 | 71974, 102478, 132982, 163486, 193990 |
| 3951 | ADA71168 | 3951 | 34455 | 64959, 95463, 125967, 156471, 186975 | 10967 | AHE38027 | 10967 | 41471 | 71975, 102479, 132983, 163487, 193991 |
| 3952 | ADA71170 | 3952 | 34456 | 64960, 95464, 125968, 156472, 186976 | 10968 | AHF20558 | 10968 | 41472 | 71976, 102480, 132984, 163488, 193992 |
| 3953 | ADA71172 | 3953 | 34457 | 64961, 95465, 125969, 156473, 186977 | 10969 | AHF20568 | 10969 | 41473 | 71977, 102481, 132985, 163489, 193993 |

FIG. 1 continued

| | | | | | | | | | |
|---|---|---|---|---|---|---|---|---|---|
| 3954 | ADA71176 | 3954 | 34458 | 64962, 95466, 125970, 156474, 186978 | 10970 | AHG96108 | 10970 | 41474 | 71978, 102482, 132986, 163490, 193994 |
| 3955 | ADA71181 | 3955 | 34459 | 64963, 95467, 125971, 156475, 186979 | 10971 | AHG96120 | 10971 | 41475 | 71979, 102483, 132987, 163491, 193995 |
| 3956 | ADA71191 | 3956 | 34460 | 64964, 95468, 125972, 156476, 186980 | 10972 | AHG96132 | 10972 | 41476 | 71980, 102484, 132988, 163492, 193996 |
| 3957 | ADA79587 | 3957 | 34461 | 64965, 95469, 125973, 156477, 186981 | 10973 | AHG96144 | 10973 | 41477 | 71981, 102485, 132989, 163493, 193997 |
| 3958 | ADA79607 | 3958 | 34462 | 64966, 95470, 125974, 156478, 186982 | 10974 | AHG96156 | 10974 | 41478 | 71982, 102486, 132990, 163494, 193998 |
| 3959 | ADA83043 | 3959 | 34463 | 64967, 95471, 125975, 156479, 186983 | 10975 | AHG96168 | 10975 | 41479 | 71983, 102487, 132991, 163495, 193999 |
| 3960 | ADA83044 | 3960 | 34464 | 64968, 95472, 125976, 156480, 186984 | 10976 | AHG96180 | 10976 | 41480 | 71984, 102488, 132992, 163496, 194000 |
| 3961 | ADA83580 | 3961 | 34465 | 64969, 95473, 125977, 156481, 186985 | 10977 | AHG96192 | 10977 | 41481 | 71985, 102489, 132993, 163497, 194001 |
| 3962 | ADA83587 | 3962 | 34466 | 64970, 95474, 125978, 156482, 186986 | 10978 | AHG96204 | 10978 | 41482 | 71986, 102490, 132994, 163498, 194002 |
| 3963 | ADA83591 | 3963 | 34467 | 64971, 95475, 125979, 156483, 186987 | 10979 | AHG96216 | 10979 | 41483 | 71987, 102491, 132995, 163499, 194003 |
| 3964 | ADA83595 | 3964 | 34468 | 64972, 95476, 125980, 156484, 186988 | 10980 | AHG96228 | 10980 | 41484 | 71988, 102492, 132996, 163500, 194004 |
| 3965 | ADA83599 | 3965 | 34469 | 64973, 95477, 125981, 156485, 186989 | 10981 | AHG96240 | 10981 | 41485 | 71989, 102493, 132997, 163501, 194005 |
| 3966 | ADA83603 | 3966 | 34470 | 64974, 95478, 125982, 156486, 186990 | 10982 | AHG96252 | 10982 | 41486 | 71990, 102494, 132998, 163502, 194006 |
| 3967 | ADA83611 | 3967 | 34471 | 64975, 95479, 125983, 156487, 186991 | 10983 | AHG96264 | 10983 | 41487 | 71991, 102495, 132999, 163503, 194007 |
| 3968 | ADA83615 | 3968 | 34472 | 64976, 95480, 125984, 156488, 186992 | 10984 | AHG96276 | 10984 | 41488 | 71992, 102496, 133000, 163504, 194008 |
| 3969 | ADA83622 | 3969 | 34473 | 64977, 95481, 125985, 156489, 186993 | 10985 | AHG96288 | 10985 | 41489 | 71993, 102497, 133001, 163505, 194009 |
| 3970 | ADA83633 | 3970 | 34474 | 64978, 95482, 125986, 156490, 186994 | 10986 | AHG96300 | 10986 | 41490 | 71994, 102498, 133002, 163506, 194010 |
| 3971 | ADA83637 | 3971 | 34475 | 64979, 95483, 125987, 156491, 186995 | 10987 | AHG96312 | 10987 | 41491 | 71995, 102499, 133003, 163507, 194011 |

FIG. 1 continued

| | | | | | | | | | |
|---|---|---|---|---|---|---|---|---|---|
| 3972 | ADA83641 | 3972 | 34476 | 64980, 95484, 125988, 156492, 186996 | 10988 | AHG96313 | 10988 | 41492 | 71996, 102500, 133004, 163508, 194012 |
| 3973 | ADA83645 | 3973 | 34477 | 64981, 95485, 125989, 156493, 186997 | 10989 | AHG96314 | 10989 | 41493 | 71997, 102501, 133005, 163509, 194013 |
| 3974 | ADA83648 | 3974 | 34478 | 64982, 95486, 125990, 156494, 186998 | 10990 | AHG96315 | 10990 | 41494 | 71998, 102502, 133006, 163510, 194014 |
| 3975 | ADA83656 | 3975 | 34479 | 64983, 95487, 125991, 156495, 186999 | 10991 | AHG96316 | 10991 | 41495 | 71999, 102503, 133007, 163511, 194015 |
| 3976 | ADA83660 | 3976 | 34480 | 64984, 95488, 125992, 156496, 187000 | 10992 | AHG96317 | 10992 | 41496 | 72000, 102504, 133008, 163512, 194016 |
| 3977 | ADA83664 | 3977 | 34481 | 64985, 95489, 125993, 156497, 187001 | 10993 | AHG96320 | 10993 | 41497 | 72001, 102505, 133009, 163513, 194017 |
| 3978 | ADA83668 | 3978 | 34482 | 64986, 95490, 125994, 156498, 187002 | 10994 | AHG96321 | 10994 | 41498 | 72002, 102506, 133010, 163514, 194018 |
| 3979 | ADA83672 | 3979 | 34483 | 64987, 95491, 125995, 156499, 187003 | 10995 | AHG96322 | 10995 | 41499 | 72003, 102507, 133011, 163515, 194019 |
| 3980 | ADA83676 | 3980 | 34484 | 64988, 95492, 125996, 156500, 187004 | 10996 | AHG96324 | 10996 | 41500 | 72004, 102508, 133012, 163516, 194020 |
| 3981 | ADA83680 | 3981 | 34485 | 64989, 95493, 125997, 156501, 187005 | 10997 | AHG96325 | 10997 | 41501 | 72005, 102509, 133013, 163517, 194021 |
| 3982 | ADA86068 | 3982 | 34486 | 64990, 95494, 125998, 156502, 187006 | 10998 | AHG96326 | 10998 | 41502 | 72006, 102510, 133014, 163518, 194022 |
| 3983 | ADA86086 | 3983 | 34487 | 64991, 95495, 125999, 156503, 187007 | 10999 | AHG96327 | 10999 | 41503 | 72007, 102511, 133015, 163519, 194023 |
| 3984 | ADA86087 | 3984 | 34488 | 64992, 95496, 126000, 156504, 187008 | 11000 | AHG96329 | 11000 | 41504 | 72008, 102512, 133016, 163520, 194024 |
| 3985 | ADA86088 | 3985 | 34489 | 64993, 95497, 126001, 156505, 187009 | 11001 | AHG96330 | 11001 | 41505 | 72009, 102513, 133017, 163521, 194025 |
| 3986 | ADB03603 | 3986 | 34490 | 64994, 95498, 126002, 156506, 187010 | 11002 | AHG96332 | 11002 | 41506 | 72010, 102514, 133018, 163522, 194026 |
| 3987 | ADB03604 | 3987 | 34491 | 64995, 95499, 126003, 156507, 187011 | 11003 | AHG96334 | 11003 | 41507 | 72011, 102515, 133019, 163523, 194027 |
| 3988 | ADB03605 | 3988 | 34492 | 64996, 95500, 126004, 156508, 187012 | 11004 | AHG96335 | 11004 | 41508 | 72012, 102516, 133020, 163524, 194028 |
| 3989 | ADB03607 | 3989 | 34493 | 64997, 95501, 126005, 156509, 187013 | 11005 | AHG96336 | 11005 | 41509 | 72013, 102517, 133021, 163525, 194029 |

FIG. 1 continued

| | | | | | | | | | |
|---|---|---|---|---|---|---|---|---|---|
| 3990 | ADB03609 | 3990 | 34494 | 64998, 95502, 126006, 156510, 187014 | 11006 | AHG96338 | 11006 | 41510 | 72014, 102518, 133022, 163526, 194030 |
| 3991 | ADB03611 | 3991 | 34495 | 64999, 95503, 126007, 156511, 187015 | 11007 | AHG96339 | 11007 | 41511 | 72015, 102519, 133023, 163527, 194031 |
| 3992 | ADB03612 | 3992 | 34496 | 65000, 95504, 126008, 156512, 187016 | 11008 | AHG96340 | 11008 | 41512 | 72016, 102520, 133024, 163528, 194032 |
| 3993 | ADB03614 | 3993 | 34497 | 65001, 95505, 126009, 156513, 187017 | 11009 | AHG96341 | 11009 | 41513 | 72017, 102521, 133025, 163529, 194033 |
| 3994 | ADB03617 | 3994 | 34498 | 65002, 95506, 126010, 156514, 187018 | 11010 | AHG96342 | 11010 | 41514 | 72018, 102522, 133026, 163530, 194034 |
| 3995 | ADB03619 | 3995 | 34499 | 65003, 95507, 126011, 156515, 187019 | 11011 | AHG96343 | 11011 | 41515 | 72019, 102523, 133027, 163531, 194035 |
| 3996 | ADB03620 | 3996 | 34500 | 65004, 95508, 126012, 156516, 187020 | 11012 | AHG96344 | 11012 | 41516 | 72020, 102524, 133028, 163532, 194036 |
| 3997 | ADB03622 | 3997 | 34501 | 65005, 95509, 126013, 156517, 187021 | 11013 | AHG96345 | 11013 | 41517 | 72021, 102525, 133029, 163533, 194037 |
| 3998 | ADB03623 | 3998 | 34502 | 65006, 95510, 126014, 156518, 187022 | 11014 | AHG96346 | 11014 | 41518 | 72022, 102526, 133030, 163534, 194038 |
| 3999 | ADB03628 | 3999 | 34503 | 65007, 95511, 126015, 156519, 187023 | 11015 | AHG96347 | 11015 | 41519 | 72023, 102527, 133031, 163535, 194039 |
| 4000 | ADB03629 | 4000 | 34504 | 65008, 95512, 126016, 156520, 187024 | 11016 | AHG96348 | 11016 | 41520 | 72024, 102528, 133032, 163536, 194040 |
| 4001 | ADB03630 | 4001 | 34505 | 65009, 95513, 126017, 156521, 187025 | 11017 | AHG96349 | 11017 | 41521 | 72025, 102529, 133033, 163537, 194041 |
| 4002 | ADB25319 | 4002 | 34506 | 65010, 95514, 126018, 156522, 187026 | 11018 | AHG96350 | 11018 | 41522 | 72026, 102530, 133034, 163538, 194042 |
| 4003 | ADB25321 | 4003 | 34507 | 65011, 95515, 126019, 156523, 187027 | 11019 | AHG96351 | 11019 | 41523 | 72027, 102531, 133035, 163539, 194043 |
| 4004 | ADB27970 | 4004 | 34508 | 65012, 95516, 126020, 156524, 187028 | 11020 | AHG96352 | 11020 | 41524 | 72028, 102532, 133036, 163540, 194044 |
| 4005 | ADB27980 | 4005 | 34509 | 65013, 95517, 126021, 156525, 187029 | 11021 | AHG96353 | 11021 | 41525 | 72029, 102533, 133037, 163541, 194045 |
| 4006 | ADB54352 | 4006 | 34510 | 65014, 95518, 126022, 156526, 187030 | 11022 | AHG96354 | 11022 | 41526 | 72030, 102534, 133038, 163542, 194046 |
| 4007 | ADB54355 | 4007 | 34511 | 65015, 95519, 126023, 156527, 187031 | 11023 | AHG96355 | 11023 | 41527 | 72031, 102535, 133039, 163543, 194047 |

FIG. 1 continued

| | | | | | | | | | |
|---|---|---|---|---|---|---|---|---|---|
| 4008 | ADB65926 | 4008 | 34512 | 65016, 95520, 126024, 156528, 187032 | 11024 | AHG96356 | 11024 | 41528 | 72032, 102536, 133040, 163544, 194048 |
| 4009 | ADB80153 | 4009 | 34513 | 65017, 95521, 126025, 156529, 187033 | 11025 | AHG96359 | 11025 | 41529 | 72033, 102537, 133041, 163545, 194049 |
| 4010 | ADB81399 | 4010 | 34514 | 65018, 95522, 126026, 156530, 187034 | 11026 | AHG96371 | 11026 | 41530 | 72034, 102538, 133042, 163546, 194050 |
| 4011 | ADB81409 | 4011 | 34515 | 65019, 95523, 126027, 156531, 187035 | 11027 | AHG96383 | 11027 | 41531 | 72035, 102539, 133043, 163547, 194051 |
| 4012 | ADB81419 | 4012 | 34516 | 65020, 95524, 126028, 156532, 187036 | 11028 | AHG96395 | 11028 | 41532 | 72036, 102540, 133044, 163548, 194052 |
| 4013 | ADB81429 | 4013 | 34517 | 65021, 95525, 126029, 156533, 187037 | 11029 | AHG96407 | 11029 | 41533 | 72037, 102541, 133045, 163549, 194053 |
| 4014 | ADB81439 | 4014 | 34518 | 65022, 95526, 126030, 156534, 187038 | 11030 | AHG96419 | 11030 | 41534 | 72038, 102542, 133046, 163550, 194054 |
| 4015 | ADB81449 | 4015 | 34519 | 65023, 95527, 126031, 156535, 187039 | 11031 | AHG96431 | 11031 | 41535 | 72039, 102543, 133047, 163551, 194055 |
| 4016 | ADB81459 | 4016 | 34520 | 65024, 95528, 126032, 156536, 187040 | 11032 | AHG96443 | 11032 | 41536 | 72040, 102544, 133048, 163552, 194056 |
| 4017 | ADB82655 | 4017 | 34521 | 65025, 95529, 126033, 156537, 187041 | 11033 | AHG96455 | 11033 | 41537 | 72041, 102545, 133049, 163553, 194057 |
| 4018 | ADB82656 | 4018 | 34522 | 65026, 95530, 126034, 156538, 187042 | 11034 | AHG96467 | 11034 | 41538 | 72042, 102546, 133050, 163554, 194058 |
| 4019 | ADB82944 | 4019 | 34523 | 65027, 95531, 126035, 156539, 187043 | 11035 | AHG96479 | 11035 | 41539 | 72043, 102547, 133051, 163555, 194059 |
| 4020 | ADB82950 | 4020 | 34524 | 65028, 95532, 126036, 156540, 187044 | 11036 | AHG96491 | 11036 | 41540 | 72044, 102548, 133052, 163556, 194060 |
| 4021 | ADB89129 | 4021 | 34525 | 65029, 95533, 126037, 156541, 187045 | 11037 | AHG96503 | 11037 | 41541 | 72045, 102549, 133053, 163557, 194061 |
| 4022 | ADB89139 | 4022 | 34526 | 65030, 95534, 126038, 156542, 187046 | 11038 | AHG96515 | 11038 | 41542 | 72046, 102550, 133054, 163558, 194062 |
| 4023 | ADB89149 | 4023 | 34527 | 65031, 95535, 126039, 156543, 187047 | 11039 | AHG96527 | 11039 | 41543 | 72047, 102551, 133055, 163559, 194063 |
| 4024 | ADB89150 | 4024 | 34528 | 65032, 95536, 126040, 156544, 187048 | 11040 | AHG96539 | 11040 | 41544 | 72048, 102552, 133056, 163560, 194064 |
| 4025 | ADB89221 | 4025 | 34529 | 65033, 95537, 126041, 156545, 187049 | 11041 | AHG96551 | 11041 | 41545 | 72049, 102553, 133057, 163561, 194065 |

FIG. 1 continued

| | | | | | | | | | |
|---|---|---|---|---|---|---|---|---|---|
| 4026 | ADB89241 | 4026 | 34530 | 65034, 95538, 126042, 156546, 187050 | 11042 | AHG96563 | 11042 | 41546 | 72050, 102554, 133058, 163562, 194066 |
| 4027 | ADB89251 | 4027 | 34531 | 65035, 95539, 126043, 156547, 187051 | 11043 | AHG96575 | 11043 | 41547 | 72051, 102555, 133059, 163563, 194067 |
| 4028 | ADB89261 | 4028 | 34532 | 65036, 95540, 126044, 156548, 187052 | 11044 | AHG96587 | 11044 | 41548 | 72052, 102556, 133060, 163564, 194068 |
| 4029 | ADB89271 | 4029 | 34533 | 65037, 95541, 126045, 156549, 187053 | 11045 | AHG96599 | 11045 | 41549 | 72053, 102557, 133061, 163565, 194069 |
| 4030 | ADB89281 | 4030 | 34534 | 65038, 95542, 126046, 156550, 187054 | 11046 | AHG96611 | 11046 | 41550 | 72054, 102558, 133062, 163566, 194070 |
| 4031 | ADB89291 | 4031 | 34535 | 65039, 95543, 126047, 156551, 187055 | 11047 | AHG96623 | 11047 | 41551 | 72055, 102559, 133063, 163567, 194071 |
| 4032 | ADB89301 | 4032 | 34536 | 65040, 95544, 126048, 156552, 187056 | 11048 | AHG96635 | 11048 | 41552 | 72056, 102560, 133064, 163568, 194072 |
| 4033 | ADB89311 | 4033 | 34537 | 65041, 95545, 126049, 156553, 187057 | 11049 | AHG96647 | 11049 | 41553 | 72057, 102561, 133065, 163569, 194073 |
| 4034 | ADB89321 | 4034 | 34538 | 65042, 95546, 126050, 156554, 187058 | 11050 | AHG96659 | 11050 | 41554 | 72058, 102562, 133066, 163570, 194074 |
| 4035 | ADB89331 | 4035 | 34539 | 65043, 95547, 126051, 156555, 187059 | 11051 | AHG96671 | 11051 | 41555 | 72059, 102563, 133067, 163571, 194075 |
| 4036 | ADB89341 | 4036 | 34540 | 65044, 95548, 126052, 156556, 187060 | 11052 | AHG96683 | 11052 | 41556 | 72060, 102564, 133068, 163572, 194076 |
| 4037 | ADB89351 | 4037 | 34541 | 65045, 95549, 126053, 156557, 187061 | 11053 | AHG96695 | 11053 | 41557 | 72061, 102565, 133069, 163573, 194077 |
| 4038 | ADB89361 | 4038 | 34542 | 65046, 95550, 126054, 156558, 187062 | 11054 | AHG96707 | 11054 | 41558 | 72062, 102566, 133070, 163574, 194078 |
| 4039 | ADB89371 | 4039 | 34543 | 65047, 95551, 126055, 156559, 187063 | 11055 | AHG96719 | 11055 | 41559 | 72063, 102567, 133071, 163575, 194079 |
| 4040 | ADB89381 | 4040 | 34544 | 65048, 95552, 126056, 156560, 187064 | 11056 | AHG96731 | 11056 | 41560 | 72064, 102568, 133072, 163576, 194080 |
| 4041 | ADB89391 | 4041 | 34545 | 65049, 95553, 126057, 156561, 187065 | 11057 | AHG96743 | 11057 | 41561 | 72065, 102569, 133073, 163577, 194081 |
| 4042 | ADB89401 | 4042 | 34546 | 65050, 95554, 126058, 156562, 187066 | 11058 | AHG96755 | 11058 | 41562 | 72066, 102570, 133074, 163578, 194082 |
| 4043 | ADB89411 | 4043 | 34547 | 65051, 95555, 126059, 156563, 187067 | 11059 | AHG96767 | 11059 | 41563 | 72067, 102571, 133075, 163579, 194083 |

FIG. 1 continued

| | | | | | | | | | |
|---|---|---|---|---|---|---|---|---|---|
| 4044 | ADB89431 | 4044 | 34548 | 65052, 95556, 126060, 156564, 187068 | 11060 | AHG96779 | 11060 | 41564 | 72068, 102572, 133076, 163580, 194084 |
| 4045 | ADB89441 | 4045 | 34549 | 65053, 95557, 126061, 156565, 187069 | 11061 | AHG96791 | 11061 | 41565 | 72069, 102573, 133077, 163581, 194085 |
| 4046 | ADB89461 | 4046 | 34550 | 65054, 95558, 126062, 156566, 187070 | 11062 | AHG96803 | 11062 | 41566 | 72070, 102574, 133078, 163582, 194086 |
| 4047 | ADB89481 | 4047 | 34551 | 65055, 95559, 126063, 156567, 187071 | 11063 | AHG96815 | 11063 | 41567 | 72071, 102575, 133079, 163583, 194087 |
| 4048 | ADB89491 | 4048 | 34552 | 65056, 95560, 126064, 156568, 187072 | 11064 | AHG96827 | 11064 | 41568 | 72072, 102576, 133080, 163584, 194088 |
| 4049 | ADB89501 | 4049 | 34553 | 65057, 95561, 126065, 156569, 187073 | 11065 | AHG96839 | 11065 | 41569 | 72073, 102577, 133081, 163585, 194089 |
| 4050 | ADB89511 | 4050 | 34554 | 65058, 95562, 126066, 156570, 187074 | 11066 | AHG96851 | 11066 | 41570 | 72074, 102578, 133082, 163586, 194090 |
| 4051 | ADB89531 | 4051 | 34555 | 65059, 95563, 126067, 156571, 187075 | 11067 | AHG96863 | 11067 | 41571 | 72075, 102579, 133083, 163587, 194091 |
| 4052 | ADB89541 | 4052 | 34556 | 65060, 95564, 126068, 156572, 187076 | 11068 | AHG96875 | 11068 | 41572 | 72076, 102580, 133084, 163588, 194092 |
| 4053 | ADB89551 | 4053 | 34557 | 65061, 95565, 126069, 156573, 187077 | 11069 | AHG96887 | 11069 | 41573 | 72077, 102581, 133085, 163589, 194093 |
| 4054 | ADB89561 | 4054 | 34558 | 65062, 95566, 126070, 156574, 187078 | 11070 | AHG96899 | 11070 | 41574 | 72078, 102582, 133086, 163590, 194094 |
| 4055 | ADB89571 | 4055 | 34559 | 65063, 95567, 126071, 156575, 187079 | 11071 | AHG96911 | 11071 | 41575 | 72079, 102583, 133087, 163591, 194095 |
| 4056 | ADB89581 | 4056 | 34560 | 65064, 95568, 126072, 156576, 187080 | 11072 | AHG96923 | 11072 | 41576 | 72080, 102584, 133088, 163592, 194096 |
| 4057 | ADB89591 | 4057 | 34561 | 65065, 95569, 126073, 156577, 187081 | 11073 | AHG96935 | 11073 | 41577 | 72081, 102585, 133089, 163593, 194097 |
| 4058 | ADB89601 | 4058 | 34562 | 65066, 95570, 126074, 156578, 187082 | 11074 | AHG96947 | 11074 | 41578 | 72082, 102586, 133090, 163594, 194098 |
| 4059 | ADB89611 | 4059 | 34563 | 65067, 95571, 126075, 156579, 187083 | 11075 | AHG96959 | 11075 | 41579 | 72083, 102587, 133091, 163595, 194099 |
| 4060 | ADB89621 | 4060 | 34564 | 65068, 95572, 126076, 156580, 187084 | 11076 | AHG96971 | 11076 | 41580 | 72084, 102588, 133092, 163596, 194100 |
| 4061 | ADB89631 | 4061 | 34565 | 65069, 95573, 126077, 156581, 187085 | 11077 | AHG96983 | 11077 | 41581 | 72085, 102589, 133093, 163597, 194101 |

FIG. 1 continued

| | | | | | | | | | |
|---|---|---|---|---|---|---|---|---|---|
| 4062 | ADB89641 | 4062 | 34566 | 65070, 95574, 126078, 156582, 187086 | 11078 | AHG96995 | 11078 | 41582 | 72086, 102590, 133094, 163598, 194102 |
| 4063 | ADB89651 | 4063 | 34567 | 65071, 95575, 126079, 156583, 187087 | 11079 | AHG97007 | 11079 | 41583 | 72087, 102591, 133095, 163599, 194103 |
| 4064 | ADB89661 | 4064 | 34568 | 65072, 95576, 126080, 156584, 187088 | 11080 | AHG97019 | 11080 | 41584 | 72088, 102592, 133096, 163600, 194104 |
| 4065 | ADB89671 | 4065 | 34569 | 65073, 95577, 126081, 156585, 187089 | 11081 | AHG97031 | 11081 | 41585 | 72089, 102593, 133097, 163601, 194105 |
| 4066 | ADB89681 | 4066 | 34570 | 65074, 95578, 126082, 156586, 187090 | 11082 | AHG97043 | 11082 | 41586 | 72090, 102594, 133098, 163602, 194106 |
| 4067 | ADB89691 | 4067 | 34571 | 65075, 95579, 126083, 156587, 187091 | 11083 | AHH00866 | 11083 | 41587 | 72091, 102595, 133099, 163603, 194107 |
| 4068 | ADB89701 | 4068 | 34572 | 65076, 95580, 126084, 156588, 187092 | 11084 | AHH00870 | 11084 | 41588 | 72092, 102596, 133100, 163604, 194108 |
| 4069 | ADB89711 | 4069 | 34573 | 65077, 95581, 126085, 156589, 187093 | 11085 | AHJ57430 | 11085 | 41589 | 72093, 102597, 133101, 163605, 194109 |
| 4070 | ADB89721 | 4070 | 34574 | 65078, 95582, 126086, 156590, 187094 | 11086 | AHJ57431 | 11086 | 41590 | 72094, 102598, 133102, 163606, 194110 |
| 4071 | ADB90360 | 4071 | 34575 | 65079, 95583, 126087, 156591, 187095 | 11087 | AHJ57432 | 11087 | 41591 | 72095, 102599, 133103, 163607, 194111 |
| 4072 | ADB90370 | 4072 | 34576 | 65080, 95584, 126088, 156592, 187096 | 11088 | AHJ57433 | 11088 | 41592 | 72096, 102600, 133104, 163608, 194112 |
| 4073 | ADB90414 | 4073 | 34577 | 65081, 95585, 126089, 156593, 187097 | 11089 | AHJ57434 | 11089 | 41593 | 72097, 102601, 133105, 163609, 194113 |
| 4074 | ADC32409 | 4074 | 34578 | 65082, 95586, 126090, 156594, 187098 | 11090 | AHJ57435 | 11090 | 41594 | 72098, 102602, 133106, 163610, 194114 |
| 4075 | ADC32410 | 4075 | 34579 | 65083, 95587, 126091, 156595, 187099 | 11091 | AHJ57436 | 11091 | 41595 | 72099, 102603, 133107, 163611, 194115 |
| 4076 | ADC32411 | 4076 | 34580 | 65084, 95588, 126092, 156596, 187100 | 11092 | AHJ57437 | 11092 | 41596 | 72100, 102604, 133108, 163612, 194116 |
| 4077 | ADC32412 | 4077 | 34581 | 65085, 95589, 126093, 156597, 187101 | 11093 | AHJ57438 | 11093 | 41597 | 72101, 102605, 133109, 163613, 194117 |
| 4078 | ADC32413 | 4078 | 34582 | 65086, 95590, 126094, 156598, 187102 | 11094 | AHJ57651 | 11094 | 41598 | 72102, 102606, 133110, 163614, 194118 |
| 4079 | ADC32414 | 4079 | 34583 | 65087, 95591, 126095, 156599, 187103 | 11095 | AHJ57663 | 11095 | 41599 | 72103, 102607, 133111, 163615, 194119 |

FIG. 1 continued

| | | | | | | | | | |
|---|---|---|---|---|---|---|---|---|---|
| 4080 | ADC32415 | 4080 | 34584 | 65088, 95592, 126096, 156600, 187104 | 11096 | AHJ57674 | 11096 | 41600 | 72104, 102608, 133112, 163616, 194120 |
| 4081 | ADC32416 | 4081 | 34585 | 65089, 95593, 126097, 156601, 187105 | 11097 | AHJ57686 | 11097 | 41601 | 72105, 102609, 133113, 163617, 194121 |
| 4082 | ADC32417 | 4082 | 34586 | 65090, 95594, 126098, 156602, 187106 | 11098 | AHJ57697 | 11098 | 41602 | 72106, 102610, 133114, 163618, 194122 |
| 4083 | ADC32418 | 4083 | 34587 | 65091, 95595, 126099, 156603, 187107 | 11099 | AHJ57707 | 11099 | 41603 | 72107, 102611, 133115, 163619, 194123 |
| 4084 | ADC32419 | 4084 | 34588 | 65092, 95596, 126100, 156604, 187108 | 11100 | AHJ57719 | 11100 | 41604 | 72108, 102612, 133116, 163620, 194124 |
| 4085 | ADC32420 | 4085 | 34589 | 65093, 95597, 126101, 156605, 187109 | 11101 | AHJ57731 | 11101 | 41605 | 72109, 102613, 133117, 163621, 194125 |
| 4086 | ADC32421 | 4086 | 34590 | 65094, 95598, 126102, 156606, 187110 | 11102 | AHJ57743 | 11102 | 41606 | 72110, 102614, 133118, 163622, 194126 |
| 4087 | ADC32422 | 4087 | 34591 | 65095, 95599, 126103, 156607, 187111 | 11103 | AHJ57755 | 11103 | 41607 | 72111, 102615, 133119, 163623, 194127 |
| 4088 | ADC32423 | 4088 | 34592 | 65096, 95600, 126104, 156608, 187112 | 11104 | AHJ57767 | 11104 | 41608 | 72112, 102616, 133120, 163624, 194128 |
| 4089 | ADC32434 | 4089 | 34593 | 65097, 95601, 126105, 156609, 187113 | 11105 | AHJ57779 | 11105 | 41609 | 72113, 102617, 133121, 163625, 194129 |
| 4090 | ADC32435 | 4090 | 34594 | 65098, 95602, 126106, 156610, 187114 | 11106 | AHJ57791 | 11106 | 41610 | 72114, 102618, 133122, 163626, 194130 |
| 4091 | ADC34940 | 4091 | 34595 | 65099, 95603, 126107, 156611, 187115 | 11107 | AHJ57815 | 11107 | 41611 | 72115, 102619, 133123, 163627, 194131 |
| 4092 | ADC38987 | 4092 | 34596 | 65100, 95604, 126108, 156612, 187116 | 11108 | AHJ57827 | 11108 | 41612 | 72116, 102620, 133124, 163628, 194132 |
| 4093 | ADC38997 | 4093 | 34597 | 65101, 95605, 126109, 156613, 187117 | 11109 | AHJ57850 | 11109 | 41613 | 72117, 102621, 133125, 163629, 194133 |
| 4094 | ADC39007 | 4094 | 34598 | 65102, 95606, 126110, 156614, 187118 | 11110 | AHJ57862 | 11110 | 41614 | 72118, 102622, 133126, 163630, 194134 |
| 4095 | ADC45604 | 4095 | 34599 | 65103, 95607, 126111, 156615, 187119 | 11111 | AHJ57873 | 11111 | 41615 | 72119, 102623, 133127, 163631, 194135 |
| 4096 | ADC45626 | 4096 | 34600 | 65104, 95608, 126112, 156616, 187120 | 11112 | AHJ57885 | 11112 | 41616 | 72120, 102624, 133128, 163632, 194136 |
| 4097 | ADC45637 | 4097 | 34601 | 65105, 95609, 126113, 156617, 187121 | 11113 | AHJ57897 | 11113 | 41617 | 72121, 102625, 133129, 163633, 194137 |

FIG. 1 continued

| | | | | | | | | | |
|---|---|---|---|---|---|---|---|---|---|
| 4098 | ADC45648 | 4098 | 34602 | 65106, 95610, 126114, 156618, 187122 | 11114 | AHJ57908 | 11114 | 41618 | 72122, 102626, 133130, 163634, 194138 |
| 4099 | ADC45659 | 4099 | 34603 | 65107, 95611, 126115, 156619, 187123 | 11115 | AHJ57920 | 11115 | 41619 | 72123, 102627, 133131, 163635, 194139 |
| 4100 | ADC45670 | 4100 | 34604 | 65108, 95612, 126116, 156620, 187124 | 11116 | AHJ57932 | 11116 | 41620 | 72124, 102628, 133132, 163636, 194140 |
| 4101 | ADC45681 | 4101 | 34605 | 65109, 95613, 126117, 156621, 187125 | 11117 | AHJ57943 | 11117 | 41621 | 72125, 102629, 133133, 163637, 194141 |
| 4102 | ADC45692 | 4102 | 34606 | 65110, 95614, 126118, 156622, 187126 | 11118 | AHJ57954 | 11118 | 41622 | 72126, 102630, 133134, 163638, 194142 |
| 4103 | ADC45703 | 4103 | 34607 | 65111, 95615, 126119, 156623, 187127 | 11119 | AHJ57965 | 11119 | 41623 | 72127, 102631, 133135, 163639, 194143 |
| 4104 | ADC45714 | 4104 | 34608 | 65112, 95616, 126120, 156624, 187128 | 11120 | AHJ57977 | 11120 | 41624 | 72128, 102632, 133136, 163640, 194144 |
| 4105 | ADC45725 | 4105 | 34609 | 65113, 95617, 126121, 156625, 187129 | 11121 | AHJ57989 | 11121 | 41625 | 72129, 102633, 133137, 163641, 194145 |
| 4106 | ADC45736 | 4106 | 34610 | 65114, 95618, 126122, 156626, 187130 | 11122 | AHJ58001 | 11122 | 41626 | 72130, 102634, 133138, 163642, 194146 |
| 4107 | ADC45747 | 4107 | 34611 | 65115, 95619, 126123, 156627, 187131 | 11123 | AHJ58013 | 11123 | 41627 | 72131, 102635, 133139, 163643, 194147 |
| 4108 | ADC45758 | 4108 | 34612 | 65116, 95620, 126124, 156628, 187132 | 11124 | AHJ58025 | 11124 | 41628 | 72132, 102636, 133140, 163644, 194148 |
| 4109 | ADC45780 | 4109 | 34613 | 65117, 95621, 126125, 156629, 187133 | 11125 | AHJ58037 | 11125 | 41629 | 72133, 102637, 133141, 163645, 194149 |
| 4110 | ADC45791 | 4110 | 34614 | 65118, 95622, 126126, 156630, 187134 | 11126 | AHJ58049 | 11126 | 41630 | 72134, 102638, 133142, 163646, 194150 |
| 4111 | ADC45813 | 4111 | 34615 | 65119, 95623, 126127, 156631, 187135 | 11127 | AHJ58061 | 11127 | 41631 | 72135, 102639, 133143, 163647, 194151 |
| 4112 | ADC45824 | 4112 | 34616 | 65120, 95624, 126128, 156632, 187136 | 11128 | AHJ58084 | 11128 | 41632 | 72136, 102640, 133144, 163648, 194152 |
| 4113 | ADC45835 | 4113 | 34617 | 65121, 95625, 126129, 156633, 187137 | 11129 | AHL80708 | 11129 | 41633 | 72137, 102641, 133145, 163649, 194153 |
| 4114 | ADC45846 | 4114 | 34618 | 65122, 95626, 126130, 156634, 187138 | 11130 | AHL80718 | 11130 | 41634 | 72138, 102642, 133146, 163650, 194154 |
| 4115 | ADC53558 | 4115 | 34619 | 65123, 95627, 126131, 156635, 187139 | 11131 | AHL80729 | 11131 | 41635 | 72139, 102643, 133147, 163651, 194155 |

FIG. 1 continued

| | | | | | | | | | |
|---|---|---|---|---|---|---|---|---|---|
| 4116 | ADD14087 | 4116 | 34620 | 65124, 95628, 126132, 156636, 187140 | 11132 | AHL80740 | 11132 | 41636 | 72140, 102644, 133148, 163652, 194156 |
| 4117 | ADD14089 | 4117 | 34621 | 65125, 95629, 126133, 156637, 187141 | 11133 | AHL80751 | 11133 | 41637 | 72141, 102645, 133149, 163653, 194157 |
| 4118 | ADD14093 | 4118 | 34622 | 65126, 95630, 126134, 156638, 187142 | 11134 | AHL80762 | 11134 | 41638 | 72142, 102646, 133150, 163654, 194158 |
| 4119 | ADD14095 | 4119 | 34623 | 65127, 95631, 126135, 156639, 187143 | 11135 | AHL80784 | 11135 | 41639 | 72143, 102647, 133151, 163655, 194159 |
| 4120 | ADD14097 | 4120 | 34624 | 65128, 95632, 126136, 156640, 187144 | 11136 | AHL80795 | 11136 | 41640 | 72144, 102648, 133152, 163656, 194160 |
| 4121 | ADD14099 | 4121 | 34625 | 65129, 95633, 126137, 156641, 187145 | 11137 | AHL80817 | 11137 | 41641 | 72145, 102649, 133153, 163657, 194161 |
| 4122 | ADD14101 | 4122 | 34626 | 65130, 95634, 126138, 156642, 187146 | 11138 | AHL80828 | 11138 | 41642 | 72146, 102650, 133154, 163658, 194162 |
| 4123 | ADD14103 | 4123 | 34627 | 65131, 95635, 126139, 156643, 187147 | 11139 | AHL80839 | 11139 | 41643 | 72147, 102651, 133155, 163659, 194163 |
| 4124 | ADD14111 | 4124 | 34628 | 65132, 95636, 126140, 156644, 187148 | 11140 | AHL80861 | 11140 | 41644 | 72148, 102652, 133156, 163660, 194164 |
| 4125 | ADD14115 | 4125 | 34629 | 65133, 95637, 126141, 156645, 187149 | 11141 | AHL80872 | 11141 | 41645 | 72149, 102653, 133157, 163661, 194165 |
| 4126 | ADD14117 | 4126 | 34630 | 65134, 95638, 126142, 156646, 187150 | 11142 | AHL80883 | 11142 | 41646 | 72150, 102654, 133158, 163662, 194166 |
| 4127 | ADD14119 | 4127 | 34631 | 65135, 95639, 126143, 156647, 187151 | 11143 | AHL80894 | 11143 | 41647 | 72151, 102655, 133159, 163663, 194167 |
| 4128 | ADD14121 | 4128 | 34632 | 65136, 95640, 126144, 156648, 187152 | 11144 | AHL80905 | 11144 | 41648 | 72152, 102656, 133160, 163664, 194168 |
| 4129 | ADD14123 | 4129 | 34633 | 65137, 95641, 126145, 156649, 187153 | 11145 | AHL80916 | 11145 | 41649 | 72153, 102657, 133161, 163665, 194169 |
| 4130 | ADD14127 | 4130 | 34634 | 65138, 95642, 126146, 156650, 187154 | 11146 | AHL80927 | 11146 | 41650 | 72154, 102658, 133162, 163666, 194170 |
| 4131 | ADD14129 | 4131 | 34635 | 65139, 95643, 126147, 156651, 187155 | 11147 | AHL80946 | 11147 | 41651 | 72155, 102659, 133163, 163667, 194171 |
| 4132 | ADD14133 | 4132 | 34636 | 65140, 95644, 126148, 156652, 187156 | 11148 | AHL80958 | 11148 | 41652 | 72156, 102660, 133164, 163668, 194172 |
| 4133 | ADD14135 | 4133 | 34637 | 65141, 95645, 126149, 156653, 187157 | 11149 | AHL81001 | 11149 | 41653 | 72157, 102661, 133165, 163669, 194173 |

FIG. 1 continued

| | | | | | | | | | |
|---|---|---|---|---|---|---|---|---|---|
| 4134 | ADD14137 | 4134 | 34638 | 65142, 95646, 126150, 156654, 187158 | 11150 | AHL81013 | 11150 | 41654 | 72158, 102662, 133166, 163670, 194174 |
| 4135 | ADD14139 | 4135 | 34639 | 65143, 95647, 126151, 156655, 187159 | 11151 | AHL81025 | 11151 | 41655 | 72159, 102663, 133167, 163671, 194175 |
| 4136 | ADD14143 | 4136 | 34640 | 65144, 95648, 126152, 156656, 187160 | 11152 | AHL81037 | 11152 | 41656 | 72160, 102664, 133168, 163672, 194176 |
| 4137 | ADD14145 | 4137 | 34641 | 65145, 95649, 126153, 156657, 187161 | 11153 | AHL81049 | 11153 | 41657 | 72161, 102665, 133169, 163673, 194177 |
| 4138 | ADD14147 | 4138 | 34642 | 65146, 95650, 126154, 156658, 187162 | 11154 | AHL81061 | 11154 | 41658 | 72162, 102666, 133170, 163674, 194178 |
| 4139 | ADD14151 | 4139 | 34643 | 65147, 95651, 126155, 156659, 187163 | 11155 | AHL81072 | 11155 | 41659 | 72163, 102667, 133171, 163675, 194179 |
| 4140 | ADD14153 | 4140 | 34644 | 65148, 95652, 126156, 156660, 187164 | 11156 | AHL81083 | 11156 | 41660 | 72164, 102668, 133172, 163676, 194180 |
| 4141 | ADD14155 | 4141 | 34645 | 65149, 95653, 126157, 156661, 187165 | 11157 | AHL81095 | 11157 | 41661 | 72165, 102669, 133173, 163677, 194181 |
| 4142 | ADD14157 | 4142 | 34646 | 65150, 95654, 126158, 156662, 187166 | 11158 | AHL81118 | 11158 | 41662 | 72166, 102670, 133174, 163678, 194182 |
| 4143 | ADD14162 | 4143 | 34647 | 65151, 95655, 126159, 156663, 187167 | 11159 | AHL81129 | 11159 | 41663 | 72167, 102671, 133175, 163679, 194183 |
| 4144 | ADD14172 | 4144 | 34648 | 65152, 95656, 126160, 156664, 187168 | 11160 | AHL81141 | 11160 | 41664 | 72168, 102672, 133176, 163680, 194184 |
| 4145 | ADD14182 | 4145 | 34649 | 65153, 95657, 126161, 156665, 187169 | 11161 | AHL81153 | 11161 | 41665 | 72169, 102673, 133177, 163681, 194185 |
| 4146 | ADD14192 | 4146 | 34650 | 65154, 95658, 126162, 156666, 187170 | 11162 | AHL81165 | 11162 | 41666 | 72170, 102674, 133178, 163682, 194186 |
| 4147 | ADD14202 | 4147 | 34651 | 65155, 95659, 126163, 156667, 187171 | 11163 | AHL81177 | 11163 | 41667 | 72171, 102675, 133179, 163683, 194187 |
| 4148 | ADD21447 | 4148 | 34652 | 65156, 95660, 126164, 156668, 187172 | 11164 | AHL81189 | 11164 | 41668 | 72172, 102676, 133180, 163684, 194188 |
| 4149 | ADD21457 | 4149 | 34653 | 65157, 95661, 126165, 156669, 187173 | 11165 | AHL81212 | 11165 | 41669 | 72173, 102677, 133181, 163685, 194189 |
| 4150 | ADD21467 | 4150 | 34654 | 65158, 95662, 126166, 156670, 187174 | 11166 | AHL81224 | 11166 | 41670 | 72174, 102678, 133182, 163686, 194190 |
| 4151 | ADD21560 | 4151 | 34655 | 65159, 95663, 126167, 156671, 187175 | 11167 | AHL81235 | 11167 | 41671 | 72175, 102679, 133183, 163687, 194191 |

FIG. 1 continued

| | | | | | | | | | |
|---|---|---|---|---|---|---|---|---|---|
| 4152 | ADD21734 | 4152 | 34656 | 65160, 95664, 126168, 156672, 187176 | 11168 | AHL81247 | 11168 | 41672 | 72176, 102680, 133184, 163688, 194192 |
| 4153 | ADD21744 | 4153 | 34657 | 65161, 95665, 126169, 156673, 187177 | 11169 | AHL81259 | 11169 | 41673 | 72177, 102681, 133185, 163689, 194193 |
| 4154 | ADD21764 | 4154 | 34658 | 65162; 95666, 126170, 156674, 187178 | 11170 | AHL81271 | 11170 | 41674 | 72178, 102682, 133186, 163690, 194194 |
| 4155 | ADD21774 | 4155 | 34659 | 65163, 95667, 126171, 156675, 187179 | 11171 | AHL81283 | 11171 | 41675 | 72179, 102683, 133187, 163691, 194195 |
| 4156 | ADD21784 | 4156 | 34660 | 65164, 95668, 126172, 156676, 187180 | 11172 | AHL81295 | 11172 | 41676 | 72180, 102684, 133188, 163692, 194196 |
| 4157 | ADD21794 | 4157 | 34661 | 65165, 95669, 126173, 156677, 187181 | 11173 | AHL81307 | 11173 | 41677 | 72181, 102685, 133189, 163693, 194197 |
| 4158 | ADD21804 | 4158 | 34662 | 65166, 95670, 126174, 156678, 187182 | 11174 | AHL81329 | 11174 | 41678 | 72182, 102686, 133190, 163694, 194198 |
| 4159 | ADD21814 | 4159 | 34663 | 65167, 95671, 126175, 156679, 187183 | 11175 | AHL81340 | 11175 | 41679 | 72183, 102687, 133191, 163695, 194199 |
| 4160 | ADD21824 | 4160 | 34664 | 65168, 95672, 126176, 156680, 187184 | 11176 | AHL81352 | 11176 | 41680 | 72184, 102688, 133192, 163696, 194200 |
| 4161 | ADD21834 | 4161 | 34665 | 65169, 95673, 126177, 156681, 187185 | 11177 | AHL81364 | 11177 | 41681 | 72185, 102689, 133193, 163697, 194201 |
| 4162 | ADD21844 | 4162 | 34666 | 65170, 95674, 126178, 156682, 187186 | 11178 | AHL81386 | 11178 | 41682 | 72186, 102690, 133194, 163698, 194202 |
| 4163 | ADD21854 | 4163 | 34667 | 65171, 95675, 126179, 156683, 187187 | 11179 | AHL81397 | 11179 | 41683 | 72187, 102691, 133195, 163699, 194203 |
| 4164 | ADD21864 | 4164 | 34668 | 65172, 95676, 126180, 156684, 187188 | 11180 | AHL81409 | 11180 | 41684 | 72188, 102692, 133196, 163700, 194204 |
| 4165 | ADD21884 | 4165 | 34669 | 65173, 95677, 126181, 156685, 187189 | 11181 | AHL81419 | 11181 | 41685 | 72189, 102693, 133197, 163701, 194205 |
| 4166 | ADD21894 | 4166 | 34670 | 65174, 95678, 126182, 156686, 187190 | 11182 | AHL81430 | 11182 | 41686 | 72190, 102694, 133198, 163702, 194206 |
| 4167 | ADD22501 | 4167 | 34671 | 65175, 95679, 126183, 156687, 187191 | 11183 | AHL88951 | 11183 | 41687 | 72191, 102695, 133199, 163703, 194207 |
| 4168 | ADD22511 | 4168 | 34672 | 65176, 95680, 126184, 156688, 187192 | 11184 | AHL89030 | 11184 | 41688 | 72192, 102696, 133200, 163704, 194208 |
| 4169 | ADD22521 | 4169 | 34673 | 65177, 95681, 126185, 156689, 187193 | 11185 | AHL89042 | 11185 | 41689 | 72193, 102697, 133201, 163705, 194209 |

FIG. 1 continued

| | | | | | | | | | |
|---|---|---|---|---|---|---|---|---|---|
| 4170 | ADD22531 | 4170 | 34674 | 65178, 95682, 126186, 156690, 187194 | 11186 | AHL89054 | 11186 | 41690 | 72194, 102698, 133202, 163706, 194210 |
| 4171 | ADD22541 | 4171 | 34675 | 65179, 95683, 126187, 156691, 187195 | 11187 | AHL89066 | 11187 | 41691 | 72195, 102699, 133203, 163707, 194211 |
| 4172 | ADD22554 | 4172 | 34676 | 65180, 95684, 126188, 156692, 187196 | 11188 | AHL89078 | 11188 | 41692 | 72196, 102700, 133204, 163708, 194212 |
| 4173 | ADD22564 | 4173 | 34677 | 65181, 95685, 126189, 156693, 187197 | 11189 | AHL89090 | 11189 | 41693 | 72197, 102701, 133205, 163709, 194213 |
| 4174 | ADD22574 | 4174 | 34678 | 65182, 95686, 126190, 156694, 187198 | 11190 | AHL89102 | 11190 | 41694 | 72198, 102702, 133206, 163710, 194214 |
| 4175 | ADD22584 | 4175 | 34679 | 65183, 95687, 126191, 156695, 187199 | 11191 | AHL89114 | 11191 | 41695 | 72199, 102703, 133207, 163711, 194215 |
| 4176 | ADD22594 | 4176 | 34680 | 65184, 95688, 126192, 156696, 187200 | 11192 | AHL89126 | 11192 | 41696 | 72200, 102704, 133208, 163712, 194216 |
| 4177 | ADD22604 | 4177 | 34681 | 65185, 95689, 126193, 156697, 187201 | 11193 | AHL89138 | 11193 | 41697 | 72201, 102705, 133209, 163713, 194217 |
| 4178 | ADD22614 | 4178 | 34682 | 65186, 95690, 126194, 156698, 187202 | 11194 | AHL89150 | 11194 | 41698 | 72202, 102706, 133210, 163714, 194218 |
| 4179 | ADD22624 | 4179 | 34683 | 65187, 95691, 126195, 156699, 187203 | 11195 | AHL89162 | 11195 | 41699 | 72203, 102707, 133211, 163715, 194219 |
| 4180 | ADD22634 | 4180 | 34684 | 65188, 95692, 126196, 156700, 187204 | 11196 | AHL89174 | 11196 | 41700 | 72204, 102708, 133212, 163716, 194220 |
| 4181 | ADD22645 | 4181 | 34685 | 65189, 95693, 126197, 156701, 187205 | 11197 | AHL89210 | 11197 | 41701 | 72205, 102709, 133213, 163717, 194221 |
| 4182 | ADD22665 | 4182 | 34686 | 65190, 95694, 126198, 156702, 187206 | 11198 | AHL89222 | 11198 | 41702 | 72206, 102710, 133214, 163718, 194222 |
| 4183 | ADD22675 | 4183 | 34687 | 65191, 95695, 126199, 156703, 187207 | 11199 | AHL89234 | 11199 | 41703 | 72207, 102711, 133215, 163719, 194223 |
| 4184 | ADD22685 | 4184 | 34688 | 65192, 95696, 126200, 156704, 187208 | 11200 | AHL89246 | 11200 | 41704 | 72208, 102712, 133216, 163720, 194224 |
| 4185 | ADD22695 | 4185 | 34689 | 65193, 95697, 126201, 156705, 187209 | 11201 | AHL89258 | 11201 | 41705 | 72209, 102713, 133217, 163721, 194225 |
| 4186 | ADD22722 | 4186 | 34690 | 65194, 95698, 126202, 156706, 187210 | 11202 | AHL89270 | 11202 | 41706 | 72210, 102714, 133218, 163722, 194226 |
| 4187 | ADD22732 | 4187 | 34691 | 65195, 95699, 126203, 156707, 187211 | 11203 | AHL89282 | 11203 | 41707 | 72211, 102715, 133219, 163723, 194227 |

FIG. 1 continued

| | | | | | | | | | |
|---|---|---|---|---|---|---|---|---|---|
| 4188 | ADD22742 | 4188 | 34692 | 65196, 95700, 126204, 156708, 187212 | 11204 | AHL89294 | 11204 | 41708 | 72212, 102716, 133220, 163724, 194228 |
| 4189 | ADD22752 | 4189 | 34693 | 65197, 95701, 126205, 156709, 187213 | 11205 | AHL89306 | 11205 | 41709 | 72213, 102717, 133221, 163725, 194229 |
| 4190 | ADD22762 | 4190 | 34694 | 65198, 95702, 126206, 156710, 187214 | 11206 | AHL89318 | 11206 | 41710 | 72214, 102718, 133222, 163726, 194230 |
| 4191 | ADD22772 | 4191 | 34695 | 65199, 95703, 126207, 156711, 187215 | 11207 | AHL89330 | 11207 | 41711 | 72215, 102719, 133223, 163727, 194231 |
| 4192 | ADD22782 | 4192 | 34696 | 65200, 95704, 126208, 156712, 187216 | 11208 | AHL89342 | 11208 | 41712 | 72216, 102720, 133224, 163728, 194232 |
| 4193 | ADD22792 | 4193 | 34697 | 65201, 95705, 126209, 156713, 187217 | 11209 | AHL89354 | 11209 | 41713 | 72217, 102721, 133225, 163729, 194233 |
| 4194 | ADD22802 | 4194 | 34698 | 65202, 95706, 126210, 156714, 187218 | 11210 | AHL89366 | 11210 | 41714 | 72218, 102722, 133226, 163730, 194234 |
| 4195 | ADD22812 | 4195 | 34699 | 65203, 95707, 126211, 156715, 187219 | 11211 | AHL89378 | 11211 | 41715 | 72219, 102723, 133227, 163731, 194235 |
| 4196 | ADD22822 | 4196 | 34700 | 65204, 95708, 126212, 156716, 187220 | 11212 | AHL89390 | 11212 | 41716 | 72220, 102724, 133228, 163732, 194236 |
| 4197 | ADD22832 | 4197 | 34701 | 65205, 95709, 126213, 156717, 187221 | 11213 | AHL89402 | 11213 | 41717 | 72221, 102725, 133229, 163733, 194237 |
| 4198 | ADD22842 | 4198 | 34702 | 65206, 95710, 126214, 156718, 187222 | 11214 | AHL89414 | 11214 | 41718 | 72222, 102726, 133230, 163734, 194238 |
| 4199 | ADD22852 | 4199 | 34703 | 65207, 95711, 126215, 156719, 187223 | 11215 | AHL89426 | 11215 | 41719 | 72223, 102727, 133231, 163735, 194239 |
| 4200 | ADD22941 | 4200 | 34704 | 65208, 95712, 126216, 156720, 187224 | 11216 | AHL89438 | 11216 | 41720 | 72224, 102728, 133232, 163736, 194240 |
| 4201 | ADD22951 | 4201 | 34705 | 65209, 95713, 126217, 156721, 187225 | 11217 | AHL89450 | 11217 | 41721 | 72225, 102729, 133233, 163737, 194241 |
| 4202 | ADD22961 | 4202 | 34706 | 65210, 95714, 126218, 156722, 187226 | 11218 | AHL89462 | 11218 | 41722 | 72226, 102730, 133234, 163738, 194242 |
| 4203 | ADD22971 | 4203 | 34707 | 65211, 95715, 126219, 156723, 187227 | 11219 | AHL89474 | 11219 | 41723 | 72227, 102731, 133235, 163739, 194243 |
| 4204 | ADD23072 | 4204 | 34708 | 65212, 95716, 126220, 156724, 187228 | 11220 | AHL89486 | 11220 | 41724 | 72228, 102732, 133236, 163740, 194244 |
| 4205 | ADD23082 | 4205 | 34709 | 65213, 95717, 126221, 156725, 187229 | 11221 | AHL89498 | 11221 | 41725 | 72229, 102733, 133237, 163741, 194245 |

FIG. 1 continued

| | | | | | | | | | |
|---|---|---|---|---|---|---|---|---|---|
| 4206 | ADD23102 | 4206 | 34710 | 65214, 95718, 126222, 156726, 187230 | 11222 | AHL89510 | 11222 | 41726 | 72230, 102734, 133238, 163742, 194246 |
| 4207 | ADD23112 | 4207 | 34711 | 65215, 95719, 126223, 156727, 187231 | 11223 | AHL89522 | 11223 | 41727 | 72231, 102735, 133239, 163743, 194247 |
| 4208 | ADD23122 | 4208 | 34712 | 65216, 95720, 126224, 156728, 187232 | 11224 | AHL89534 | 11224 | 41728 | 72232, 102736, 133240, 163744, 194248 |
| 4209 | ADD23132 | 4209 | 34713 | 65217, 95721, 126225, 156729, 187233 | 11225 | AHL89546 | 11225 | 41729 | 72233, 102737, 133241, 163745, 194249 |
| 4210 | ADD23142 | 4210 | 34714 | 65218, 95722, 126226, 156730, 187234 | 11226 | AHL89558 | 11226 | 41730 | 72234, 102738, 133242, 163746, 194250 |
| 4211 | ADD23162 | 4211 | 34715 | 65219, 95723, 126227, 156731, 187235 | 11227 | AHL89570 | 11227 | 41731 | 72235, 102739, 133243, 163747, 194251 |
| 4212 | ADD23172 | 4212 | 34716 | 65220, 95724, 126228, 156732, 187236 | 11228 | AHL89582 | 11228 | 41732 | 72236, 102740, 133244, 163748, 194252 |
| 4213 | ADD23182 | 4213 | 34717 | 65221, 95725, 126229, 156733, 187237 | 11229 | AHL89594 | 11229 | 41733 | 72237, 102741, 133245, 163749, 194253 |
| 4214 | ADD23192 | 4214 | 34718 | 65222, 95726, 126230, 156734, 187238 | 11230 | AHL89606 | 11230 | 41734 | 72238, 102742, 133246, 163750, 194254 |
| 4215 | ADD23202 | 4215 | 34719 | 65223, 95727, 126231, 156735, 187239 | 11231 | AHL89618 | 11231 | 41735 | 72239, 102743, 133247, 163751, 194255 |
| 4216 | ADD23220 | 4216 | 34720 | 65224, 95728, 126232, 156736, 187240 | 11232 | AHL89630 | 11232 | 41736 | 72240, 102744, 133248, 163752, 194256 |
| 4217 | ADD23230 | 4217 | 34721 | 65225, 95729, 126233, 156737, 187241 | 11233 | AHL89642 | 11233 | 41737 | 72241, 102745, 133249, 163753, 194257 |
| 4218 | ADD23240 | 4218 | 34722 | 65226, 95730, 126234, 156738, 187242 | 11234 | AHL89654 | 11234 | 41738 | 72242, 102746, 133250, 163754, 194258 |
| 4219 | ADD23260 | 4219 | 34723 | 65227, 95731, 126235, 156739, 187243 | 11235 | AHL89666 | 11235 | 41739 | 72243, 102747, 133251, 163755, 194259 |
| 4220 | ADD23280 | 4220 | 34724 | 65228, 95732, 126236, 156740, 187244 | 11236 | AHL89678 | 11236 | 41740 | 72244, 102748, 133252, 163756, 194260 |
| 4221 | ADD23290 | 4221 | 34725 | 65229, 95733, 126237, 156741, 187245 | 11237 | AHL89690 | 11237 | 41741 | 72245, 102749, 133253, 163757, 194261 |
| 4222 | ADD23300 | 4222 | 34726 | 65230, 95734, 126238, 156742, 187246 | 11238 | AHL89702 | 11238 | 41742 | 72246, 102750, 133254, 163758, 194262 |
| 4223 | ADD23310 | 4223 | 34727 | 65231, 95735, 126239, 156743, 187247 | 11239 | AHL89714 | 11239 | 41743 | 72247, 102751, 133255, 163759, 194263 |

FIG. 1 continued

| | | | | | | | | | |
|---|---|---|---|---|---|---|---|---|---|
| 4224 | ADD23320 | 4224 | 34728 | 65232, 95736, 126240, 156744, 187248 | 11240 | AHL89726 | 11240 | 41744 | 72248, 102752, 133256, 163760, 194264 |
| 4225 | ADD23330 | 4225 | 34729 | 65233, 95737, 126241, 156745, 187249 | 11241 | AHL89750 | 11241 | 41745 | 72249, 102753, 133257, 163761, 194265 |
| 4226 | ADD23355 | 4226 | 34730 | 65234, 95738, 126242, 156746, 187250 | 11242 | AHL89762 | 11242 | 41746 | 72250, 102754, 133258, 163762, 194266 |
| 4227 | ADD23375 | 4227 | 34731 | 65235, 95739, 126243, 156747, 187251 | 11243 | AHL89774 | 11243 | 41747 | 72251, 102755, 133259, 163763, 194267 |
| 4228 | ADD23385 | 4228 | 34732 | 65236, 95740, 126244, 156748, 187252 | 11244 | AHL89786 | 11244 | 41748 | 72252, 102756, 133260, 163764, 194268 |
| 4229 | ADD23405 | 4229 | 34733 | 65237, 95741, 126245, 156749, 187253 | 11245 | AHL89798 | 11245 | 41749 | 72253, 102757, 133261, 163765, 194269 |
| 4230 | ADD23415 | 4230 | 34734 | 65238, 95742, 126246, 156750, 187254 | 11246 | AHL89810 | 11246 | 41750 | 72254, 102758, 133262, 163766, 194270 |
| 4231 | ADD23435 | 4231 | 34735 | 65239, 95743, 126247, 156751, 187255 | 11247 | AHL89822 | 11247 | 41751 | 72255, 102759, 133263, 163767, 194271 |
| 4232 | ADD23465 | 4232 | 34736 | 65240, 95744, 126248, 156752, 187256 | 11248 | AHL89834 | 11248 | 41752 | 72256, 102760, 133264, 163768, 194272 |
| 4233 | ADD23475 | 4233 | 34737 | 65241, 95745, 126249, 156753, 187257 | 11249 | AHL89846 | 11249 | 41753 | 72257, 102761, 133265, 163769, 194273 |
| 4234 | ADD23485 | 4234 | 34738 | 65242, 95746, 126250, 156754, 187258 | 11250 | AHL89858 | 11250 | 41754 | 72258, 102762, 133266, 163770, 194274 |
| 4235 | ADD23495 | 4235 | 34739 | 65243, 95747, 126251, 156755, 187259 | 11251 | AHL89870 | 11251 | 41755 | 72259, 102763, 133267, 163771, 194275 |
| 4236 | ADD23505 | 4236 | 34740 | 65244, 95748, 126252, 156756, 187260 | 11252 | AHL89882 | 11252 | 41756 | 72260, 102764, 133268, 163772, 194276 |
| 4237 | ADD23515 | 4237 | 34741 | 65245, 95749, 126253, 156757, 187261 | 11253 | AHL89894 | 11253 | 41757 | 72261, 102765, 133269, 163773, 194277 |
| 4238 | ADD23994 | 4238 | 34742 | 65246, 95750, 126254, 156758, 187262 | 11254 | AHL89906 | 11254 | 41758 | 72262, 102766, 133270, 163774, 194278 |
| 4239 | ADD24004 | 4239 | 34743 | 65247, 95751, 126255, 156759, 187263 | 11255 | AHL89918 | 11255 | 41759 | 72263, 102767, 133271, 163775, 194279 |
| 4240 | ADD24014 | 4240 | 34744 | 65248, 95752, 126256, 156760, 187264 | 11256 | AHL89930 | 11256 | 41760 | 72264, 102768, 133272, 163776, 194280 |
| 4241 | ADD52537 | 4241 | 34745 | 65249, 95753, 126257, 156761, 187265 | 11257 | AHL89942 | 11257 | 41761 | 72265, 102769, 133273, 163777, 194281 |

FIG. 1 continued

| | | | | | | | | | |
|---|---|---|---|---|---|---|---|---|---|
| 4242 | ADD64203 | 4242 | 34746 | 65250, 95754, 126258, 156762, 187266 | 11258 | AHL89954 | 11258 | 41762 | 72266, 102770, 133274, 163778, 194282 |
| 4243 | ADD64204 | 4243 | 34747 | 65251, 95755, 126259, 156763, 187267 | 11259 | AHL89966 | 11259 | 41763 | 72267, 102771, 133275, 163779, 194283 |
| 4244 | ADD64205 | 4244 | 34748 | 65252, 95756, 126260, 156764, 187268 | 11260 | AHL89978 | 11260 | 41764 | 72268, 102772, 133276, 163780, 194284 |
| 4245 | ADD64206 | 4245 | 34749 | 65253, 95757, 126261, 156765, 187269 | 11261 | AHL89990 | 11261 | 41765 | 72269, 102773, 133277, 163781, 194285 |
| 4246 | ADD64207 | 4246 | 34750 | 65254, 95758, 126262, 156766, 187270 | 11262 | AHL90002 | 11262 | 41766 | 72270, 102774, 133278, 163782, 194286 |
| 4247 | ADD64208 | 4247 | 34751 | 65255, 95759, 126263, 156767, 187271 | 11263 | AHL90014 | 11263 | 41767 | 72271, 102775, 133279, 163783, 194287 |
| 4248 | ADD64209 | 4248 | 34752 | 65256, 95760, 126264, 156768, 187272 | 11264 | AHL90026 | 11264 | 41768 | 72272, 102776, 133280, 163784, 194288 |
| 4249 | ADD64210 | 4249 | 34753 | 65257, 95761, 126265, 156769, 187273 | 11265 | AHL90050 | 11265 | 41769 | 72273, 102777, 133281, 163785, 194289 |
| 4250 | ADD64211 | 4250 | 34754 | 65258, 95762, 126266, 156770, 187274 | 11266 | AHL90062 | 11266 | 41770 | 72274, 102778, 133282, 163786, 194290 |
| 4251 | ADD64212 | 4251 | 34755 | 65259, 95763, 126267, 156771, 187275 | 11267 | AHL90074 | 11267 | 41771 | 72275, 102779, 133283, 163787, 194291 |
| 4252 | ADD64213 | 4252 | 34756 | 65260, 95764, 126268, 156772, 187276 | 11268 | AHL90086 | 11268 | 41772 | 72276, 102780, 133284, 163788, 194292 |
| 4253 | ADD64214 | 4253 | 34757 | 65261, 95765, 126269, 156773, 187277 | 11269 | AHL90098 | 11269 | 41773 | 72277, 102781, 133285, 163789, 194293 |
| 4254 | ADD64215 | 4254 | 34758 | 65262, 95766, 126270, 156774, 187278 | 11270 | AHL90110 | 11270 | 41774 | 72278, 102782, 133286, 163790, 194294 |
| 4255 | ADD64216 | 4255 | 34759 | 65263, 95767, 126271, 156775, 187279 | 11271 | AHL90122 | 11271 | 41775 | 72279, 102783, 133287, 163791, 194295 |
| 4256 | ADD64217 | 4256 | 34760 | 65264, 95768, 126272, 156776, 187280 | 11272 | AHL90133 | 11272 | 41776 | 72280, 102784, 133288, 163792, 194296 |
| 4257 | ADD74350 | 4257 | 34761 | 65265, 95769, 126273, 156777, 187281 | 11273 | AHL90145 | 11273 | 41777 | 72281, 102785, 133289, 163793, 194297 |
| 4258 | ADD74360 | 4258 | 34762 | 65266, 95770, 126274, 156778, 187282 | 11274 | AHL90157 | 11274 | 41778 | 72282, 102786, 133290, 163794, 194298 |
| 4259 | ADD74370 | 4259 | 34763 | 65267, 95771, 126275, 156779, 187283 | 11275 | AHL90169 | 11275 | 41779 | 72283, 102787, 133291, 163795, 194299 |

FIG. 1 continued

| | | | | | | | | | |
|---|---|---|---|---|---|---|---|---|---|
| 4260 | ADD74398 | 4260 | 34764 | 65268, 95772, 126276, 156780, 187284 | 11276 | AHL90181 | 11276 | 41780 | 72284, 102788, 133292, 163796, 194300 |
| 4261 | ADD74428 | 4261 | 34765 | 65269, 95773, 126277, 156781, 187285 | 11277 | AHL90217 | 11277 | 41781 | 72285, 102789, 133293, 163797, 194301 |
| 4262 | ADD74438 | 4262 | 34766 | 65270, 95774, 126278, 156782, 187286 | 11278 | AHL90229 | 11278 | 41782 | 72286, 102790, 133294, 163798, 194302 |
| 4263 | ADD74448 | 4263 | 34767 | 65271, 95775, 126279, 156783, 187287 | 11279 | AHL90241 | 11279 | 41783 | 72287, 102791, 133295, 163799, 194303 |
| 4264 | ADD74458 | 4264 | 34768 | 65272, 95776, 126280, 156784, 187288 | 11280 | AHL90253 | 11280 | 41784 | 72288, 102792, 133296, 163800, 194304 |
| 4265 | ADD74468 | 4265 | 34769 | 65273, 95777, 126281, 156785, 187289 | 11281 | AHL90265 | 11281 | 41785 | 72289, 102793, 133297, 163801, 194305 |
| 4266 | ADD74488 | 4266 | 34770 | 65274, 95778, 126282, 156786, 187290 | 11282 | AHL90277 | 11282 | 41786 | 72290, 102794, 133298, 163802, 194306 |
| 4267 | ADD74498 | 4267 | 34771 | 65275, 95779, 126283, 156787, 187291 | 11283 | AHL90289 | 11283 | 41787 | 72291, 102795, 133299, 163803, 194307 |
| 4268 | ADD74508 | 4268 | 34772 | 65276, 95780, 126284, 156788, 187292 | 11284 | AHL90301 | 11284 | 41788 | 72292, 102796, 133300, 163804, 194308 |
| 4269 | ADD74518 | 4269 | 34773 | 65277, 95781, 126285, 156789, 187293 | 11285 | AHL90325 | 11285 | 41789 | 72293, 102797, 133301, 163805, 194309 |
| 4270 | ADD74528 | 4270 | 34774 | 65278, 95782, 126286, 156790, 187294 | 11286 | AHL90337 | 11286 | 41790 | 72294, 102798, 133302, 163806, 194310 |
| 4271 | ADD74538 | 4271 | 34775 | 65279, 95783, 126287, 156791, 187295 | 11287 | AHL90349 | 11287 | 41791 | 72295, 102799, 133303, 163807, 194311 |
| 4272 | ADD74548 | 4272 | 34776 | 65280, 95784, 126288, 156792, 187296 | 11288 | AHL90361 | 11288 | 41792 | 72296, 102800, 133304, 163808, 194312 |
| 4273 | ADD74558 | 4273 | 34777 | 65281, 95785, 126289, 156793, 187297 | 11289 | AHL90373 | 11289 | 41793 | 72297, 102801, 133305, 163809, 194313 |
| 4274 | ADD74568 | 4274 | 34778 | 65282, 95786, 126290, 156794, 187298 | 11290 | AHL90385 | 11290 | 41794 | 72298, 102802, 133306, 163810, 194314 |
| 4275 | ADD74578 | 4275 | 34779 | 65283, 95787, 126291, 156795, 187299 | 11291 | AHL90397 | 11291 | 41795 | 72299, 102803, 133307, 163811, 194315 |
| 4276 | ADD74588 | 4276 | 34780 | 65284, 95788, 126292, 156796, 187300 | 11292 | AHL90410 | 11292 | 41796 | 72300, 102804, 133308, 163812, 194316 |
| 4277 | ADD74598 | 4277 | 34781 | 65285, 95789, 126293, 156797, 187301 | 11293 | AHL90422 | 11293 | 41797 | 72301, 102805, 133309, 163813, 194317 |

FIG. 1 continued

| | | | | | | | | | |
|---|---|---|---|---|---|---|---|---|---|
| 4278 | ADD74608 | 4278 | 34782 | 65286, 95790, 126294, 156798, 187302 | 11294 | AHL90434 | 11294 | 41798 | 72302, 102806, 133310, 163814, 194318 |
| 4279 | ADD74618 | 4279 | 34783 | 65287, 95791, 126295, 156799, 187303 | 11295 | AHL90446 | 11295 | 41799 | 72303, 102807, 133311, 163815, 194319 |
| 4280 | ADD74628 | 4280 | 34784 | 65288, 95792, 126296, 156800, 187304 | 11296 | AHL90458 | 11296 | 41800 | 72304, 102808, 133312, 163816, 194320 |
| 4281 | ADD74648 | 4281 | 34785 | 65289, 95793, 126297, 156801, 187305 | 11297 | AHL90470 | 11297 | 41801 | 72305, 102809, 133313, 163817, 194321 |
| 4282 | ADD74658 | 4282 | 34786 | 65290, 95794, 126298, 156802, 187306 | 11298 | AHL90482 | 11298 | 41802 | 72306, 102810, 133314, 163818, 194322 |
| 4283 | ADD74668 | 4283 | 34787 | 65291, 95795, 126299, 156803, 187307 | 11299 | AHL90494 | 11299 | 41803 | 72307, 102811, 133315, 163819, 194323 |
| 4284 | ADD74678 | 4284 | 34788 | 65292, 95796, 126300, 156804, 187308 | 11300 | AHL90506 | 11300 | 41804 | 72308, 102812, 133316, 163820, 194324 |
| 4285 | ADD74688 | 4285 | 34789 | 65293, 95797, 126301, 156805, 187309 | 11301 | AHL90518 | 11301 | 41805 | 72309, 102813, 133317, 163821, 194325 |
| 4286 | ADD74698 | 4286 | 34790 | 65294, 95798, 126302, 156806, 187310 | 11302 | AHL90530 | 11302 | 41806 | 72310, 102814, 133318, 163822, 194326 |
| 4287 | ADD74708 | 4287 | 34791 | 65295, 95799, 126303, 156807, 187311 | 11303 | AHL90542 | 11303 | 41807 | 72311, 102815, 133319, 163823, 194327 |
| 4288 | ADD74728 | 4288 | 34792 | 65296, 95800, 126304, 156808, 187312 | 11304 | AHL90554 | 11304 | 41808 | 72312, 102816, 133320, 163824, 194328 |
| 4289 | ADD74738 | 4289 | 34793 | 65297, 95801, 126305, 156809, 187313 | 11305 | AHL90566 | 11305 | 41809 | 72313, 102817, 133321, 163825, 194329 |
| 4290 | ADD74748 | 4290 | 34794 | 65298, 95802, 126306, 156810, 187314 | 11306 | AHL90578 | 11306 | 41810 | 72314, 102818, 133322, 163826, 194330 |
| 4291 | ADD74758 | 4291 | 34795 | 65299, 95803, 126307, 156811, 187315 | 11307 | AHL90590 | 11307 | 41811 | 72315, 102819, 133323, 163827, 194331 |
| 4292 | ADD74768 | 4292 | 34796 | 65300, 95804, 126308, 156812, 187316 | 11308 | AHL90602 | 11308 | 41812 | 72316, 102820, 133324, 163828, 194332 |
| 4293 | ADD74778 | 4293 | 34797 | 65301, 95805, 126309, 156813, 187317 | 11309 | AHL90614 | 11309 | 41813 | 72317, 102821, 133325, 163829, 194333 |
| 4294 | ADD74788 | 4294 | 34798 | 65302, 95806, 126310, 156814, 187318 | 11310 | AHL90638 | 11310 | 41814 | 72318, 102822, 133326, 163830, 194334 |
| 4295 | ADD74798 | 4295 | 34799 | 65303, 95807, 126311, 156815, 187319 | 11311 | AHL90650 | 11311 | 41815 | 72319, 102823, 133327, 163831, 194335 |

FIG. 1 continued

| | | | | | | | | | |
|---|---|---|---|---|---|---|---|---|---|
| 4296 | ADD74808 | 4296 | 34800 | 65304, 95808, 126312, 156816, 187320 | 11312 | AHL90662 | 11312 | 41816 | 72320, 102824, 133328, 163832, 194336 |
| 4297 | ADD74818 | 4297 | 34801 | 65305, 95809, 126313, 156817, 187321 | 11313 | AHL90674 | 11313 | 41817 | 72321, 102825, 133329, 163833, 194337 |
| 4298 | ADD74838 | 4298 | 34802 | 65306, 95810, 126314, 156818, 187322 | 11314 | AHL90686 | 11314 | 41818 | 72322, 102826, 133330, 163834, 194338 |
| 4299 | ADD74848 | 4299 | 34803 | 65307, 95811, 126315, 156819, 187323 | 11315 | AHL90698 | 11315 | 41819 | 72323, 102827, 133331, 163835, 194339 |
| 4300 | ADD74858 | 4300 | 34804 | 65308, 95812, 126316, 156820, 187324 | 11316 | AHL90710 | 11316 | 41820 | 72324, 102828, 133332, 163836, 194340 |
| 4301 | ADD74868 | 4301 | 34805 | 65309, 95813, 126317, 156821, 187325 | 11317 | AHL90722 | 11317 | 41821 | 72325, 102829, 133333, 163837, 194341 |
| 4302 | ADD74878 | 4302 | 34806 | 65310, 95814, 126318, 156822, 187326 | 11318 | AHL90746 | 11318 | 41822 | 72326, 102830, 133334, 163838, 194342 |
| 4303 | ADD74888 | 4303 | 34807 | 65311, 95815, 126319, 156823, 187327 | 11319 | AHL90758 | 11319 | 41823 | 72327, 102831, 133335, 163839, 194343 |
| 4304 | ADD74898 | 4304 | 34808 | 65312, 95816, 126320, 156824, 187328 | 11320 | AHL90770 | 11320 | 41824 | 72328, 102832, 133336, 163840, 194344 |
| 4305 | ADD74908 | 4305 | 34809 | 65313, 95817, 126321, 156825, 187329 | 11321 | AHL90782 | 11321 | 41825 | 72329, 102833, 133337, 163841, 194345 |
| 4306 | ADD74918 | 4306 | 34810 | 65314, 95818, 126322, 156826, 187330 | 11322 | AHL90794 | 11322 | 41826 | 72330, 102834, 133338, 163842, 194346 |
| 4307 | ADD74928 | 4307 | 34811 | 65315, 95819, 126323, 156827, 187331 | 11323 | AHL90806 | 11323 | 41827 | 72331, 102835, 133339, 163843, 194347 |
| 4308 | ADD74938 | 4308 | 34812 | 65316, 95820, 126324, 156828, 187332 | 11324 | AHL90818 | 11324 | 41828 | 72332, 102836, 133340, 163844, 194348 |
| 4309 | ADD74958 | 4309 | 34813 | 65317, 95821, 126325, 156829, 187333 | 11325 | AHL90830 | 11325 | 41829 | 72333, 102837, 133341, 163845, 194349 |
| 4310 | ADD74968 | 4310 | 34814 | 65318, 95822, 126326, 156830, 187334 | 11326 | AHL90842 | 11326 | 41830 | 72334, 102838, 133342, 163846, 194350 |
| 4311 | ADD74998 | 4311 | 34815 | 65319, 95823, 126327, 156831, 187335 | 11327 | AHL90854 | 11327 | 41831 | 72335, 102839, 133343, 163847, 194351 |
| 4312 | ADD75008 | 4312 | 34816 | 65320, 95824, 126328, 156832, 187336 | 11328 | AHL90866 | 11328 | 41832 | 72336, 102840, 133344, 163848, 194352 |
| 4313 | ADD75018 | 4313 | 34817 | 65321, 95825, 126329, 156833, 187337 | 11329 | AHL90878 | 11329 | 41833 | 72337, 102841, 133345, 163849, 194353 |

FIG. 1 continued

| | | | | | | | | | |
|---|---|---|---|---|---|---|---|---|---|
| 4314 | ADD75028 | 4314 | 34818 | 65322, 95826, 126330, 156834, 187338 | 11330 | AHL90890 | 11330 | 41834 | 72338, 102842, 133346, 163850, 194354 |
| 4315 | ADD75058 | 4315 | 34819 | 65323, 95827, 126331, 156835, 187339 | 11331 | AHL90902 | 11331 | 41835 | 72339, 102843, 133347, 163851, 194355 |
| 4316 | ADD75088 | 4316 | 34820 | 65324, 95828, 126332, 156836, 187340 | 11332 | AHL90914 | 11332 | 41836 | 72340, 102844, 133348, 163852, 194356 |
| 4317 | ADD75098 | 4317 | 34821 | 65325, 95829, 126333, 156837, 187341 | 11333 | AHL90938 | 11333 | 41837 | 72341, 102845, 133349, 163853, 194357 |
| 4318 | ADD75108 | 4318 | 34822 | 65326, 95830, 126334, 156838, 187342 | 11334 | AHL90950 | 11334 | 41838 | 72342, 102846, 133350, 163854, 194358 |
| 4319 | ADD75118 | 4319 | 34823 | 65327, 95831, 126335, 156839, 187343 | 11335 | AHL90962 | 11335 | 41839 | 72343, 102847, 133351, 163855, 194359 |
| 4320 | ADD75128 | 4320 | 34824 | 65328, 95832, 126336, 156840, 187344 | 11336 | AHL90974 | 11336 | 41840 | 72344, 102848, 133352, 163856, 194360 |
| 4321 | ADD75138 | 4321 | 34825 | 65329, 95833, 126337, 156841, 187345 | 11337 | AHL90986 | 11337 | 41841 | 72345, 102849, 133353, 163857, 194361 |
| 4322 | ADD75148 | 4322 | 34826 | 65330, 95834, 126338, 156842, 187346 | 11338 | AHL91010 | 11338 | 41842 | 72346, 102850, 133354, 163858, 194362 |
| 4323 | ADD75158 | 4323 | 34827 | 65331, 95835, 126339, 156843, 187347 | 11339 | AHL91022 | 11339 | 41843 | 72347, 102851, 133355, 163859, 194363 |
| 4324 | ADD84494 | 4324 | 34828 | 65332, 95836, 126340, 156844, 187348 | 11340 | AHL91034 | 11340 | 41844 | 72348, 102852, 133356, 163860, 194364 |
| 4325 | ADD84495 | 4325 | 34829 | 65333, 95837, 126341, 156845, 187349 | 11341 | AHL91046 | 11341 | 41845 | 72349, 102853, 133357, 163861, 194365 |
| 4326 | ADD84496 | 4326 | 34830 | 65334, 95838, 126342, 156846, 187350 | 11342 | AHL91058 | 11342 | 41846 | 72350, 102854, 133358, 163862, 194366 |
| 4327 | ADD84497 | 4327 | 34831 | 65335, 95839, 126343, 156847, 187351 | 11343 | AHL91070 | 11343 | 41847 | 72351, 102855, 133359, 163863, 194367 |
| 4328 | ADD84498 | 4328 | 34832 | 65336, 95840, 126344, 156848, 187352 | 11344 | AHL91082 | 11344 | 41848 | 72352, 102856, 133360, 163864, 194368 |
| 4329 | ADD84499 | 4329 | 34833 | 65337, 95841, 126345, 156849, 187353 | 11345 | AHL91094 | 11345 | 41849 | 72353, 102857, 133361, 163865, 194369 |
| 4330 | ADD92535 | 4330 | 34834 | 65338, 95842, 126346, 156850, 187354 | 11346 | AHL91106 | 11346 | 41850 | 72354, 102858, 133362, 163866, 194370 |
| 4331 | ADD96766 | 4331 | 34835 | 65339, 95843, 126347, 156851, 187355 | 11347 | AHL91118 | 11347 | 41851 | 72355, 102859, 133363, 163867, 194371 |

FIG. 1 continued

| | | | | | | | | | |
|---|---|---|---|---|---|---|---|---|---|
| 4332 | ADD96776 | 4332 | 34836 | 65340, 95844, 126348, 156852, 187356 | 11348 | AHL91130 | 11348 | 41852 | 72356, 102860, 133364, 163868, 194372 |
| 4333 | ADD96786 | 4333 | 34837 | 65341, 95845, 126349, 156853, 187357 | 11349 | AHL91142 | 11349 | 41853 | 72357, 102861, 133365, 163869, 194373 |
| 4334 | ADD96796 | 4334 | 34838 | 65342, 95846, 126350, 156854, 187358 | 11350 | AHL91154 | 11350 | 41854 | 72358, 102862, 133366, 163870, 194374 |
| 4335 | ADD96806 | 4335 | 34839 | 65343, 95847, 126351, 156855, 187359 | 11351 | AHL91166 | 11351 | 41855 | 72359, 102863, 133367, 163871, 194375 |
| 4336 | ADD96816 | 4336 | 34840 | 65344, 95848, 126352, 156856, 187360 | 11352 | AHL94984 | 11352 | 41856 | 72360, 102864, 133368, 163872, 194376 |
| 4337 | ADD96826 | 4337 | 34841 | 65345, 95849, 126353, 156857, 187361 | 11353 | AHL94996 | 11353 | 41857 | 72361, 102865, 133369, 163873, 194377 |
| 4338 | ADD96836 | 4338 | 34842 | 65346, 95850, 126354, 156858, 187362 | 11354 | AHL95008 | 11354 | 41858 | 72362, 102866, 133370, 163874, 194378 |
| 4339 | ADD96846 | 4339 | 34843 | 65347, 95851, 126355, 156859, 187363 | 11355 | AHL95020 | 11355 | 41859 | 72363, 102867, 133371, 163875, 194379 |
| 4340 | ADD96856 | 4340 | 34844 | 65348, 95852, 126356, 156860, 187364 | 11356 | AHL95032 | 11356 | 41860 | 72364, 102868, 133372, 163876, 194380 |
| 4341 | ADD96886 | 4341 | 34845 | 65349, 95853, 126357, 156861, 187365 | 11357 | AHL95044 | 11357 | 41861 | 72365, 102869, 133373, 163877, 194381 |
| 4342 | ADD96896 | 4342 | 34846 | 65350, 95854, 126358, 156862, 187366 | 11358 | AHL95056 | 11358 | 41862 | 72366, 102870, 133374, 163878, 194382 |
| 4343 | ADD96906 | 4343 | 34847 | 65351, 95855, 126359, 156863, 187367 | 11359 | AHL95068 | 11359 | 41863 | 72367, 102871, 133375, 163879, 194383 |
| 4344 | ADD96916 | 4344 | 34848 | 65352, 95856, 126360, 156864, 187368 | 11360 | AHL95080 | 11360 | 41864 | 72368, 102872, 133376, 163880, 194384 |
| 4345 | ADD96926 | 4345 | 34849 | 65353, 95857, 126361, 156865, 187369 | 11361 | AHL95092 | 11361 | 41865 | 72369, 102873, 133377, 163881, 194385 |
| 4346 | ADD96936 | 4346 | 34850 | 65354, 95858, 126362, 156866, 187370 | 11362 | AHL95104 | 11362 | 41866 | 72370, 102874, 133378, 163882, 194386 |
| 4347 | ADD96946 | 4347 | 34851 | 65355, 95859, 126363, 156867, 187371 | 11363 | AHL95116 | 11363 | 41867 | 72371, 102875, 133379, 163883, 194387 |
| 4348 | ADD96956 | 4348 | 34852 | 65356, 95860, 126364, 156868, 187372 | 11364 | AHL95128 | 11364 | 41868 | 72372, 102876, 133380, 163884, 194388 |
| 4349 | ADD96976 | 4349 | 34853 | 65357, 95861, 126365, 156869, 187373 | 11365 | AHL95140 | 11365 | 41869 | 72373, 102877, 133381, 163885, 194389 |

FIG. 1 continued

| | | | | | | | | | |
|---|---|---|---|---|---|---|---|---|---|
| 4350 | ADD96986 | 4350 | 34854 | 65358, 95862, 126366, 156870, 187374 | 11366 | AHL95152 | 11366 | 41870 | 72374, 102878, 133382, 163886, 194390 |
| 4351 | ADD97035 | 4351 | 34855 | 65359, 95863, 126367, 156871, 187375 | 11367 | AHL95164 | 11367 | 41871 | 72375, 102879, 133383, 163887, 194391 |
| 4352 | ADD97045 | 4352 | 34856 | 65360, 95864, 126368, 156872, 187376 | 11368 | AHL95176 | 11368 | 41872 | 72376, 102880, 133384, 163888, 194392 |
| 4353 | ADD97055 | 4353 | 34857 | 65361, 95865, 126369, 156873, 187377 | 11369 | AHL95188 | 11369 | 41873 | 72377, 102881, 133385, 163889, 194393 |
| 4354 | ADD97123 | 4354 | 34858 | 65362, 95866, 126370, 156874, 187378 | 11370 | AHL95200 | 11370 | 41874 | 72378, 102882, 133386, 163890, 194394 |
| 4355 | ADD97161 | 4355 | 34859 | 65363, 95867, 126371, 156875, 187379 | 11371 | AHL95212 | 11371 | 41875 | 72379, 102883, 133387, 163891, 194395 |
| 4356 | ADD97171 | 4356 | 34860 | 65364, 95868, 126372, 156876, 187380 | 11372 | AHL95224 | 11372 | 41876 | 72380, 102884, 133388, 163892, 194396 |
| 4357 | ADD97181 | 4357 | 34861 | 65365, 95869, 126373, 156877, 187381 | 11373 | AHL95236 | 11373 | 41877 | 72381, 102885, 133389, 163893, 194397 |
| 4358 | ADD97201 | 4358 | 34862 | 65366, 95870, 126374, 156878, 187382 | 11374 | AHL95248 | 11374 | 41878 | 72382, 102886, 133390, 163894, 194398 |
| 4359 | ADD97211 | 4359 | 34863 | 65367, 95871, 126375, 156879, 187383 | 11375 | AHL95260 | 11375 | 41879 | 72383, 102887, 133391, 163895, 194399 |
| 4360 | ADD97231 | 4360 | 34864 | 65368, 95872, 126376, 156880, 187384 | 11376 | AHL95272 | 11376 | 41880 | 72384, 102888, 133392, 163896, 194400 |
| 4361 | ADD97241 | 4361 | 34865 | 65369, 95873, 126377, 156881, 187385 | 11377 | AHL95284 | 11377 | 41881 | 72385, 102889, 133393, 163897, 194401 |
| 4362 | ADD97251 | 4362 | 34866 | 65370, 95874, 126378, 156882, 187386 | 11378 | AHL95296 | 11378 | 41882 | 72386, 102890, 133394, 163898, 194402 |
| 4363 | ADD97261 | 4363 | 34867 | 65371, 95875, 126379, 156883, 187387 | 11379 | AHL95307 | 11379 | 41883 | 72387, 102891, 133395, 163899, 194403 |
| 4364 | ADD97271 | 4364 | 34868 | 65372, 95876, 126380, 156884, 187388 | 11380 | AHL95319 | 11380 | 41884 | 72388, 102892, 133396, 163900, 194404 |
| 4365 | ADD97281 | 4365 | 34869 | 65373, 95877, 126381, 156885, 187389 | 11381 | AHL95331 | 11381 | 41885 | 72389, 102893, 133397, 163901, 194405 |
| 4366 | ADD97291 | 4366 | 34870 | 65374, 95878, 126382, 156886, 187390 | 11382 | AHL95343 | 11382 | 41886 | 72390, 102894, 133398, 163902, 194406 |
| 4367 | ADD97311 | 4367 | 34871 | 65375, 95879, 126383, 156887, 187391 | 11383 | AHL95432 | 11383 | 41887 | 72391, 102895, 133399, 163903, 194407 |

FIG. 1 continued

| | | | | | | | | | |
|---|---|---|---|---|---|---|---|---|---|
| 4368 | ADD97321 | 4368 | 34872 | 65376, 95880, 126384, 156888, 187392 | 11384 | AHL95444 | 11384 | 41888 | 72392, 102896, 133400, 163904, 194408 |
| 4369 | ADD97331 | 4369 | 34873 | 65377, 95881, 126385, 156889, 187393 | 11385 | AHL95457 | 11385 | 41889 | 72393, 102897, 133401, 163905, 194409 |
| 4370 | ADD97341 | 4370 | 34874 | 65378, 95882, 126386, 156890, 187394 | 11386 | AHL95470 | 11386 | 41890 | 72394, 102898, 133402, 163906, 194410 |
| 4371 | ADD97351 | 4371 | 34875 | 65379, 95883, 126387, 156891, 187395 | 11387 | AHL95482 | 11387 | 41891 | 72395, 102899, 133403, 163907, 194411 |
| 4372 | ADD97361 | 4372 | 34876 | 65380, 95884, 126388, 156892, 187396 | 11388 | AHL95494 | 11388 | 41892 | 72396, 102900, 133404, 163908, 194412 |
| 4373 | ADD97371 | 4373 | 34877 | 65381, 95885, 126389, 156893, 187397 | 11389 | AHL95506 | 11389 | 41893 | 72397, 102901, 133405, 163909, 194413 |
| 4374 | ADD97381 | 4374 | 34878 | 65382, 95886, 126390, 156894, 187398 | 11390 | AHL95518 | 11390 | 41894 | 72398, 102902, 133406, 163910, 194414 |
| 4375 | ADD97391 | 4375 | 34879 | 65383, 95887, 126391, 156895, 187399 | 11391 | AHL95530 | 11391 | 41895 | 72399, 102903, 133407, 163911, 194415 |
| 4376 | ADD97411 | 4376 | 34880 | 65384, 95888, 126392, 156896, 187400 | 11392 | AHL95542 | 11392 | 41896 | 72400, 102904, 133408, 163912, 194416 |
| 4377 | ADD97421 | 4377 | 34881 | 65385, 95889, 126393, 156897, 187401 | 11393 | AHL95554 | 11393 | 41897 | 72401, 102905, 133409, 163913, 194417 |
| 4378 | ADD97431 | 4378 | 34882 | 65386, 95890, 126394, 156898, 187402 | 11394 | AHL95566 | 11394 | 41898 | 72402, 102906, 133410, 163914, 194418 |
| 4379 | ADD97441 | 4379 | 34883 | 65387, 95891, 126395, 156899, 187403 | 11395 | AHL95578 | 11395 | 41899 | 72403, 102907, 133411, 163915, 194419 |
| 4380 | ADD97451 | 4380 | 34884 | 65388, 95892, 126396, 156900, 187404 | 11396 | AHL95590 | 11396 | 41900 | 72404, 102908, 133412, 163916, 194420 |
| 4381 | ADD97461 | 4381 | 34885 | 65389, 95893, 126397, 156901, 187405 | 11397 | AHL95602 | 11397 | 41901 | 72405, 102909, 133413, 163917, 194421 |
| 4382 | ADD97471 | 4382 | 34886 | 65390, 95894, 126398, 156902, 187406 | 11398 | AHL95614 | 11398 | 41902 | 72406, 102910, 133414, 163918, 194422 |
| 4383 | ADD97481 | 4383 | 34887 | 65391, 95895, 126399, 156903, 187407 | 11399 | AHL95626 | 11399 | 41903 | 72407, 102911, 133415, 163919, 194423 |
| 4384 | ADD97491 | 4384 | 34888 | 65392, 95896, 126400, 156904, 187408 | 11400 | AHL95638 | 11400 | 41904 | 72408, 102912, 133416, 163920, 194424 |
| 4385 | ADD97501 | 4385 | 34889 | 65393, 95897, 126401, 156905, 187409 | 11401 | AHL95650 | 11401 | 41905 | 72409, 102913, 133417, 163921, 194425 |

FIG. 1 continued

| | | | | | | | | | |
|---|---|---|---|---|---|---|---|---|---|
| 4386 | ADD97511 | 4386 | 34890 | 65394, 95898, 126402, 156906, 187410 | 11402 | AHL95662 | 11402 | 41906 | 72410, 102914, 133418, 163922, 194426 |
| 4387 | ADD97531 | 4387 | 34891 | 65395, 95899, 126403, 156907, 187411 | 11403 | AHL95686 | 11403 | 41907 | 72411, 102915, 133419, 163923, 194427 |
| 4388 | ADD97541 | 4388 | 34892 | 65396, 95900, 126404, 156908, 187412 | 11404 | AHL95698 | 11404 | 41908 | 72412, 102916, 133420, 163924, 194428 |
| 4389 | ADD97551 | 4389 | 34893 | 65397, 95901, 126405, 156909, 187413 | 11405 | AHL95710 | 11405 | 41909 | 72413, 102917, 133421, 163925, 194429 |
| 4390 | ADD97561 | 4390 | 34894 | 65398, 95902, 126406, 156910, 187414 | 11406 | AHL95722 | 11406 | 41910 | 72414, 102918, 133422, 163926, 194430 |
| 4391 | ADD97571 | 4391 | 34895 | 65399, 95903, 126407, 156911, 187415 | 11407 | AHL95734 | 11407 | 41911 | 72415, 102919, 133423, 163927, 194431 |
| 4392 | ADD97581 | 4392 | 34896 | 65400, 95904, 126408, 156912, 187416 | 11408 | AHL95746 | 11408 | 41912 | 72416, 102920, 133424, 163928, 194432 |
| 4393 | ADD97591 | 4393 | 34897 | 65401, 95905, 126409, 156913, 187417 | 11409 | AHL95758 | 11409 | 41913 | 72417, 102921, 133425, 163929, 194433 |
| 4394 | ADD97688 | 4394 | 34898 | 65402, 95906, 126410, 156914, 187418 | 11410 | AHL95770 | 11410 | 41914 | 72418, 102922, 133426, 163930, 194434 |
| 4395 | ADD97698 | 4395 | 34899 | 65403, 95907, 126411, 156915, 187419 | 11411 | AHL95782 | 11411 | 41915 | 72419, 102923, 133427, 163931, 194435 |
| 4396 | ADD97888 | 4396 | 34900 | 65404, 95908, 126412, 156916, 187420 | 11412 | AHL95794 | 11412 | 41916 | 72420, 102924, 133428, 163932, 194436 |
| 4397 | ADD97898 | 4397 | 34901 | 65405, 95909, 126413, 156917, 187421 | 11413 | AHL95806 | 11413 | 41917 | 72421, 102925, 133429, 163933, 194437 |
| 4398 | ADD97908 | 4398 | 34902 | 65406, 95910, 126414, 156918, 187422 | 11414 | AHL95818 | 11414 | 41918 | 72422, 102926, 133430, 163934, 194438 |
| 4399 | ADD97918 | 4399 | 34903 | 65407, 95911, 126415, 156919, 187423 | 11415 | AHL95830 | 11415 | 41919 | 72423, 102927, 133431, 163935, 194439 |
| 4400 | ADD97928 | 4400 | 34904 | 65408, 95912, 126416, 156920, 187424 | 11416 | AHL95842 | 11416 | 41920 | 72424, 102928, 133432, 163936, 194440 |
| 4401 | ADD97938 | 4401 | 34905 | 65409, 95913, 126417, 156921, 187425 | 11417 | AHL95854 | 11417 | 41921 | 72425, 102929, 133433, 163937, 194441 |
| 4402 | ADD97948 | 4402 | 34906 | 65410, 95914, 126418, 156922, 187426 | 11418 | AHL95866 | 11418 | 41922 | 72426, 102930, 133434, 163938, 194442 |
| 4403 | ADD97958 | 4403 | 34907 | 65411, 95915, 126419, 156923, 187427 | 11419 | AHL95878 | 11419 | 41923 | 72427, 102931, 133435, 163939, 194443 |

FIG. 1 continued

| | | | | | | | | | |
|---|---|---|---|---|---|---|---|---|---|
| 4404 | ADD97968 | 4404 | 34908 | 65412, 95916, 126420, 156924, 187428 | 11420 | AHL95889 | 11420 | 41924 | 72428, 102932, 133436, 163940, 194444 |
| 4405 | ADD97978 | 4405 | 34909 | 65413, 95917, 126421, 156925, 187429 | 11421 | AHL95901 | 11421 | 41925 | 72429, 102933, 133437, 163941, 194445 |
| 4406 | ADD97988 | 4406 | 34910 | 65414, 95918, 126422, 156926, 187430 | 11422 | AHL95913 | 11422 | 41926 | 72430, 102934, 133438, 163942, 194446 |
| 4407 | ADD97998 | 4407 | 34911 | 65415, 95919, 126423, 156927, 187431 | 11423 | AHL95937 | 11423 | 41927 | 72431, 102935, 133439, 163943, 194447 |
| 4408 | ADD98008 | 4408 | 34912 | 65416, 95920, 126424, 156928, 187432 | 11424 | AHL95949 | 11424 | 41928 | 72432, 102936, 133440, 163944, 194448 |
| 4409 | ADD98018 | 4409 | 34913 | 65417, 95921, 126425, 156929, 187433 | 11425 | AHL95961 | 11425 | 41929 | 72433, 102937, 133441, 163945, 194449 |
| 4410 | ADD98028 | 4410 | 34914 | 65418, 95922, 126426, 156930, 187434 | 11426 | AHL95973 | 11426 | 41930 | 72434, 102938, 133442, 163946, 194450 |
| 4411 | ADD98038 | 4411 | 34915 | 65419, 95923, 126427, 156931, 187435 | 11427 | AHL95985 | 11427 | 41931 | 72435, 102939, 133443, 163947, 194451 |
| 4412 | ADD98048 | 4412 | 34916 | 65420, 95924, 126428, 156932, 187436 | 11428 | AHL95997 | 11428 | 41932 | 72436, 102940, 133444, 163948, 194452 |
| 4413 | ADD98058 | 4413 | 34917 | 65421, 95925, 126429, 156933, 187437 | 11429 | AHL96021 | 11429 | 41933 | 72437, 102941, 133445, 163949, 194453 |
| 4414 | ADD98068 | 4414 | 34918 | 65422, 95926, 126430, 156934, 187438 | 11430 | AHL96033 | 11430 | 41934 | 72438, 102942, 133446, 163950, 194454 |
| 4415 | ADD98078 | 4415 | 34919 | 65423, 95927, 126431, 156935, 187439 | 11431 | AHL96045 | 11431 | 41935 | 72439, 102943, 133447, 163951, 194455 |
| 4416 | ADD98098 | 4416 | 34920 | 65424, 95928, 126432, 156936, 187440 | 11432 | AHL96056 | 11432 | 41936 | 72440, 102944, 133448, 163952, 194456 |
| 4417 | ADD98118 | 4417 | 34921 | 65425, 95929, 126433, 156937, 187441 | 11433 | AHL96068 | 11433 | 41937 | 72441, 102945, 133449, 163953, 194457 |
| 4418 | ADD98128 | 4418 | 34922 | 65426, 95930, 126434, 156938, 187442 | 11434 | AHL96080 | 11434 | 41938 | 72442, 102946, 133450, 163954, 194458 |
| 4419 | ADD98138 | 4419 | 34923 | 65427, 95931, 126435, 156939, 187443 | 11435 | AHL96092 | 11435 | 41939 | 72443, 102947, 133451, 163955, 194459 |
| 4420 | ADD98148 | 4420 | 34924 | 65428, 95932, 126436, 156940, 187444 | 11436 | AHL96104 | 11436 | 41940 | 72444, 102948, 133452, 163956, 194460 |
| 4421 | ADD98158 | 4421 | 34925 | 65429, 95933, 126437, 156941, 187445 | 11437 | AHL96116 | 11437 | 41941 | 72445, 102949, 133453, 163957, 194461 |

FIG. 1 continued

| | | | | | | | | | |
|---|---|---|---|---|---|---|---|---|---|
| 4422 | ADD98168 | 4422 | 34926 | 65430, 95934, 126438, 156942, 187446 | 11438 | AHL96128 | 11438 | 41942 | 72446, 102950, 133454, 163958, 194462 |
| 4423 | ADD98188 | 4423 | 34927 | 65431, 95935, 126439, 156943, 187447 | 11439 | AHL96152 | 11439 | 41943 | 72447, 102951, 133455, 163959, 194463 |
| 4424 | ADD98198 | 4424 | 34928 | 65432, 95936, 126440, 156944, 187448 | 11440 | AHL96164 | 11440 | 41944 | 72448, 102952, 133456, 163960, 194464 |
| 4425 | ADD98208 | 4425 | 34929 | 65433, 95937, 126441, 156945, 187449 | 11441 | AHL96176 | 11441 | 41945 | 72449, 102953, 133457, 163961, 194465 |
| 4426 | ADE20321 | 4426 | 34930 | 65434, 95938, 126442, 156946, 187450 | 11442 | AHL96188 | 11442 | 41946 | 72450, 102954, 133458, 163962, 194466 |
| 4427 | ADE20331 | 4427 | 34931 | 65435, 95939, 126443, 156947, 187451 | 11443 | AHL96200 | 11443 | 41947 | 72451, 102955, 133459, 163963, 194467 |
| 4428 | ADE20341 | 4428 | 34932 | 65436, 95940, 126444, 156948, 187452 | 11444 | AHL96212 | 11444 | 41948 | 72452, 102956, 133460, 163964, 194468 |
| 4429 | ADE20351 | 4429 | 34933 | 65437, 95941, 126445, 156949, 187453 | 11445 | AHL96224 | 11445 | 41949 | 72453, 102957, 133461, 163965, 194469 |
| 4430 | ADE20375 | 4430 | 34934 | 65438, 95942, 126446, 156950, 187454 | 11446 | AHL96236 | 11446 | 41950 | 72454, 102958, 133462, 163966, 194470 |
| 4431 | ADE20388 | 4431 | 34935 | 65439, 95943, 126447, 156951, 187455 | 11447 | AHL96248 | 11447 | 41951 | 72455, 102959, 133463, 163967, 194471 |
| 4432 | ADE20628 | 4432 | 34936 | 65440, 95944, 126448, 156952, 187456 | 11448 | AHL96260 | 11448 | 41952 | 72456, 102960, 133464, 163968, 194472 |
| 4433 | ADE20638 | 4433 | 34937 | 65441, 95945, 126449, 156953, 187457 | 11449 | AHL96274 | 11449 | 41953 | 72457, 102961, 133465, 163969, 194473 |
| 4434 | ADE20648 | 4434 | 34938 | 65442, 95946, 126450, 156954, 187458 | 11450 | AHL96304 | 11450 | 41954 | 72458, 102962, 133466, 163970, 194474 |
| 4435 | ADE20658 | 4435 | 34939 | 65443, 95947, 126451, 156955, 187459 | 11451 | AHL96318 | 11451 | 41955 | 72459, 102963, 133467, 163971, 194475 |
| 4436 | ADE20668 | 4436 | 34940 | 65444, 95948, 126452, 156956, 187460 | 11452 | AHL96330 | 11452 | 41956 | 72460, 102964, 133468, 163972, 194476 |
| 4437 | ADE20678 | 4437 | 34941 | 65445, 95949, 126453, 156957, 187461 | 11453 | AHL96342 | 11453 | 41957 | 72461, 102965, 133469, 163973, 194477 |
| 4438 | ADE20688 | 4438 | 34942 | 65446, 95950, 126454, 156958, 187462 | 11454 | AHL96354 | 11454 | 41958 | 72462, 102966, 133470, 163974, 194478 |
| 4439 | ADE20708 | 4439 | 34943 | 65447, 95951, 126455, 156959, 187463 | 11455 | AHL96366 | 11455 | 41959 | 72463, 102967, 133471, 163975, 194479 |

FIG. 1 continued

| | | | | | | | | | |
|---|---|---|---|---|---|---|---|---|---|
| 4440 | ADE20718 | 4440 | 34944 | 65448, 95952, 126456, 156960, 187464 | 11456 | AHL96378 | 11456 | 41960 | 72464, 102968, 133472, 163976, 194480 |
| 4441 | ADE20728 | 4441 | 34945 | 65449, 95953, 126457, 156961, 187465 | 11457 | AHL96390 | 11457 | 41961 | 72465, 102969, 133473, 163977, 194481 |
| 4442 | ADE20738 | 4442 | 34946 | 65450, 95954, 126458, 156962, 187466 | 11458 | AHL96402 | 11458 | 41962 | 72466, 102970, 133474, 163978, 194482 |
| 4443 | ADE20748 | 4443 | 34947 | 65451, 95955, 126459, 156963, 187467 | 11459 | AHL96414 | 11459 | 41963 | 72467, 102971, 133475, 163979, 194483 |
| 4444 | ADE20758 | 4444 | 34948 | 65452, 95956, 126460, 156964, 187468 | 11460 | AHL96426 | 11460 | 41964 | 72468, 102972, 133476, 163980, 194484 |
| 4445 | ADE20768 | 4445 | 34949 | 65453, 95957, 126461, 156965, 187469 | 11461 | AHL96438 | 11461 | 41965 | 72469, 102973, 133477, 163981, 194485 |
| 4446 | ADE20778 | 4446 | 34950 | 65454, 95958, 126462, 156966, 187470 | 11462 | AHL96450 | 11462 | 41966 | 72470, 102974, 133478, 163982, 194486 |
| 4447 | ADE20788 | 4447 | 34951 | 65455, 95959, 126463, 156967, 187471 | 11463 | AHL96462 | 11463 | 41967 | 72471, 102975, 133479, 163983, 194487 |
| 4448 | ADE20808 | 4448 | 34952 | 65456, 95960, 126464, 156968, 187472 | 11464 | AHL96474 | 11464 | 41968 | 72472, 102976, 133480, 163984, 194488 |
| 4449 | ADE20818 | 4449 | 34953 | 65457, 95961, 126465, 156969, 187473 | 11465 | AHL96485 | 11465 | 41969 | 72473, 102977, 133481, 163985, 194489 |
| 4450 | ADE20828 | 4450 | 34954 | 65458, 95962, 126466, 156970, 187474 | 11466 | AHL96497 | 11466 | 41970 | 72474, 102978, 133482, 163986, 194490 |
| 4451 | ADE20848 | 4451 | 34955 | 65459, 95963, 126467, 156971, 187475 | 11467 | AHL96509 | 11467 | 41971 | 72475, 102979, 133483, 163987, 194491 |
| 4452 | ADE20858 | 4452 | 34956 | 65460, 95964, 126468, 156972, 187476 | 11468 | AHL96521 | 11468 | 41972 | 72476, 102980, 133484, 163988, 194492 |
| 4453 | ADE20868 | 4453 | 34957 | 65461, 95965, 126469, 156973, 187477 | 11469 | AHL96533 | 11469 | 41973 | 72477, 102981, 133485, 163989, 194493 |
| 4454 | ADE20878 | 4454 | 34958 | 65462, 95966, 126470, 156974, 187478 | 11470 | AHL96545 | 11470 | 41974 | 72478, 102982, 133486, 163990, 194494 |
| 4455 | ADE20888 | 4455 | 34959 | 65463, 95967, 126471, 156975, 187479 | 11471 | AHL96569 | 11471 | 41975 | 72479, 102983, 133487, 163991, 194495 |
| 4456 | ADE20898 | 4456 | 34960 | 65464, 95968, 126472, 156976, 187480 | 11472 | AHL96581 | 11472 | 41976 | 72480, 102984, 133488, 163992, 194496 |
| 4457 | ADE20908 | 4457 | 34961 | 65465, 95969, 126473, 156977, 187481 | 11473 | AHL96592 | 11473 | 41977 | 72481, 102985, 133489, 163993, 194497 |

FIG. 1 continued

| | | | | | | | | | |
|---|---|---|---|---|---|---|---|---|---|
| 4458 | ADE20918 | 4458 | 34962 | 65466, 95970, 126474, 156978, 187482 | 11474 | AHL96604 | 11474 | 41978 | 72482, 102986, 133490, 163994, 194498 |
| 4459 | ADE20928 | 4459 | 34963 | 65467, 95971, 126475, 156979, 187483 | 11475 | AHL96616 | 11475 | 41979 | 72483, 102987, 133491, 163995, 194499 |
| 4460 | ADE20948 | 4460 | 34964 | 65468, 95972, 126476, 156980, 187484 | 11476 | AHL96628 | 11476 | 41980 | 72484, 102988, 133492, 163996, 194500 |
| 4461 | ADE20968 | 4461 | 34965 | 65469, 95973, 126477, 156981, 187485 | 11477 | AHL96640 | 11477 | 41981 | 72485, 102989, 133493, 163997, 194501 |
| 4462 | ADE20978 | 4462 | 34966 | 65470, 95974, 126478, 156982, 187486 | 11478 | AHL96652 | 11478 | 41982 | 72486, 102990, 133494, 163998, 194502 |
| 4463 | ADE20988 | 4463 | 34967 | 65471, 95975, 126479, 156983, 187487 | 11479 | AHL96664 | 11479 | 41983 | 72487, 102991, 133495, 163999, 194503 |
| 4464 | ADE20998 | 4464 | 34968 | 65472, 95976, 126480, 156984, 187488 | 11480 | AHL96676 | 11480 | 41984 | 72488, 102992, 133496, 164000, 194504 |
| 4465 | ADE21008 | 4465 | 34969 | 65473, 95977, 126481, 156985, 187489 | 11481 | AHL96688 | 11481 | 41985 | 72489, 102993, 133497, 164001, 194505 |
| 4466 | ADE21018 | 4466 | 34970 | 65474, 95978, 126482, 156986, 187490 | 11482 | AHL96700 | 11482 | 41986 | 72490, 102994, 133498, 164002, 194506 |
| 4467 | ADE21028 | 4467 | 34971 | 65475, 95979, 126483, 156987, 187491 | 11483 | AHL96712 | 11483 | 41987 | 72491, 102995, 133499, 164003, 194507 |
| 4468 | ADE21038 | 4468 | 34972 | 65476, 95980, 126484, 156988, 187492 | 11484 | AHL96724 | 11484 | 41988 | 72492, 102996, 133500, 164004, 194508 |
| 4469 | ADE21048 | 4469 | 34973 | 65477, 95981, 126485, 156989, 187493 | 11485 | AHL96748 | 11485 | 41989 | 72493, 102997, 133501, 164005, 194509 |
| 4470 | ADE21058 | 4470 | 34974 | 65478, 95982, 126486, 156990, 187494 | 11486 | AHL96784 | 11486 | 41990 | 72494, 102998, 133502, 164006, 194510 |
| 4471 | ADE21068 | 4471 | 34975 | 65479, 95983, 126487, 156991, 187495 | 11487 | AHL96796 | 11487 | 41991 | 72495, 102999, 133503, 164007, 194511 |
| 4472 | ADE28761 | 4472 | 34976 | 65480, 95984, 126488, 156992, 187496 | 11488 | AHL96808 | 11488 | 41992 | 72496, 103000, 133504, 164008, 194512 |
| 4473 | ADE28780 | 4473 | 34977 | 65481, 95985, 126489, 156993, 187497 | 11489 | AHL96820 | 11489 | 41993 | 72497, 103001, 133505, 164009, 194513 |
| 4474 | ADE28790 | 4474 | 34978 | 65482, 95986, 126490, 156994, 187498 | 11490 | AHL96832 | 11490 | 41994 | 72498, 103002, 133506, 164010, 194514 |
| 4475 | ADE28800 | 4475 | 34979 | 65483, 95987, 126491, 156995, 187499 | 11491 | AHL96844 | 11491 | 41995 | 72499, 103003, 133507, 164011, 194515 |

FIG. 1 continued

| | | | | | | | | | |
|---|---|---|---|---|---|---|---|---|---|
| 4476 | ADE28810 | 4476 | 34980 | 65484, 95988, 126492, 156996, 187500 | 11492 | AHL96856 | 11492 | 41996 | 72500, 103004, 133508, 164012, 194516 |
| 4477 | ADE28820 | 4477 | 34981 | 65485, 95989, 126493, 156997, 187501 | 11493 | AHL96868 | 11493 | 41997 | 72501, 103005, 133509, 164013, 194517 |
| 4478 | ADE28830 | 4478 | 34982 | 65486, 95990, 126494, 156998, 187502 | 11494 | AHL96880 | 11494 | 41998 | 72502, 103006, 133510, 164014, 194518 |
| 4479 | ADE28840 | 4479 | 34983 | 65487, 95991, 126495, 156999, 187503 | 11495 | AHL96892 | 11495 | 41999 | 72503, 103007, 133511, 164015, 194519 |
| 4480 | ADE28850 | 4480 | 34984 | 65488, 95992, 126496, 157000, 187504 | 11496 | AHL96904 | 11496 | 42000 | 72504, 103008, 133512, 164016, 194520 |
| 4481 | ADE28881 | 4481 | 34985 | 65489, 95993, 126497, 157001, 187505 | 11497 | AHL96916 | 11497 | 42001 | 72505, 103009, 133513, 164017, 194521 |
| 4482 | ADE28891 | 4482 | 34986 | 65490, 95994, 126498, 157002, 187506 | 11498 | AHL96928 | 11498 | 42002 | 72506, 103010, 133514, 164018, 194522 |
| 4483 | ADE28911 | 4483 | 34987 | 65491, 95995, 126499, 157003, 187507 | 11499 | AHL96940 | 11499 | 42003 | 72507, 103011, 133515, 164019, 194523 |
| 4484 | ADE28921 | 4484 | 34988 | 65492, 95996, 126500, 157004, 187508 | 11500 | AHL96952 | 11500 | 42004 | 72508, 103012, 133516, 164020, 194524 |
| 4485 | ADE28931 | 4485 | 34989 | 65493, 95997, 126501, 157005, 187509 | 11501 | AHL96964 | 11501 | 42005 | 72509, 103013, 133517, 164021, 194525 |
| 4486 | ADE28951 | 4486 | 34990 | 65494, 95998, 126502, 157006, 187510 | 11502 | AHL96976 | 11502 | 42006 | 72510, 103014, 133518, 164022, 194526 |
| 4487 | ADE28961 | 4487 | 34991 | 65495, 95999, 126503, 157007, 187511 | 11503 | AHL96988 | 11503 | 42007 | 72511, 103015, 133519, 164023, 194527 |
| 4488 | ADE28971 | 4488 | 34992 | 65496, 96000, 126504, 157008, 187512 | 11504 | AHL97000 | 11504 | 42008 | 72512, 103016, 133520, 164024, 194528 |
| 4489 | ADE28981 | 4489 | 34993 | 65497, 96001, 126505, 157009, 187513 | 11505 | AHL97012 | 11505 | 42009 | 72513, 103017, 133521, 164025, 194529 |
| 4490 | ADE28991 | 4490 | 34994 | 65498, 96002, 126506, 157010, 187514 | 11506 | AHL97024 | 11506 | 42010 | 72514, 103018, 133522, 164026, 194530 |
| 4491 | ADE29001 | 4491 | 34995 | 65499, 96003, 126507, 157011, 187515 | 11507 | AHL97036 | 11507 | 42011 | 72515, 103019, 133523, 164027, 194531 |
| 4492 | ADE29011 | 4492 | 34996 | 65500, 96004, 126508, 157012, 187516 | 11508 | AHL97048 | 11508 | 42012 | 72516, 103020, 133524, 164028, 194532 |
| 4493 | ADE29021 | 4493 | 34997 | 65501, 96005, 126509, 157013, 187517 | 11509 | AHL97060 | 11509 | 42013 | 72517, 103021, 133525, 164029, 194533 |

FIG. 1 continued

| | | | | | | | | | |
|---|---|---|---|---|---|---|---|---|---|
| 4494 | ADE29031 | 4494 | 34998 | 65502, 96006, 126510, 157014, 187518 | 11510 | AHL97072 | 11510 | 42014 | 72518, 103022, 133526, 164030, 194534 |
| 4495 | ADE29041 | 4495 | 34999 | 65503, 96007, 126511, 157015, 187519 | 11511 | AHL97084 | 11511 | 42015 | 72519, 103023, 133527, 164031, 194535 |
| 4496 | ADE29051 | 4496 | 35000 | 65504, 96008, 126512, 157016, 187520 | 11512 | AHL97096 | 11512 | 42016 | 72520, 103024, 133528, 164032, 194536 |
| 4497 | ADE29085 | 4497 | 35001 | 65505, 96009, 126513, 157017, 187521 | 11513 | AHL97108 | 11513 | 42017 | 72521, 103025, 133529, 164033, 194537 |
| 4498 | ADE29095 | 4498 | 35002 | 65506, 96010, 126514, 157018, 187522 | 11514 | AHL97120 | 11514 | 42018 | 72522, 103026, 133530, 164034, 194538 |
| 4499 | ADE34191 | 4499 | 35003 | 65507, 96011, 126515, 157019, 187523 | 11515 | AHL97132 | 11515 | 42019 | 72523, 103027, 133531, 164035, 194539 |
| 4500 | ADE34202 | 4500 | 35004 | 65508, 96012, 126516, 157020, 187524 | 11516 | AHL97144 | 11516 | 42020 | 72524, 103028, 133532, 164036, 194540 |
| 4501 | ADE34213 | 4501 | 35005 | 65509, 96013, 126517, 157021, 187525 | 11517 | AHL97156 | 11517 | 42021 | 72525, 103029, 133533, 164037, 194541 |
| 4502 | ADE34224 | 4502 | 35006 | 65510, 96014, 126518, 157022, 187526 | 11518 | AHL97168 | 11518 | 42022 | 72526, 103030, 133534, 164038, 194542 |
| 4503 | ADE34235 | 4503 | 35007 | 65511, 96015, 126519, 157023, 187527 | 11519 | AHL97180 | 11519 | 42023 | 72527, 103031, 133535, 164039, 194543 |
| 4504 | ADE34246 | 4504 | 35008 | 65512, 96016, 126520, 157024, 187528 | 11520 | AHL97192 | 11520 | 42024 | 72528, 103032, 133536, 164040, 194544 |
| 4505 | ADE34257 | 4505 | 35009 | 65513, 96017, 126521, 157025, 187529 | 11521 | AHL97204 | 11521 | 42025 | 72529, 103033, 133537, 164041, 194545 |
| 4506 | ADE34268 | 4506 | 35010 | 65514, 96018, 126522, 157026, 187530 | 11522 | AHL97216 | 11522 | 42026 | 72530, 103034, 133538, 164042, 194546 |
| 4507 | ADE45499 | 4507 | 35011 | 65515, 96019, 126523, 157027, 187531 | 11523 | AHL97228 | 11523 | 42027 | 72531, 103035, 133539, 164043, 194547 |
| 4508 | ADE45501 | 4508 | 35012 | 65516, 96020, 126524, 157028, 187532 | 11524 | AHL97240 | 11524 | 42028 | 72532, 103036, 133540, 164044, 194548 |
| 4509 | ADE45503 | 4509 | 35013 | 65517, 96021, 126525, 157029, 187533 | 11525 | AHL97252 | 11525 | 42029 | 72533, 103037, 133541, 164045, 194549 |
| 4510 | ADE45505 | 4510 | 35014 | 65518, 96022, 126526, 157030, 187534 | 11526 | AHL97264 | 11526 | 42030 | 72534, 103038, 133542, 164046, 194550 |
| 4511 | ADE45507 | 4511 | 35015 | 65519, 96023, 126527, 157031, 187535 | 11527 | AHL97276 | 11527 | 42031 | 72535, 103039, 133543, 164047, 194551 |

FIG. 1 continued

| | | | | | | | | | |
|---|---|---|---|---|---|---|---|---|---|
| 4512 | ADE45509 | 4512 | 35016 | 65520, 96024, 126528, 157032, 187536 | 11528 | AHL97288 | 11528 | 42032 | 72536, 103040, 133544, 164048, 194552 |
| 4513 | ADE45511 | 4513 | 35017 | 65521, 96025, 126529, 157033, 187537 | 11529 | AHL97300 | 11529 | 42033 | 72537, 103041, 133545, 164049, 194553 |
| 4514 | ADE45513 | 4514 | 35018 | 65522, 96026, 126530, 157034, 187538 | 11530 | AHL97312 | 11530 | 42034 | 72538, 103042, 133546, 164050, 194554 |
| 4515 | ADE75388 | 4515 | 35019 | 65523, 96027, 126531, 157035, 187539 | 11531 | AHL97336 | 11531 | 42035 | 72539, 103043, 133547, 164051, 194555 |
| 4516 | ADE75390 | 4516 | 35020 | 65524, 96028, 126532, 157036, 187540 | 11532 | AHL97348 | 11532 | 42036 | 72540, 103044, 133548, 164052, 194556 |
| 4517 | ADF10067 | 4517 | 35021 | 65525, 96029, 126533, 157037, 187541 | 11533 | AHL97372 | 11533 | 42037 | 72541, 103045, 133549, 164053, 194557 |
| 4518 | ADF10077 | 4518 | 35022 | 65526, 96030, 126534, 157038, 187542 | 11534 | AHL97384 | 11534 | 42038 | 72542, 103046, 133550, 164054, 194558 |
| 4519 | ADF10087 | 4519 | 35023 | 65527, 96031, 126535, 157039, 187543 | 11535 | AHL97396 | 11535 | 42039 | 72543, 103047, 133551, 164055, 194559 |
| 4520 | ADF10097 | 4520 | 35024 | 65528, 96032, 126536, 157040, 187544 | 11536 | AHL97408 | 11536 | 42040 | 72544, 103048, 133552, 164056, 194560 |
| 4521 | ADF10107 | 4521 | 35025 | 65529, 96033, 126537, 157041, 187545 | 11537 | AHL97420 | 11537 | 42041 | 72545, 103049, 133553, 164057, 194561 |
| 4522 | ADF10117 | 4522 | 35026 | 65530, 96034, 126538, 157042, 187546 | 11538 | AHL97444 | 11538 | 42042 | 72546, 103050, 133554, 164058, 194562 |
| 4523 | ADF10127 | 4523 | 35027 | 65531, 96035, 126539, 157043, 187547 | 11539 | AHL97456 | 11539 | 42043 | 72547, 103051, 133555, 164059, 194563 |
| 4524 | ADF10137 | 4524 | 35028 | 65532, 96036, 126540, 157044, 187548 | 11540 | AHL97468 | 11540 | 42044 | 72548, 103052, 133556, 164060, 194564 |
| 4525 | ADF10154 | 4525 | 35029 | 65533, 96037, 126541, 157045, 187549 | 11541 | AHL97480 | 11541 | 42045 | 72549, 103053, 133557, 164061, 194565 |
| 4526 | ADF10174 | 4526 | 35030 | 65534, 96038, 126542, 157046, 187550 | 11542 | AHL97493 | 11542 | 42046 | 72550, 103054, 133558, 164062, 194566 |
| 4527 | ADF10190 | 4527 | 35031 | 65535, 96039, 126543, 157047, 187551 | 11543 | AHL97505 | 11543 | 42047 | 72551, 103055, 133559, 164063, 194567 |
| 4528 | ADF10237 | 4528 | 35032 | 65536, 96040, 126544, 157048, 187552 | 11544 | AHL97517 | 11544 | 42048 | 72552, 103056, 133560, 164064, 194568 |
| 4529 | ADF10262 | 4529 | 35033 | 65537, 96041, 126545, 157049, 187553 | 11545 | AHL97529 | 11545 | 42049 | 72553, 103057, 133561, 164065, 194569 |

FIG. 1 continued

| | | | | | | | | | |
|---|---|---|---|---|---|---|---|---|---|
| 4530 | ADF10288 | 4530 | 35034 | 65538, 96042, 126546, 157050, 187554 | 11546 | AHL97541 | 11546 | 42050 | 72554, 103058, 133562, 164066, 194570 |
| 4531 | ADF10302 | 4531 | 35035 | 65539, 96043, 126547, 157051, 187555 | 11547 | AHL97553 | 11547 | 42051 | 72555, 103059, 133563, 164067, 194571 |
| 4532 | ADF10335 | 4532 | 35036 | 65540, 96044, 126548, 157052, 187556 | 11548 | AHL97565 | 11548 | 42052 | 72556, 103060, 133564, 164068, 194572 |
| 4533 | ADF10359 | 4533 | 35037 | 65541, 96045, 126549, 157053, 187557 | 11549 | AHL97577 | 11549 | 42053 | 72557, 103061, 133565, 164069, 194573 |
| 4534 | ADF10369 | 4534 | 35038 | 65542, 96046, 126550, 157054, 187558 | 11550 | AHL97589 | 11550 | 42054 | 72558, 103062, 133566, 164070, 194574 |
| 4535 | ADF10390 | 4535 | 35039 | 65543, 96047, 126551, 157055, 187559 | 11551 | AHL97601 | 11551 | 42055 | 72559, 103063, 133567, 164071, 194575 |
| 4536 | ADF10528 | 4536 | 35040 | 65544, 96048, 126552, 157056, 187560 | 11552 | AHL97613 | 11552 | 42056 | 72560, 103064, 133568, 164072, 194576 |
| 4537 | ADF10598 | 4537 | 35041 | 65545, 96049, 126553, 157057, 187561 | 11553 | AHL97625 | 11553 | 42057 | 72561, 103065, 133569, 164073, 194577 |
| 4538 | ADF10670 | 4538 | 35042 | 65546, 96050, 126554, 157058, 187562 | 11554 | AHL97637 | 11554 | 42058 | 72562, 103066, 133570, 164074, 194578 |
| 4539 | ADF10724 | 4539 | 35043 | 65547, 96051, 126555, 157059, 187563 | 11555 | AHL97661 | 11555 | 42059 | 72563, 103067, 133571, 164075, 194579 |
| 4540 | ADF10757 | 4540 | 35044 | 65548, 96052, 126556, 157060, 187564 | 11556 | AHL97673 | 11556 | 42060 | 72564, 103068, 133572, 164076, 194580 |
| 4541 | ADF10828 | 4541 | 35045 | 65549, 96053, 126557, 157061, 187565 | 11557 | AHL97685 | 11557 | 42061 | 72565, 103069, 133573, 164077, 194581 |
| 4542 | ADF10874 | 4542 | 35046 | 65550, 96054, 126558, 157062, 187566 | 11558 | AHL97697 | 11558 | 42062 | 72566, 103070, 133574, 164078, 194582 |
| 4543 | ADF10929 | 4543 | 35047 | 65551, 96055, 126559, 157063, 187567 | 11559 | AHL97709 | 11559 | 42063 | 72567, 103071, 133575, 164079, 194583 |
| 4544 | ADF10996 | 4544 | 35048 | 65552, 96056, 126560, 157064, 187568 | 11560 | AHL97721 | 11560 | 42064 | 72568, 103072, 133576, 164080, 194584 |
| 4545 | ADF27367 | 4545 | 35049 | 65553, 96057, 126561, 157065, 187569 | 11561 | AHL97733 | 11561 | 42065 | 72569, 103073, 133577, 164081, 194585 |
| 4546 | ADF27369 | 4546 | 35050 | 65554, 96058, 126562, 157066, 187570 | 11562 | AHL97745 | 11562 | 42066 | 72570, 103074, 133578, 164082, 194586 |
| 4547 | ADF27370 | 4547 | 35051 | 65555, 96059, 126563, 157067, 187571 | 11563 | AHL97757 | 11563 | 42067 | 72571, 103075, 133579, 164083, 194587 |

FIG. 1 continued

| | | | | | | | | | |
|---|---|---|---|---|---|---|---|---|---|
| 4548 | ADF27371 | 4548 | 35052 | 65556, 96060, 126564, 157068, 187572 | 11564 | AHL97769 | 11564 | 42068 | 72572, 103076, 133580, 164084, 194588 |
| 4549 | ADF27372 | 4549 | 35053 | 65557, 96061, 126565, 157069, 187573 | 11565 | AHL97781 | 11565 | 42069 | 72573, 103077, 133581, 164085, 194589 |
| 4550 | ADF27373 | 4550 | 35054 | 65558, 96062, 126566, 157070, 187574 | 11566 | AHL97793 | 11566 | 42070 | 72574, 103078, 133582, 164086, 194590 |
| 4551 | ADF27374 | 4551 | 35055 | 65559, 96063, 126567, 157071, 187575 | 11567 | AHL97805 | 11567 | 42071 | 72575, 103079, 133583, 164087, 194591 |
| 4552 | ADF27375 | 4552 | 35056 | 65560, 96064, 126568, 157072, 187576 | 11568 | AHL97817 | 11568 | 42072 | 72576, 103080, 133584, 164088, 194592 |
| 4553 | ADF27376 | 4553 | 35057 | 65561, 96065, 126569, 157073, 187577 | 11569 | AHL97829 | 11569 | 42073 | 72577, 103081, 133585, 164089, 194593 |
| 4554 | ADF27378 | 4554 | 35058 | 65562, 96066, 126570, 157074, 187578 | 11570 | AHL97841 | 11570 | 42074 | 72578, 103082, 133586, 164090, 194594 |
| 4555 | ADF27389 | 4555 | 35059 | 65563, 96067, 126571, 157075, 187579 | 11571 | AHL97853 | 11571 | 42075 | 72579, 103083, 133587, 164091, 194595 |
| 4556 | ADF27399 | 4556 | 35060 | 65564, 96068, 126572, 157076, 187580 | 11572 | AHL97865 | 11572 | 42076 | 72580, 103084, 133588, 164092, 194596 |
| 4557 | ADF27409 | 4557 | 35061 | 65565, 96069, 126573, 157077, 187581 | 11573 | AHL97877 | 11573 | 42077 | 72581, 103085, 133589, 164093, 194597 |
| 4558 | ADF27419 | 4558 | 35062 | 65566, 96070, 126574, 157078, 187582 | 11574 | AHL97889 | 11574 | 42078 | 72582, 103086, 133590, 164094, 194598 |
| 4559 | ADF27429 | 4559 | 35063 | 65567, 96071, 126575, 157079, 187583 | 11575 | AHL97901 | 11575 | 42079 | 72583, 103087, 133591, 164095, 194599 |
| 4560 | ADF27439 | 4560 | 35064 | 65568, 96072, 126576, 157080, 187584 | 11576 | AHL97913 | 11576 | 42080 | 72584, 103088, 133592, 164096, 194600 |
| 4561 | ADF27449 | 4561 | 35065 | 65569, 96073, 126577, 157081, 187585 | 11577 | AHL97925 | 11577 | 42081 | 72585, 103089, 133593, 164097, 194601 |
| 4562 | ADF27459 | 4562 | 35066 | 65570, 96074, 126578, 157082, 187586 | 11578 | AHL97937 | 11578 | 42082 | 72586, 103090, 133594, 164098, 194602 |
| 4563 | ADF27469 | 4563 | 35067 | 65571, 96075, 126579, 157083, 187587 | 11579 | AHL97949 | 11579 | 42083 | 72587, 103091, 133595, 164099, 194603 |
| 4564 | ADF27479 | 4564 | 35068 | 65572, 96076, 126580, 157084, 187588 | 11580 | AHL97961 | 11580 | 42084 | 72588, 103092, 133596, 164100, 194604 |
| 4565 | ADF27489 | 4565 | 35069 | 65573, 96077, 126581, 157085, 187589 | 11581 | AHL97973 | 11581 | 42085 | 72589, 103093, 133597, 164101, 194605 |

FIG. 1 continued

| | | | | | | | | | |
|---|---|---|---|---|---|---|---|---|---|
| 4566 | ADF27499 | 4566 | 35070 | 65574, 96078, 126582, 157086, 187590 | 11582 | AHL97985 | 11582 | 42086 | 72590, 103094, 133598, 164102, 194606 |
| 4567 | ADF27509 | 4567 | 35071 | 65575, 96079, 126583, 157087, 187591 | 11583 | AHL97997 | 11583 | 42087 | 72591, 103095, 133599, 164103, 194607 |
| 4568 | ADF27529 | 4568 | 35072 | 65576, 96080, 126584, 157088, 187592 | 11584 | AHL98009 | 11584 | 42088 | 72592, 103096, 133600, 164104, 194608 |
| 4569 | ADF27539 | 4569 | 35073 | 65577, 96081, 126585, 157089, 187593 | 11585 | AHL98021 | 11585 | 42089 | 72593, 103097, 133601, 164105, 194609 |
| 4570 | ADF27549 | 4570 | 35074 | 65578, 96082, 126586, 157090, 187594 | 11586 | AHL98033 | 11586 | 42090 | 72594, 103098, 133602, 164106, 194610 |
| 4571 | ADF27559 | 4571 | 35075 | 65579, 96083, 126587, 157091, 187595 | 11587 | AHL98045 | 11587 | 42091 | 72595, 103099, 133603, 164107, 194611 |
| 4572 | ADF27569 | 4572 | 35076 | 65580, 96084, 126588, 157092, 187596 | 11588 | AHL98057 | 11588 | 42092 | 72596, 103100, 133604, 164108, 194612 |
| 4573 | ADF27579 | 4573 | 35077 | 65581, 96085, 126589, 157093, 187597 | 11589 | AHL98069 | 11589 | 42093 | 72597, 103101, 133605, 164109, 194613 |
| 4574 | ADF27589 | 4574 | 35078 | 65582, 96086, 126590, 157094, 187598 | 11590 | AHL98081 | 11590 | 42094 | 72598, 103102, 133606, 164110, 194614 |
| 4575 | ADF27599 | 4575 | 35079 | 65583, 96087, 126591, 157095, 187599 | 11591 | AHL98093 | 11591 | 42095 | 72599, 103103, 133607, 164111, 194615 |
| 4576 | ADF27609 | 4576 | 35080 | 65584, 96088, 126592, 157096, 187600 | 11592 | AHL98105 | 11592 | 42096 | 72600, 103104, 133608, 164112, 194616 |
| 4577 | ADF27619 | 4577 | 35081 | 65585, 96089, 126593, 157097, 187601 | 11593 | AHL98116 | 11593 | 42097 | 72601, 103105, 133609, 164113, 194617 |
| 4578 | ADF27629 | 4578 | 35082 | 65586, 96090, 126594, 157098, 187602 | 11594 | AHL98128 | 11594 | 42098 | 72602, 103106, 133610, 164114, 194618 |
| 4579 | ADF27649 | 4579 | 35083 | 65587, 96091, 126595, 157099, 187603 | 11595 | AHL98140 | 11595 | 42099 | 72603, 103107, 133611, 164115, 194619 |
| 4580 | ADF27659 | 4580 | 35084 | 65588, 96092, 126596, 157100, 187604 | 11596 | AHL98152 | 11596 | 42100 | 72604, 103108, 133612, 164116, 194620 |
| 4581 | ADF27669 | 4581 | 35085 | 65589, 96093, 126597, 157101, 187605 | 11597 | AHL98164 | 11597 | 42101 | 72605, 103109, 133613, 164117, 194621 |
| 4582 | ADF27679 | 4582 | 35086 | 65590, 96094, 126598, 157102, 187606 | 11598 | AHL98176 | 11598 | 42102 | 72606, 103110, 133614, 164118, 194622 |
| 4583 | ADF27689 | 4583 | 35087 | 65591, 96095, 126599, 157103, 187607 | 11599 | AHL98188 | 11599 | 42103 | 72607, 103111, 133615, 164119, 194623 |

FIG. 1 continued

| | | | | | | | | | |
|---|---|---|---|---|---|---|---|---|---|
| 4584 | ADF27699 | 4584 | 35088 | 65592, 96096, 126600, 157104, 187608 | 11600 | AHL98200 | 11600 | 42104 | 72608, 103112, 133616, 164120, 194624 |
| 4585 | ADF27709 | 4585 | 35089 | 65593, 96097, 126601, 157105, 187609 | 11601 | AHL98212 | 11601 | 42105 | 72609, 103113, 133617, 164121, 194625 |
| 4586 | ADF27785 | 4586 | 35090 | 65594, 96098, 126602, 157106, 187610 | 11602 | AHL98224 | 11602 | 42106 | 72610, 103114, 133618, 164122, 194626 |
| 4587 | ADF27795 | 4587 | 35091 | 65595, 96099, 126603, 157107, 187611 | 11603 | AHL98236 | 11603 | 42107 | 72611, 103115, 133619, 164123, 194627 |
| 4588 | ADF27805 | 4588 | 35092 | 65596, 96100, 126604, 157108, 187612 | 11604 | AHL98248 | 11604 | 42108 | 72612, 103116, 133620, 164124, 194628 |
| 4589 | ADF27815 | 4589 | 35093 | 65597, 96101, 126605, 157109, 187613 | 11605 | AHL98260 | 11605 | 42109 | 72613, 103117, 133621, 164125, 194629 |
| 4590 | ADF27825 | 4590 | 35094 | 65598, 96102, 126606, 157110, 187614 | 11606 | AHL98272 | 11606 | 42110 | 72614, 103118, 133622, 164126, 194630 |
| 4591 | ADF27845 | 4591 | 35095 | 65599, 96103, 126607, 157111, 187615 | 11607 | AHL98284 | 11607 | 42111 | 72615, 103119, 133623, 164127, 194631 |
| 4592 | ADF27855 | 4592 | 35096 | 65600, 96104, 126608, 157112, 187616 | 11608 | AHL98295 | 11608 | 42112 | 72616, 103120, 133624, 164128, 194632 |
| 4593 | ADF27865 | 4593 | 35097 | 65601, 96105, 126609, 157113, 187617 | 11609 | AHL98307 | 11609 | 42113 | 72617, 103121, 133625, 164129, 194633 |
| 4594 | ADF27875 | 4594 | 35098 | 65602, 96106, 126610, 157114, 187618 | 11610 | AHL98319 | 11610 | 42114 | 72618, 103122, 133626, 164130, 194634 |
| 4595 | ADF27885 | 4595 | 35099 | 65603, 96107, 126611, 157115, 187619 | 11611 | AHL98331 | 11611 | 42115 | 72619, 103123, 133627, 164131, 194635 |
| 4596 | ADF27895 | 4596 | 35100 | 65604, 96108, 126612, 157116, 187620 | 11612 | AHL98343 | 11612 | 42116 | 72620, 103124, 133628, 164132, 194636 |
| 4597 | ADF27915 | 4597 | 35101 | 65605, 96109, 126613, 157117, 187621 | 11613 | AHL98354 | 11613 | 42117 | 72621, 103125, 133629, 164133, 194637 |
| 4598 | ADF27925 | 4598 | 35102 | 65606, 96110, 126614, 157118, 187622 | 11614 | AHL98366 | 11614 | 42118 | 72622, 103126, 133630, 164134, 194638 |
| 4599 | ADF27935 | 4599 | 35103 | 65607, 96111, 126615, 157119, 187623 | 11615 | AHL98378 | 11615 | 42119 | 72623, 103127, 133631, 164135, 194639 |
| 4600 | ADF27955 | 4600 | 35104 | 65608, 96112, 126616, 157120, 187624 | 11616 | AHL98390 | 11616 | 42120 | 72624, 103128, 133632, 164136, 194640 |
| 4601 | ADF27965 | 4601 | 35105 | 65609, 96113, 126617, 157121, 187625 | 11617 | AHL98402 | 11617 | 42121 | 72625, 103129, 133633, 164137, 194641 |

FIG. 1 continued

| | | | | | | | | | |
|---|---|---|---|---|---|---|---|---|---|
| 4602 | ADF27975 | 4602 | 35106 | 65610, 96114, 126618, 157122, 187626 | 11618 | AHL98414 | 11618 | 42122 | 72626, 103130, 133634, 164138, 194642 |
| 4603 | ADF27985 | 4603 | 35107 | 65611, 96115, 126619, 157123, 187627 | 11619 | AHL98426 | 11619 | 42123 | 72627, 103131, 133635, 164139, 194643 |
| 4604 | ADF27995 | 4604 | 35108 | 65612, 96116, 126620, 157124, 187628 | 11620 | AHL98438 | 11620 | 42124 | 72628, 103132, 133636, 164140, 194644 |
| 4605 | ADF28005 | 4605 | 35109 | 65613, 96117, 126621, 157125, 187629 | 11621 | AHL98449 | 11621 | 42125 | 72629, 103133, 133637, 164141, 194645 |
| 4606 | ADF28015 | 4606 | 35110 | 65614, 96118, 126622, 157126, 187630 | 11622 | AHL98471 | 11622 | 42126 | 72630, 103134, 133638, 164142, 194646 |
| 4607 | ADF28025 | 4607 | 35111 | 65615, 96119, 126623, 157127, 187631 | 11623 | AHL98482 | 11623 | 42127 | 72631, 103135, 133639, 164143, 194647 |
| 4608 | ADF28045 | 4608 | 35112 | 65616, 96120, 126624, 157128, 187632 | 11624 | AHL98494 | 11624 | 42128 | 72632, 103136, 133640, 164144, 194648 |
| 4609 | ADF28055 | 4609 | 35113 | 65617, 96121, 126625, 157129, 187633 | 11625 | AHL98506 | 11625 | 42129 | 72633, 103137, 133641, 164145, 194649 |
| 4610 | ADF28065 | 4610 | 35114 | 65618, 96122, 126626, 157130, 187634 | 11626 | AHL98518 | 11626 | 42130 | 72634, 103138, 133642, 164146, 194650 |
| 4611 | ADF28075 | 4611 | 35115 | 65619, 96123, 126627, 157131, 187635 | 11627 | AHL98530 | 11627 | 42131 | 72635, 103139, 133643, 164147, 194651 |
| 4612 | ADF28085 | 4612 | 35116 | 65620, 96124, 126628, 157132, 187636 | 11628 | AHL98542 | 11628 | 42132 | 72636, 103140, 133644, 164148, 194652 |
| 4613 | ADF28107 | 4613 | 35117 | 65621, 96125, 126629, 157133, 187637 | 11629 | AHL98554 | 11629 | 42133 | 72637, 103141, 133645, 164149, 194653 |
| 4614 | ADF28117 | 4614 | 35118 | 65622, 96126, 126630, 157134, 187638 | 11630 | AHL98566 | 11630 | 42134 | 72638, 103142, 133646, 164150, 194654 |
| 4615 | ADF29918 | 4615 | 35119 | 65623, 96127, 126631, 157135, 187639 | 11631 | AHL98578 | 11631 | 42135 | 72639, 103143, 133647, 164151, 194655 |
| 4616 | ADF42689 | 4616 | 35120 | 65624, 96128, 126632, 157136, 187640 | 11632 | AHL98590 | 11632 | 42136 | 72640, 103144, 133648, 164152, 194656 |
| 4617 | ADF42699 | 4617 | 35121 | 65625, 96129, 126633, 157137, 187641 | 11633 | AHL98602 | 11633 | 42137 | 72641, 103145, 133649, 164153, 194657 |
| 4618 | ADF42709 | 4618 | 35122 | 65626, 96130, 126634, 157138, 187642 | 11634 | AHL98614 | 11634 | 42138 | 72642, 103146, 133650, 164154, 194658 |
| 4619 | ADF42719 | 4619 | 35123 | 65627, 96131, 126635, 157139, 187643 | 11635 | AHL98626 | 11635 | 42139 | 72643, 103147, 133651, 164155, 194659 |

FIG. 1 continued

| | | | | | | | | | |
|---|---|---|---|---|---|---|---|---|---|
| 4620 | ADF42729 | 4620 | 35124 | 65628, 96132, 126636, 157140, 187644 | 11636 | AHL98638 | 11636 | 42140 | 72644, 103148, 133652, 164156, 194660 |
| 4621 | ADF42739 | 4621 | 35125 | 65629, 96133, 126637, 157141, 187645 | 11637 | AHL98650 | 11637 | 42141 | 72645, 103149, 133653, 164157, 194661 |
| 4622 | ADF58349 | 4622 | 35126 | 65630, 96134, 126638, 157142, 187646 | 11638 | AHL98662 | 11638 | 42142 | 72646, 103150, 133654, 164158, 194662 |
| 4623 | ADF58351 | 4623 | 35127 | 65631, 96135, 126639, 157143, 187647 | 11639 | AHL98674 | 11639 | 42143 | 72647, 103151, 133655, 164159, 194663 |
| 4624 | ADF80454 | 4624 | 35128 | 65632, 96136, 126640, 157144, 187648 | 11640 | AHL98686 | 11640 | 42144 | 72648, 103152, 133656, 164160, 194664 |
| 4625 | ADF80462 | 4625 | 35129 | 65633, 96137, 126641, 157145, 187649 | 11641 | AHL98699 | 11641 | 42145 | 72649, 103153, 133657, 164161, 194665 |
| 4626 | ADF80470 | 4626 | 35130 | 65634, 96138, 126642, 157146, 187650 | 11642 | AHL98711 | 11642 | 42146 | 72650, 103154, 133658, 164162, 194666 |
| 4627 | ADF80478 | 4627 | 35131 | 65635, 96139, 126643, 157147, 187651 | 11643 | AHL98722 | 11643 | 42147 | 72651, 103155, 133659, 164163, 194667 |
| 4628 | ADF80494 | 4628 | 35132 | 65636, 96140, 126644, 157148, 187652 | 11644 | AHL98734 | 11644 | 42148 | 72652, 103156, 133660, 164164, 194668 |
| 4629 | ADF80498 | 4629 | 35133 | 65637, 96141, 126645, 157149, 187653 | 11645 | AHL98746 | 11645 | 42149 | 72653, 103157, 133661, 164165, 194669 |
| 4630 | ADF80502 | 4630 | 35134 | 65638, 96142, 126646, 157150, 187654 | 11646 | AHL98758 | 11646 | 42150 | 72654, 103158, 133662, 164166, 194670 |
| 4631 | ADF80506 | 4631 | 35135 | 65639, 96143, 126647, 157151, 187655 | 11647 | AHL98770 | 11647 | 42151 | 72655, 103159, 133663, 164167, 194671 |
| 4632 | ADF83741 | 4632 | 35136 | 65640, 96144, 126648, 157152, 187656 | 11648 | AHL98782 | 11648 | 42152 | 72656, 103160, 133664, 164168, 194672 |
| 4633 | ADF83752 | 4633 | 35137 | 65641, 96145, 126649, 157153, 187657 | 11649 | AHL98794 | 11649 | 42153 | 72657, 103161, 133665, 164169, 194673 |
| 4634 | ADF83763 | 4634 | 35138 | 65642, 96146, 126650, 157154, 187658 | 11650 | AHL98806 | 11650 | 42154 | 72658, 103162, 133666, 164170, 194674 |
| 4635 | ADF83773 | 4635 | 35139 | 65643, 96147, 126651, 157155, 187659 | 11651 | AHL98818 | 11651 | 42155 | 72659, 103163, 133667, 164171, 194675 |
| 4636 | ADF83783 | 4636 | 35140 | 65644, 96148, 126652, 157156, 187660 | 11652 | AHL98830 | 11652 | 42156 | 72660, 103164, 133668, 164172, 194676 |
| 4637 | ADF83793 | 4637 | 35141 | 65645, 96149, 126653, 157157, 187661 | 11653 | AHL98842 | 11653 | 42157 | 72661, 103165, 133669, 164173, 194677 |

FIG. 1 continued

| | | | | | | | | | |
|---|---|---|---|---|---|---|---|---|---|
| 4638 | ADF83803 | 4638 | 35142 | 65646, 96150, 126654, 157158, 187662 | 11654 | AHL98854 | 11654 | 42158 | 72662, 103166, 133670, 164174, 194678 |
| 4639 | ADF83813 | 4639 | 35143 | 65647, 96151, 126655, 157159, 187663 | 11655 | AHL98878 | 11655 | 42159 | 72663, 103167, 133671, 164175, 194679 |
| 4640 | ADF83823 | 4640 | 35144 | 65648, 96152, 126656, 157160, 187664 | 11656 | AHL98890 | 11656 | 42160 | 72664, 103168, 133672, 164176, 194680 |
| 4641 | ADF83833 | 4641 | 35145 | 65649, 96153, 126657, 157161, 187665 | 11657 | AHL98902 | 11657 | 42161 | 72665, 103169, 133673, 164177, 194681 |
| 4642 | ADF83843 | 4642 | 35146 | 65650, 96154, 126658, 157162, 187666 | 11658 | AHL98913 | 11658 | 42162 | 72666, 103170, 133674, 164178, 194682 |
| 4643 | ADF83853 | 4643 | 35147 | 65651, 96155, 126659, 157163, 187667 | 11659 | AHL98925 | 11659 | 42163 | 72667, 103171, 133675, 164179, 194683 |
| 4644 | ADF83873 | 4644 | 35148 | 65652, 96156, 126660, 157164, 187668 | 11660 | AHL98937 | 11660 | 42164 | 72668, 103172, 133676, 164180, 194684 |
| 4645 | ADF83885 | 4645 | 35149 | 65653, 96157, 126661, 157165, 187669 | 11661 | AHL98961 | 11661 | 42165 | 72669, 103173, 133677, 164181, 194685 |
| 4646 | ADF83895 | 4646 | 35150 | 65654, 96158, 126662, 157166, 187670 | 11662 | AHL98973 | 11662 | 42166 | 72670, 103174, 133678, 164182, 194686 |
| 4647 | ADF83915 | 4647 | 35151 | 65655, 96159, 126663, 157167, 187671 | 11663 | AHL98985 | 11663 | 42167 | 72671, 103175, 133679, 164183, 194687 |
| 4648 | ADF84441 | 4648 | 35152 | 65656, 96160, 126664, 157168, 187672 | 11664 | AHL98997 | 11664 | 42168 | 72672, 103176, 133680, 164184, 194688 |
| 4649 | ADF84459 | 4649 | 35153 | 65657, 96161, 126665, 157169, 187673 | 11665 | AHL99009 | 11665 | 42169 | 72673, 103177, 133681, 164185, 194689 |
| 4650 | ADF84469 | 4650 | 35154 | 65658, 96162, 126666, 157170, 187674 | 11666 | AHL99021 | 11666 | 42170 | 72674, 103178, 133682, 164186, 194690 |
| 4651 | ADF84479 | 4651 | 35155 | 65659, 96163, 126667, 157171, 187675 | 11667 | AHL99045 | 11667 | 42171 | 72675, 103179, 133683, 164187, 194691 |
| 4652 | ADF84489 | 4652 | 35156 | 65660, 96164, 126668, 157172, 187676 | 11668 | AHL99057 | 11668 | 42172 | 72676, 103180, 133684, 164188, 194692 |
| 4653 | ADF85017 | 4653 | 35157 | 65661, 96165, 126669, 157173, 187677 | 11669 | AHL99069 | 11669 | 42173 | 72677, 103181, 133685, 164189, 194693 |
| 4654 | ADF87152 | 4654 | 35158 | 65662, 96166, 126670, 157174, 187678 | 11670 | AHL99081 | 11670 | 42174 | 72678, 103182, 133686, 164190, 194694 |
| 4655 | ADF87162 | 4655 | 35159 | 65663, 96167, 126671, 157175, 187679 | 11671 | AHL99093 | 11671 | 42175 | 72679, 103183, 133687, 164191, 194695 |

FIG. 1 continued

| | | | | | | | | | |
|---|---|---|---|---|---|---|---|---|---|
| 4656 | ADF87172 | 4656 | 35160 | 65664, 96168, 126672, 157176, 187680 | 11672 | AHL99117 | 11672 | 42176 | 72680, 103184, 133688, 164192, 194696 |
| 4657 | ADF87182 | 4657 | 35161 | 65665, 96169, 126673, 157177, 187681 | 11673 | AHL99129 | 11673 | 42177 | 72681, 103185, 133689, 164193, 194697 |
| 4658 | ADF87192 | 4658 | 35162 | 65666, 96170, 126674, 157178, 187682 | 11674 | AHL99141 | 11674 | 42178 | 72682, 103186, 133690, 164194, 194698 |
| 4659 | ADF87202 | 4659 | 35163 | 65667, 96171, 126675, 157179, 187683 | 11675 | AHL99153 | 11675 | 42179 | 72683, 103187, 133691, 164195, 194699 |
| 4660 | ADF87212 | 4660 | 35164 | 65668, 96172, 126676, 157180, 187684 | 11676 | AHL99165 | 11676 | 42180 | 72684, 103188, 133692, 164196, 194700 |
| 4661 | ADF87232 | 4661 | 35165 | 65669, 96173, 126677, 157181, 187685 | 11677 | AHL99177 | 11677 | 42181 | 72685, 103189, 133693, 164197, 194701 |
| 4662 | ADF87242 | 4662 | 35166 | 65670, 96174, 126678, 157182, 187686 | 11678 | AHL99189 | 11678 | 42182 | 72686, 103190, 133694, 164198, 194702 |
| 4663 | ADF87252 | 4663 | 35167 | 65671, 96175, 126679, 157183, 187687 | 11679 | AHL99225 | 11679 | 42183 | 72687, 103191, 133695, 164199, 194703 |
| 4664 | ADF87262 | 4664 | 35168 | 65672, 96176, 126680, 157184, 187688 | 11680 | AHL99237 | 11680 | 42184 | 72688, 103192, 133696, 164200, 194704 |
| 4665 | ADF87272 | 4665 | 35169 | 65673, 96177, 126681, 157185, 187689 | 11681 | AHL99249 | 11681 | 42185 | 72689, 103193, 133697, 164201, 194705 |
| 4666 | ADF87282 | 4666 | 35170 | 65674, 96178, 126682, 157186, 187690 | 11682 | AHL99261 | 11682 | 42186 | 72690, 103194, 133698, 164202, 194706 |
| 4667 | ADF87292 | 4667 | 35171 | 65675, 96179, 126683, 157187, 187691 | 11683 | AHL99273 | 11683 | 42187 | 72691, 103195, 133699, 164203, 194707 |
| 4668 | ADF87302 | 4668 | 35172 | 65676, 96180, 126684, 157188, 187692 | 11684 | AHL99285 | 11684 | 42188 | 72692, 103196, 133700, 164204, 194708 |
| 4669 | ADF87331 | 4669 | 35173 | 65677, 96181, 126685, 157189, 187693 | 11685 | AHL99297 | 11685 | 42189 | 72693, 103197, 133701, 164205, 194709 |
| 4670 | ADF87341 | 4670 | 35174 | 65678, 96182, 126686, 157190, 187694 | 11686 | AHL99309 | 11686 | 42190 | 72694, 103198, 133702, 164206, 194710 |
| 4671 | ADF87351 | 4671 | 35175 | 65679, 96183, 126687, 157191, 187695 | 11687 | AHL99321 | 11687 | 42191 | 72695, 103199, 133703, 164207, 194711 |
| 4672 | ADF87361 | 4672 | 35176 | 65680, 96184, 126688, 157192, 187696 | 11688 | AHL99333 | 11688 | 42192 | 72696, 103200, 133704, 164208, 194712 |
| 4673 | ADF87371 | 4673 | 35177 | 65681, 96185, 126689, 157193, 187697 | 11689 | AHL99356 | 11689 | 42193 | 72697, 103201, 133705, 164209, 194713 |

FIG. 1 continued

| | | | | | | | | | |
|---|---|---|---|---|---|---|---|---|---|
| 4674 | ADG08115 | 4674 | 35178 | 65682, 96186, 126690, 157194, 187698 | 11690 | AHL99367 | 11690 | 42194 | 72698, 103202, 133706, 164210, 194714 |
| 4675 | ADG21004 | 4675 | 35179 | 65683, 96187, 126691, 157195, 187699 | 11691 | AHL99379 | 11691 | 42195 | 72699, 103203, 133707, 164211, 194715 |
| 4676 | ADG21006 | 4676 | 35180 | 65684, 96188, 126692, 157196, 187700 | 11692 | AHL99390 | 11692 | 42196 | 72700, 103204, 133708, 164212, 194716 |
| 4677 | ADG21008 | 4677 | 35181 | 65685, 96189, 126693, 157197, 187701 | 11693 | AHL99402 | 11693 | 42197 | 72701, 103205, 133709, 164213, 194717 |
| 4678 | ADG21009 | 4678 | 35182 | 65686, 96190, 126694, 157198, 187702 | 11694 | AHL99426 | 11694 | 42198 | 72702, 103206, 133710, 164214, 194718 |
| 4679 | ADG21010 | 4679 | 35183 | 65687, 96191, 126695, 157199, 187703 | 11695 | AHL99438 | 11695 | 42199 | 72703, 103207, 133711, 164215, 194719 |
| 4680 | ADG21011 | 4680 | 35184 | 65688, 96192, 126696, 157200, 187704 | 11696 | AHL99450 | 11696 | 42200 | 72704, 103208, 133712, 164216, 194720 |
| 4681 | ADG21012 | 4681 | 35185 | 65689, 96193, 126697, 157201, 187705 | 11697 | AHL99462 | 11697 | 42201 | 72705, 103209, 133713, 164217, 194721 |
| 4682 | ADG21013 | 4682 | 35186 | 65690, 96194, 126698, 157202, 187706 | 11698 | AHL99474 | 11698 | 42202 | 72706, 103210, 133714, 164218, 194722 |
| 4683 | ADG21014 | 4683 | 35187 | 65691, 96195, 126699, 157203, 187707 | 11699 | AHL99486 | 11699 | 42203 | 72707, 103211, 133715, 164219, 194723 |
| 4684 | ADG21017 | 4684 | 35188 | 65692, 96196, 126700, 157204, 187708 | 11700 | AHL99498 | 11700 | 42204 | 72708, 103212, 133716, 164220, 194724 |
| 4685 | ADG21018 | 4685 | 35189 | 65693, 96197, 126701, 157205, 187709 | 11701 | AHL99510 | 11701 | 42205 | 72709, 103213, 133717, 164221, 194725 |
| 4686 | ADG21019 | 4686 | 35190 | 65694, 96198, 126702, 157206, 187710 | 11702 | AHL99522 | 11702 | 42206 | 72710, 103214, 133718, 164222, 194726 |
| 4687 | ADG21020 | 4687 | 35191 | 65695, 96199, 126703, 157207, 187711 | 11703 | AHL99534 | 11703 | 42207 | 72711, 103215, 133719, 164223, 194727 |
| 4688 | ADG21022 | 4688 | 35192 | 65696, 96200, 126704, 157208, 187712 | 11704 | AHL99546 | 11704 | 42208 | 72712, 103216, 133720, 164224, 194728 |
| 4689 | ADG21023 | 4689 | 35193 | 65697, 96201, 126705, 157209, 187713 | 11705 | AHL99558 | 11705 | 42209 | 72713, 103217, 133721, 164225, 194729 |
| 4690 | ADG21024 | 4690 | 35194 | 65698, 96202, 126706, 157210, 187714 | 11706 | AHL99570 | 11706 | 42210 | 72714, 103218, 133722, 164226, 194730 |
| 4691 | ADG21026 | 4691 | 35195 | 65699, 96203, 126707, 157211, 187715 | 11707 | AHL99582 | 11707 | 42211 | 72715, 103219, 133723, 164227, 194731 |

FIG. 1 continued

| | | | | | | | | | |
|---|---|---|---|---|---|---|---|---|---|
| 4692 | ADG21037 | 4692 | 35196 | 65700, 96204, 126708, 157212, 187716 | 11708 | AHL99594 | 11708 | 42212 | 72716, 103220, 133724, 164228, 194732 |
| 4693 | ADG21038 | 4693 | 35197 | 65701, 96205, 126709, 157213, 187717 | 11709 | AHL99605 | 11709 | 42213 | 72717, 103221, 133725, 164229, 194733 |
| 4694 | ADG21040 | 4694 | 35198 | 65702, 96206, 126710, 157214, 187718 | 11710 | AHL99617 | 11710 | 42214 | 72718, 103222, 133726, 164230, 194734 |
| 4695 | ADG21041 | 4695 | 35199 | 65703, 96207, 126711, 157215, 187719 | 11711 | AHL99629 | 11711 | 42215 | 72719, 103223, 133727, 164231, 194735 |
| 4696 | ADG21042 | 4696 | 35200 | 65704, 96208, 126712, 157216, 187720 | 11712 | AHL99641 | 11712 | 42216 | 72720, 103224, 133728, 164232, 194736 |
| 4697 | ADG21043 | 4697 | 35201 | 65705, 96209, 126713, 157217, 187721 | 11713 | AHL99665 | 11713 | 42217 | 72721, 103225, 133729, 164233, 194737 |
| 4698 | ADG21045 | 4698 | 35202 | 65706, 96210, 126714, 157218, 187722 | 11714 | AHL99677 | 11714 | 42218 | 72722, 103226, 133730, 164234, 194738 |
| 4699 | ADG21046 | 4699 | 35203 | 65707, 96211, 126715, 157219, 187723 | 11715 | AHL99689 | 11715 | 42219 | 72723, 103227, 133731, 164235, 194739 |
| 4700 | ADG21048 | 4700 | 35204 | 65708, 96212, 126716, 157220, 187724 | 11716 | AHL99701 | 11716 | 42220 | 72724, 103228, 133732, 164236, 194740 |
| 4701 | ADG21049 | 4701 | 35205 | 65709, 96213, 126717, 157221, 187725 | 11717 | AHL99713 | 11717 | 42221 | 72725, 103229, 133733, 164237, 194741 |
| 4702 | ADG21122 | 4702 | 35206 | 65710, 96214, 126718, 157222, 187726 | 11718 | AHL99725 | 11718 | 42222 | 72726, 103230, 133734, 164238, 194742 |
| 4703 | ADG21123 | 4703 | 35207 | 65711, 96215, 126719, 157223, 187727 | 11719 | AHL99737 | 11719 | 42223 | 72727, 103231, 133735, 164239, 194743 |
| 4704 | ADG21124 | 4704 | 35208 | 65712, 96216, 126720, 157224, 187728 | 11720 | AHL99748 | 11720 | 42224 | 72728, 103232, 133736, 164240, 194744 |
| 4705 | ADG21125 | 4705 | 35209 | 65713, 96217, 126721, 157225, 187729 | 11721 | AHL99760 | 11721 | 42225 | 72729, 103233, 133737, 164241, 194745 |
| 4706 | ADG21126 | 4706 | 35210 | 65714, 96218, 126722, 157226, 187730 | 11722 | AHL99772 | 11722 | 42226 | 72730, 103234, 133738, 164242, 194746 |
| 4707 | ADG21127 | 4707 | 35211 | 65715, 96219, 126723, 157227, 187731 | 11723 | AHL99784 | 11723 | 42227 | 72731, 103235, 133739, 164243, 194747 |
| 4708 | ADG21128 | 4708 | 35212 | 65716, 96220, 126724, 157228, 187732 | 11724 | AHL99796 | 11724 | 42228 | 72732, 103236, 133740, 164244, 194748 |
| 4709 | ADG21129 | 4709 | 35213 | 65717, 96221, 126725, 157229, 187733 | 11725 | AHL99808 | 11725 | 42229 | 72733, 103237, 133741, 164245, 194749 |

FIG. 1 continued

| | | | | | | | | | |
|---|---|---|---|---|---|---|---|---|---|
| 4710 | ADG21130 | 4710 | 35214 | 65718, 96222, 126726, 157230, 187734 | 11726 | AHL99820 | 11726 | 42230 | 72734, 103238, 133742, 164246, 194750 |
| 4711 | ADG21131 | 4711 | 35215 | 65719, 96223, 126727, 157231, 187735 | 11727 | AHL99832 | 11727 | 42231 | 72735, 103239, 133743, 164247, 194751 |
| 4712 | ADG21132 | 4712 | 35216 | 65720, 96224, 126728, 157232, 187736 | 11728 | AHL99844 | 11728 | 42232 | 72736, 103240, 133744, 164248, 194752 |
| 4713 | ADG21133 | 4713 | 35217 | 65721, 96225, 126729, 157233, 187737 | 11729 | AHL99856 | 11729 | 42233 | 72737, 103241, 133745, 164249, 194753 |
| 4714 | ADG21134 | 4714 | 35218 | 65722, 96226, 126730, 157234, 187738 | 11730 | AHL99868 | 11730 | 42234 | 72738, 103242, 133746, 164250, 194754 |
| 4715 | ADG21135 | 4715 | 35219 | 65723, 96227, 126731, 157235, 187739 | 11731 | AHL99880 | 11731 | 42235 | 72739, 103243, 133747, 164251, 194755 |
| 4716 | ADG21136 | 4716 | 35220 | 65724, 96228, 126732, 157236, 187740 | 11732 | AHL99892 | 11732 | 42236 | 72740, 103244, 133748, 164252, 194756 |
| 4717 | ADG21137 | 4717 | 35221 | 65725, 96229, 126733, 157237, 187741 | 11733 | AHL99904 | 11733 | 42237 | 72741, 103245, 133749, 164253, 194757 |
| 4718 | ADG21138 | 4718 | 35222 | 65726, 96230, 126734, 157238, 187742 | 11734 | AHL99916 | 11734 | 42238 | 72742, 103246, 133750, 164254, 194758 |
| 4719 | ADG21139 | 4719 | 35223 | 65727, 96231, 126735, 157239, 187743 | 11735 | AHL99928 | 11735 | 42239 | 72743, 103247, 133751, 164255, 194759 |
| 4720 | ADG21140 | 4720 | 35224 | 65728, 96232, 126736, 157240, 187744 | 11736 | AHL99940 | 11736 | 42240 | 72744, 103248, 133752, 164256, 194760 |
| 4721 | ADG21141 | 4721 | 35225 | 65729, 96233, 126737, 157241, 187745 | 11737 | AHL99952 | 11737 | 42241 | 72745, 103249, 133753, 164257, 194761 |
| 4722 | ADG21142 | 4722 | 35226 | 65730, 96234, 126738, 157242, 187746 | 11738 | AHL99964 | 11738 | 42242 | 72746, 103250, 133754, 164258, 194762 |
| 4723 | ADG21143 | 4723 | 35227 | 65731, 96235, 126739, 157243, 187747 | 11739 | AHL99976 | 11739 | 42243 | 72747, 103251, 133755, 164259, 194763 |
| 4724 | ADG21144 | 4724 | 35228 | 65732, 96236, 126740, 157244, 187748 | 11740 | AHL99988 | 11740 | 42244 | 72748, 103252, 133756, 164260, 194764 |
| 4725 | ADG21145 | 4725 | 35229 | 65733, 96237, 126741, 157245, 187749 | 11741 | AHM00001 | 11741 | 42245 | 72749, 103253, 133757, 164261, 194765 |
| 4726 | ADG21146 | 4726 | 35230 | 65734, 96238, 126742, 157246, 187750 | 11742 | AHM00013 | 11742 | 42246 | 72750, 103254, 133758, 164262, 194766 |
| 4727 | ADG21147 | 4727 | 35231 | 65735, 96239, 126743, 157247, 187751 | 11743 | AHM00025 | 11743 | 42247 | 72751, 103255, 133759, 164263, 194767 |

FIG. 1 continued

| | | | | | | | | | |
|---|---|---|---|---|---|---|---|---|---|
| 4728 | ADG21148 | 4728 | 35232 | 65736, 96240, 126744, 157248, 187752 | 11744 | AHM00037 | 11744 | 42248 | 72752, 103256, 133760, 164264, 194768 |
| 4729 | ADG21149 | 4729 | 35233 | 65737, 96241, 126745, 157249, 187753 | 11745 | AHM00061 | 11745 | 42249 | 72753, 103257, 133761, 164265, 194769 |
| 4730 | ADG21150 | 4730 | 35234 | 65738, 96242, 126746, 157250, 187754 | 11746 | AHM00073 | 11746 | 42250 | 72754, 103258, 133762, 164266, 194770 |
| 4731 | ADG21151 | 4731 | 35235 | 65739, 96243, 126747, 157251, 187755 | 11747 | AHM00085 | 11747 | 42251 | 72755, 103259, 133763, 164267, 194771 |
| 4732 | ADG21152 | 4732 | 35236 | 65740, 96244, 126748, 157252, 187756 | 11748 | AHM00097 | 11748 | 42252 | 72756, 103260, 133764, 164268, 194772 |
| 4733 | ADG21153 | 4733 | 35237 | 65741, 96245, 126749, 157253, 187757 | 11749 | AHM00108 | 11749 | 42253 | 72757, 103261, 133765, 164269, 194773 |
| 4734 | ADG21154 | 4734 | 35238 | 65742, 96246, 126750, 157254, 187758 | 11750 | AHM00120 | 11750 | 42254 | 72758, 103262, 133766, 164270, 194774 |
| 4735 | ADG21155 | 4735 | 35239 | 65743, 96247, 126751, 157255, 187759 | 11751 | AHM00132 | 11751 | 42255 | 72759, 103263, 133767, 164271, 194775 |
| 4736 | ADG21156 | 4736 | 35240 | 65744, 96248, 126752, 157256, 187760 | 11752 | AHM00144 | 11752 | 42256 | 72760, 103264, 133768, 164272, 194776 |
| 4737 | ADG21158 | 4737 | 35241 | 65745, 96249, 126753, 157257, 187761 | 11753 | AHM00156 | 11753 | 42257 | 72761, 103265, 133769, 164273, 194777 |
| 4738 | ADG21159 | 4738 | 35242 | 65746, 96250, 126754, 157258, 187762 | 11754 | AHM00168 | 11754 | 42258 | 72762, 103266, 133770, 164274, 194778 |
| 4739 | ADG21160 | 4739 | 35243 | 65747, 96251, 126755, 157259, 187763 | 11755 | AHM00180 | 11755 | 42259 | 72763, 103267, 133771, 164275, 194779 |
| 4740 | ADG21161 | 4740 | 35244 | 65748, 96252, 126756, 157260, 187764 | 11756 | AHM00192 | 11756 | 42260 | 72764, 103268, 133772, 164276, 194780 |
| 4741 | ADG21163 | 4741 | 35245 | 65749, 96253, 126757, 157261, 187765 | 11757 | AHM00204 | 11757 | 42261 | 72765, 103269, 133773, 164277, 194781 |
| 4742 | ADG21165 | 4742 | 35246 | 65750, 96254, 126758, 157262, 187766 | 11758 | AHM00216 | 11758 | 42262 | 72766, 103270, 133774, 164278, 194782 |
| 4743 | ADG21166 | 4743 | 35247 | 65751, 96255, 126759, 157263, 187767 | 11759 | AHM00228 | 11759 | 42263 | 72767, 103271, 133775, 164279, 194783 |
| 4744 | ADG21168 | 4744 | 35248 | 65752, 96256, 126760, 157264, 187768 | 11760 | AHM00240 | 11760 | 42264 | 72768, 103272, 133776, 164280, 194784 |
| 4745 | ADG21169 | 4745 | 35249 | 65753, 96257, 126761, 157265, 187769 | 11761 | AHM00252 | 11761 | 42265 | 72769, 103273, 133777, 164281, 194785 |

FIG. 1 continued

| | | | | | | | | | |
|---|---|---|---|---|---|---|---|---|---|
| 4746 | ADG21170 | 4746 | 35250 | 65754, 96258, 126762, 157266, 187770 | 11762 | AHM00264 | 11762 | 42266 | 72270, 103274, 133778, 164282, 194786 |
| 4747 | ADG21173 | 4747 | 35251 | 65755, 96259, 126763, 157267, 187771 | 11763 | AHM00276 | 11763 | 42267 | 72271, 103275, 133779, 164283, 194787 |
| 4748 | ADG21174 | 4748 | 35252 | 65756, 96260, 126764, 157268, 187772 | 11764 | AHM00288 | 11764 | 42268 | 72272, 103276, 133780, 164284, 194788 |
| 4749 | ADG21175 | 4749 | 35253 | 65757, 96261, 126765, 157269, 187773 | 11765 | AHM00300 | 11765 | 42269 | 72273, 103277, 133781, 164285, 194789 |
| 4750 | ADG21176 | 4750 | 35254 | 65758, 96262, 126766, 157270, 187774 | 11766 | AHM00312 | 11766 | 42270 | 72274, 103278, 133782, 164286, 194790 |
| 4751 | ADG21177 | 4751 | 35255 | 65759, 96263, 126767, 157271, 187775 | 11767 | AHM00324 | 11767 | 42271 | 72275, 103279, 133783, 164287, 194791 |
| 4752 | ADG21178 | 4752 | 35256 | 65760, 96264, 126768, 157272, 187776 | 11768 | AHM00336 | 11768 | 42272 | 72276, 103280, 133784, 164288, 194792 |
| 4753 | ADG21179 | 4753 | 35257 | 65761, 96265, 126769, 157273, 187777 | 11769 | AHM00348 | 11769 | 42273 | 72277, 103281, 133785, 164289, 194793 |
| 4754 | ADG21180 | 4754 | 35258 | 65762, 96266, 126770, 157274, 187778 | 11770 | AHM00360 | 11770 | 42274 | 72278, 103282, 133786, 164290, 194794 |
| 4755 | ADG21181 | 4755 | 35259 | 65763, 96267, 126771, 157275, 187779 | 11771 | AHM00372 | 11771 | 42275 | 72279, 103283, 133787, 164291, 194795 |
| 4756 | ADG21182 | 4756 | 35260 | 65764, 96268, 126772, 157276, 187780 | 11772 | AHM00395 | 11772 | 42276 | 72280, 103284, 133788, 164292, 194796 |
| 4757 | ADG21183 | 4757 | 35261 | 65765, 96269, 126773, 157277, 187781 | 11773 | AHM00407 | 11773 | 42277 | 72281, 103285, 133789, 164293, 194797 |
| 4758 | ADG21184 | 4758 | 35262 | 65766, 96270, 126774, 157278, 187782 | 11774 | AHM00419 | 11774 | 42278 | 72282, 103286, 133790, 164294, 194798 |
| 4759 | ADG21185 | 4759 | 35263 | 65767, 96271, 126775, 157279, 187783 | 11775 | AHM00443 | 11775 | 42279 | 72283, 103287, 133791, 164295, 194799 |
| 4760 | ADG21188 | 4760 | 35264 | 65768, 96272, 126776, 157280, 187784 | 11776 | AHM00455 | 11776 | 42280 | 72284, 103288, 133792, 164296, 194800 |
| 4761 | ADG21402 | 4761 | 35265 | 65769, 96273, 126777, 157281, 187785 | 11777 | AHM00467 | 11777 | 42281 | 72285, 103289, 133793, 164297, 194801 |
| 4762 | ADG21414 | 4762 | 35266 | 65770, 96274, 126778, 157282, 187786 | 11778 | AHM00479 | 11778 | 42282 | 72286, 103290, 133794, 164298, 194802 |
| 4763 | ADG21416 | 4763 | 35267 | 65771, 96275, 126779, 157283, 187787 | 11779 | AHM00491 | 11779 | 42283 | 72287, 103291, 133795, 164299, 194803 |

FIG. 1 continued

| | | | | | | | | | |
|---|---|---|---|---|---|---|---|---|---|
| 4764 | ADG21420 | 4764 | 35268 | 65772, 96276, 126780, 157284, 187788 | 11780 | AHM00503 | 11780 | 42284 | 72788, 103292, 133796, 164300, 194804 |
| 4765 | ADG21422 | 4765 | 35269 | 65773, 96277, 126781, 157285, 187789 | 11781 | AHM00515 | 11781 | 42285 | 72789, 103293, 133797, 164301, 194805 |
| 4766 | ADG21425 | 4766 | 35270 | 65774, 96278, 126782, 157286, 187790 | 11782 | AHM00527 | 11782 | 42286 | 72790, 103294, 133798, 164302, 194806 |
| 4767 | ADG21429 | 4767 | 35271 | 65775, 96279, 126783, 157287, 187791 | 11783 | AHM00539 | 11783 | 42287 | 72791, 103295, 133799, 164303, 194807 |
| 4768 | ADG21437 | 4768 | 35272 | 65776, 96280, 126784, 157288, 187792 | 11784 | AHM00543 | 11784 | 42288 | 72792, 103296, 133800, 164304, 194808 |
| 4769 | ADG21439 | 4769 | 35273 | 65777, 96281, 126785, 157289, 187793 | 11785 | AHM00555 | 11785 | 42289 | 72793, 103297, 133801, 164305, 194809 |
| 4770 | ADG21441 | 4770 | 35274 | 65778, 96282, 126786, 157290, 187794 | 11786 | AHM00567 | 11786 | 42290 | 72794, 103298, 133802, 164306, 194810 |
| 4771 | ADG21443 | 4771 | 35275 | 65779, 96283, 126787, 157291, 187795 | 11787 | AHM00579 | 11787 | 42291 | 72795, 103299, 133803, 164307, 194811 |
| 4772 | ADG21445 | 4772 | 35276 | 65780, 96284, 126788, 157292, 187796 | 11788 | AHM00591 | 11788 | 42292 | 72796, 103300, 133804, 164308, 194812 |
| 4773 | ADG21912 | 4773 | 35277 | 65781, 96285, 126789, 157293, 187797 | 11789 | AHM00603 | 11789 | 42293 | 72797, 103301, 133805, 164309, 194813 |
| 4774 | ADG21913 | 4774 | 35278 | 65782, 96286, 126790, 157294, 187798 | 11790 | AHM00615 | 11790 | 42294 | 72798, 103302, 133806, 164310, 194814 |
| 4775 | ADG21914 | 4775 | 35279 | 65783, 96287, 126791, 157295, 187799 | 11791 | AHM00627 | 11791 | 42295 | 72799, 103303, 133807, 164311, 194815 |
| 4776 | ADG21915 | 4776 | 35280 | 65784, 96288, 126792, 157296, 187800 | 11792 | AHM00639 | 11792 | 42296 | 72800, 103304, 133808, 164312, 194816 |
| 4777 | ADG21916 | 4777 | 35281 | 65785, 96289, 126793, 157297, 187801 | 11793 | AHM00651 | 11793 | 42297 | 72801, 103305, 133809, 164313, 194817 |
| 4778 | ADG21917 | 4778 | 35282 | 65786, 96290, 126794, 157298, 187802 | 11794 | AHM00663 | 11794 | 42298 | 72802, 103306, 133810, 164314, 194818 |
| 4779 | ADG21918 | 4779 | 35283 | 65787, 96291, 126795, 157299, 187803 | 11795 | AHM00675 | 11795 | 42299 | 72803, 103307, 133811, 164315, 194819 |
| 4780 | ADG21919 | 4780 | 35284 | 65788, 96292, 126796, 157300, 187804 | 11796 | AHM00687 | 11796 | 42300 | 72804, 103308, 133812, 164316, 194820 |
| 4781 | ADG21921 | 4781 | 35285 | 65789, 96293, 126797, 157301, 187805 | 11797 | AHM00698 | 11797 | 42301 | 72805, 103309, 133813, 164317, 194821 |

FIG. 1 continued

| | | | | | | | | | |
|---|---|---|---|---|---|---|---|---|---|
| 4782 | ADG21922 | 4782 | 35286 | 65790, 96294, 126798, 157302, 187806 | 11798 | AHM00710 | 11798 | 42302 | 72806, 103310, 133814, 164318, 194822 |
| 4783 | ADG21923 | 4783 | 35287 | 65791, 96295, 126799, 157303, 187807 | 11799 | AHM00722 | 11799 | 42303 | 72807, 103311, 133815, 164319, 194823 |
| 4784 | ADG21924 | 4784 | 35288 | 65792, 96296, 126800, 157304, 187808 | 11800 | AHM00734 | 11800 | 42304 | 72808, 103312, 133816, 164320, 194824 |
| 4785 | ADG21925 | 4785 | 35289 | 65793, 96297, 126801, 157305, 187809 | 11801 | AHM00746 | 11801 | 42305 | 72809, 103313, 133817, 164321, 194825 |
| 4786 | ADG21926 | 4786 | 35290 | 65794, 96298, 126802, 157306, 187810 | 11802 | AHM00758 | 11802 | 42306 | 72810, 103314, 133818, 164322, 194826 |
| 4787 | ADG21927 | 4787 | 35291 | 65795, 96299, 126803, 157307, 187811 | 11803 | AHM00770 | 11803 | 42307 | 72811, 103315, 133819, 164323, 194827 |
| 4788 | ADG21928 | 4788 | 35292 | 65796, 96300, 126804, 157308, 187812 | 11804 | AHM00782 | 11804 | 42308 | 72812, 103316, 133820, 164324, 194828 |
| 4789 | ADG21930 | 4789 | 35293 | 65797, 96301, 126805, 157309, 187813 | 11805 | AHM00794 | 11805 | 42309 | 72813, 103317, 133821, 164325, 194829 |
| 4790 | ADG21931 | 4790 | 35294 | 65798, 96302, 126806, 157310, 187814 | 11806 | AHM00806 | 11806 | 42310 | 72814, 103318, 133822, 164326, 194830 |
| 4791 | ADG21932 | 4791 | 35295 | 65799, 96303, 126807, 157311, 187815 | 11807 | AHM00818 | 11807 | 42311 | 72815, 103319, 133823, 164327, 194831 |
| 4792 | ADG21933 | 4792 | 35296 | 65800, 96304, 126808, 157312, 187816 | 11808 | AHM00830 | 11808 | 42312 | 72816, 103320, 133824, 164328, 194832 |
| 4793 | ADG21934 | 4793 | 35297 | 65801, 96305, 126809, 157313, 187817 | 11809 | AHM00842 | 11809 | 42313 | 72817, 103321, 133825, 164329, 194833 |
| 4794 | ADG21935 | 4794 | 35298 | 65802, 96306, 126810, 157314, 187818 | 11810 | AHM00854 | 11810 | 42314 | 72818, 103322, 133826, 164330, 194834 |
| 4795 | ADG21936 | 4795 | 35299 | 65803, 96307, 126811, 157315, 187819 | 11811 | AHM00866 | 11811 | 42315 | 72819, 103323, 133827, 164331, 194835 |
| 4796 | ADG21937 | 4796 | 35300 | 65804, 96308, 126812, 157316, 187820 | 11812 | AHM00878 | 11812 | 42316 | 72820, 103324, 133828, 164332, 194836 |
| 4797 | ADG21938 | 4797 | 35301 | 65805, 96309, 126813, 157317, 187821 | 11813 | AHM00890 | 11813 | 42317 | 72821, 103325, 133829, 164333, 194837 |
| 4798 | ADG21939 | 4798 | 35302 | 65806, 96310, 126814, 157318, 187822 | 11814 | AHM00902 | 11814 | 42318 | 72822, 103326, 133830, 164334, 194838 |
| 4799 | ADG21940 | 4799 | 35303 | 65807, 96311, 126815, 157319, 187823 | 11815 | AHM00914 | 11815 | 42319 | 72823, 103327, 133831, 164335, 194839 |

FIG. 1 continued

| | | | | | | | | | |
|---|---|---|---|---|---|---|---|---|---|
| 4800 | ADG21941 | 4800 | 35304 | 65808, 96312, 126816, 157320, 187824 | 11816 | AHM00926 | 11816 | 42320 | 72824, 103328, 133832, 164336, 194840 |
| 4801 | ADG21943 | 4801 | 35305 | 65809, 96313, 126817, 157321, 187825 | 11817 | AHM00938 | 11817 | 42321 | 72825, 103329, 133833, 164337, 194841 |
| 4802 | ADG21944 | 4802 | 35306 | 65810, 96314, 126818, 157322, 187826 | 11818 | AHM00950 | 11818 | 42322 | 72826, 103330, 133834, 164338, 194842 |
| 4803 | ADG21945 | 4803 | 35307 | 65811, 96315, 126819, 157323, 187827 | 11819 | AHM00962 | 11819 | 42323 | 72827, 103331, 133835, 164339, 194843 |
| 4804 | ADG21946 | 4804 | 35308 | 65812, 96316, 126820, 157324, 187828 | 11820 | AHM00974 | 11820 | 42324 | 72828, 103332, 133836, 164340, 194844 |
| 4805 | ADG21947 | 4805 | 35309 | 65813, 96317, 126821, 157325, 187829 | 11821 | AHM24224 | 11821 | 42325 | 72829, 103333, 133837, 164341, 194845 |
| 4806 | ADG21948 | 4806 | 35310 | 65814, 96318, 126822, 157326, 187830 | 11822 | AHM24236 | 11822 | 42326 | 72830, 103334, 133838, 164342, 194846 |
| 4807 | ADG27794 | 4807 | 35311 | 65815, 96319, 126823, 157327, 187831 | 11823 | AHM24248 | 11823 | 42327 | 72831, 103335, 133839, 164343, 194847 |
| 4808 | ADG27948 | 4808 | 35312 | 65816, 96320, 126824, 157328, 187832 | 11824 | AHM98309 | 11824 | 42328 | 72832, 103336, 133840, 164344, 194848 |
| 4809 | ADG27966 | 4809 | 35313 | 65817, 96321, 126825, 157329, 187833 | 11825 | AHM98339 | 11825 | 42329 | 72833, 103337, 133841, 164345, 194849 |
| 4810 | ADG27974 | 4810 | 35314 | 65818, 96322, 126826, 157330, 187834 | 11826 | AHM98350 | 11826 | 42330 | 72834, 103338, 133842, 164346, 194850 |
| 4811 | ADG27982 | 4811 | 35315 | 65819, 96323, 126827, 157331, 187835 | 11827 | AHM98361 | 11827 | 42331 | 72835, 103339, 133843, 164347, 194851 |
| 4812 | ADG27988 | 4812 | 35316 | 65820, 96324, 126828, 157332, 187836 | 11828 | AHM98372 | 11828 | 42332 | 72836, 103340, 133844, 164348, 194852 |
| 4813 | ADG27997 | 4813 | 35317 | 65821, 96325, 126829, 157333, 187837 | 11829 | AHM98383 | 11829 | 42333 | 72837, 103341, 133845, 164349, 194853 |
| 4814 | ADG28011 | 4814 | 35318 | 65822, 96326, 126830, 157334, 187838 | 11830 | AHM98394 | 11830 | 42334 | 72838, 103342, 133846, 164350, 194854 |
| 4815 | ADG42093 | 4815 | 35319 | 65823, 96327, 126831, 157335, 187839 | 11831 | AHM98405 | 11831 | 42335 | 72839, 103343, 133847, 164351, 194855 |
| 4816 | ADG42103 | 4816 | 35320 | 65824, 96328, 126832, 157336, 187840 | 11832 | AHM98416 | 11832 | 42336 | 72840, 103344, 133848, 164352, 194856 |
| 4817 | ADG42113 | 4817 | 35321 | 65825, 96329, 126833, 157337, 187841 | 11833 | AHM98427 | 11833 | 42337 | 72841, 103345, 133849, 164353, 194857 |

FIG. 1 continued

| | | | | | | | | | |
|---|---|---|---|---|---|---|---|---|---|
| 4818 | ADG42123 | 4818 | 35322 | 65826, 96330, 126834, 157338, 187842 | 11834 | AHM98438 | 11834 | 42338 | 72842, 103346, 133850, 164354, 194858 |
| 4819 | ADG42133 | 4819 | 35323 | 65827, 96331, 126835, 157339, 187843 | 11835 | AHM98449 | 11835 | 42339 | 72843, 103347, 133851, 164355, 194859 |
| 4820 | ADG42143 | 4820 | 35324 | 65828, 96332, 126836, 157340, 187844 | 11836 | AHM98460 | 11836 | 42340 | 72844, 103348, 133852, 164356, 194860 |
| 4821 | ADG42153 | 4821 | 35325 | 65829, 96333, 126837, 157341, 187845 | 11837 | AHM98471 | 11837 | 42341 | 72845, 103349, 133853, 164357, 194861 |
| 4822 | ADG42193 | 4822 | 35326 | 65830, 96334, 126838, 157342, 187846 | 11838 | AHM98482 | 11838 | 42342 | 72846, 103350, 133854, 164358, 194862 |
| 4823 | ADG42213 | 4823 | 35327 | 65831, 96335, 126839, 157343, 187847 | 11839 | AHM98493 | 11839 | 42343 | 72847, 103351, 133855, 164359, 194863 |
| 4824 | ADG42233 | 4824 | 35328 | 65832, 96336, 126840, 157344, 187848 | 11840 | AHM98504 | 11840 | 42344 | 72848, 103352, 133856, 164360, 194864 |
| 4825 | ADG42243 | 4825 | 35329 | 65833, 96337, 126841, 157345, 187849 | 11841 | AHM98515 | 11841 | 42345 | 72849, 103353, 133857, 164361, 194865 |
| 4826 | ADG42253 | 4826 | 35330 | 65834, 96338, 126842, 157346, 187850 | 11842 | AHM98526 | 11842 | 42346 | 72850, 103354, 133858, 164362, 194866 |
| 4827 | ADG42263 | 4827 | 35331 | 65835, 96339, 126843, 157347, 187851 | 11843 | AHM98537 | 11843 | 42347 | 72851, 103355, 133859, 164363, 194867 |
| 4828 | ADG42273 | 4828 | 35332 | 65836, 96340, 126844, 157348, 187852 | 11844 | AHM98548 | 11844 | 42348 | 72852, 103356, 133860, 164364, 194868 |
| 4829 | ADG42283 | 4829 | 35333 | 65837, 96341, 126845, 157349, 187853 | 11845 | AHM98559 | 11845 | 42349 | 72853, 103357, 133861, 164365, 194869 |
| 4830 | ADG42293 | 4830 | 35334 | 65838, 96342, 126846, 157350, 187854 | 11846 | AHM98570 | 11846 | 42350 | 72854, 103358, 133862, 164366, 194870 |
| 4831 | ADG42303 | 4831 | 35335 | 65839, 96343, 126847, 157351, 187855 | 11847 | AHM98581 | 11847 | 42351 | 72855, 103359, 133863, 164367, 194871 |
| 4832 | ADG42313 | 4832 | 35336 | 65840, 96344, 126848, 157352, 187856 | 11848 | AHM98592 | 11848 | 42352 | 72856, 103360, 133864, 164368, 194872 |
| 4833 | ADG42323 | 4833 | 35337 | 65841, 96345, 126849, 157353, 187857 | 11849 | AHM98603 | 11849 | 42353 | 72857, 103361, 133865, 164369, 194873 |
| 4834 | ADG42333 | 4834 | 35338 | 65842, 96346, 126850, 157354, 187858 | 11850 | AHM98614 | 11850 | 42354 | 72858, 103362, 133866, 164370, 194874 |
| 4835 | ADG42343 | 4835 | 35339 | 65843, 96347, 126851, 157355, 187859 | 11851 | AHM98625 | 11851 | 42355 | 72859, 103363, 133867, 164371, 194875 |

FIG. 1 continued

| | | | | | | | | | |
|---|---|---|---|---|---|---|---|---|---|
| 4836 | ADG42363 | 4836 | 35340 | 65844, 96348, 126852, 157356, 187860 | 11852 | AHM98636 | 11852 | 42356 | 72860, 103364, 133868, 164372, 194876 |
| 4837 | ADG42373 | 4837 | 35341 | 65845, 96349, 126853, 157357, 187861 | 11853 | AHM98647 | 11853 | 42357 | 72861, 103365, 133869, 164373, 194877 |
| 4838 | ADG42393 | 4838 | 35342 | 65846, 96350, 126854, 157358, 187862 | 11854 | AHM98658 | 11854 | 42358 | 72862, 103366, 133870, 164374, 194878 |
| 4839 | ADG42403 | 4839 | 35343 | 65847, 96351, 126855, 157359, 187863 | 11855 | AHM98669 | 11855 | 42359 | 72863, 103367, 133871, 164375, 194879 |
| 4840 | ADG42413 | 4840 | 35344 | 65848, 96352, 126856, 157360, 187864 | 11856 | AHM98701 | 11856 | 42360 | 72864, 103368, 133872, 164376, 194880 |
| 4841 | ADG42423 | 4841 | 35345 | 65849, 96353, 126857, 157361, 187865 | 11857 | AHM98712 | 11857 | 42361 | 72865, 103369, 133873, 164377, 194881 |
| 4842 | ADG42443 | 4842 | 35346 | 65850, 96354, 126858, 157362, 187866 | 11858 | AHM98723 | 11858 | 42362 | 72866, 103370, 133874, 164378, 194882 |
| 4843 | ADG42453 | 4843 | 35347 | 65851, 96355, 126859, 157363, 187867 | 11859 | AHM98734 | 11859 | 42363 | 72867, 103371, 133875, 164379, 194883 |
| 4844 | ADG42463 | 4844 | 35348 | 65852, 96356, 126860, 157364, 187868 | 11860 | AHM98745 | 11860 | 42364 | 72868, 103372, 133876, 164380, 194884 |
| 4845 | ADG42473 | 4845 | 35349 | 65853, 96357, 126861, 157365, 187869 | 11861 | AHM98756 | 11861 | 42365 | 72869, 103373, 133877, 164381, 194885 |
| 4846 | ADG42483 | 4846 | 35350 | 65854, 96358, 126862, 157366, 187870 | 11862 | AHM98767 | 11862 | 42366 | 72870, 103374, 133878, 164382, 194886 |
| 4847 | ADG42493 | 4847 | 35351 | 65855, 96359, 126863, 157367, 187871 | 11863 | AHM98778 | 11863 | 42367 | 72871, 103375, 133879, 164383, 194887 |
| 4848 | ADG42503 | 4848 | 35352 | 65856, 96360, 126864, 157368, 187872 | 11864 | AHM98798 | 11864 | 42368 | 72872, 103376, 133880, 164384, 194888 |
| 4849 | ADG42513 | 4849 | 35353 | 65857, 96361, 126865, 157369, 187873 | 11865 | AHM98809 | 11865 | 42369 | 72873, 103377, 133881, 164385, 194889 |
| 4850 | ADG42533 | 4850 | 35354 | 65858, 96362, 126866, 157370, 187874 | 11866 | AHM98820 | 11866 | 42370 | 72874, 103378, 133882, 164386, 194890 |
| 4851 | ADG42553 | 4851 | 35355 | 65859, 96363, 126867, 157371, 187875 | 11867 | AHM98831 | 11867 | 42371 | 72875, 103379, 133883, 164387, 194891 |
| 4852 | ADG42573 | 4852 | 35356 | 65860, 96364, 126868, 157372, 187876 | 11868 | AHM98836 | 11868 | 42372 | 72876, 103380, 133884, 164388, 194892 |
| 4853 | ADG42583 | 4853 | 35357 | 65861, 96365, 126869, 157373, 187877 | 11869 | AHM98847 | 11869 | 42373 | 72877, 103381, 133885, 164389, 194893 |

FIG. 1 continued

| | | | | | | | | | |
|---|---|---|---|---|---|---|---|---|---|
| 4854 | ADG42593 | 4854 | 35358 | 65862, 96366, 126870, 157374, 187878 | 11870 | AHM98858 | 11870 | 42374 | 72878, 103382, 133886, 164390, 194894 |
| 4855 | ADG42603 | 4855 | 35359 | 65863, 96367, 126871, 157375, 187879 | 11871 | AHM98877 | 11871 | 42375 | 72879, 103383, 133887, 164391, 194895 |
| 4856 | ADG42613 | 4856 | 35360 | 65864, 96368, 126872, 157376, 187880 | 11872 | AHM98898 | 11872 | 42376 | 72880, 103384, 133888, 164392, 194896 |
| 4857 | ADG42623 | 4857 | 35361 | 65865, 96369, 126873, 157377, 187881 | 11873 | AHM98909 | 11873 | 42377 | 72881, 103385, 133889, 164393, 194897 |
| 4858 | ADG42633 | 4858 | 35362 | 65866, 96370, 126874, 157378, 187882 | 11874 | AHM98932 | 11874 | 42378 | 72882, 103386, 133890, 164394, 194898 |
| 4859 | ADG42643 | 4859 | 35363 | 65867, 96371, 126875, 157379, 187883 | 11875 | AHM98940 | 11875 | 42379 | 72883, 103387, 133891, 164395, 194899 |
| 4860 | ADG42653 | 4860 | 35364 | 65868, 96372, 126876, 157380, 187884 | 11876 | AHM98951 | 11876 | 42380 | 72884, 103388, 133892, 164396, 194900 |
| 4861 | ADG42663 | 4861 | 35365 | 65869, 96373, 126877, 157381, 187885 | 11877 | AHM98975 | 11877 | 42381 | 72885, 103389, 133893, 164397, 194901 |
| 4862 | ADG42673 | 4862 | 35366 | 65870, 96374, 126878, 157382, 187886 | 11878 | AHM98997 | 11878 | 42382 | 72886, 103390, 133894, 164398, 194902 |
| 4863 | ADG42683 | 4863 | 35367 | 65871, 96375, 126879, 157383, 187887 | 11879 | AHM99019 | 11879 | 42383 | 72887, 103391, 133895, 164399, 194903 |
| 4864 | ADG42693 | 4864 | 35368 | 65872, 96376, 126880, 157384, 187888 | 11880 | AHM99031 | 11880 | 42384 | 72888, 103392, 133896, 164400, 194904 |
| 4865 | ADG42703 | 4865 | 35369 | 65873, 96377, 126881, 157385, 187889 | 11881 | AHM99043 | 11881 | 42385 | 72889, 103393, 133897, 164401, 194905 |
| 4866 | ADG42723 | 4866 | 35370 | 65874, 96378, 126882, 157386, 187890 | 11882 | AHM99054 | 11882 | 42386 | 72890, 103394, 133898, 164402, 194906 |
| 4867 | ADG42743 | 4867 | 35371 | 65875, 96379, 126883, 157387, 187891 | 11883 | AHM99065 | 11883 | 42387 | 72891, 103395, 133899, 164403, 194907 |
| 4868 | ADG42753 | 4868 | 35372 | 65876, 96380, 126884, 157388, 187892 | 11884 | AHM99075 | 11884 | 42388 | 72892, 103396, 133900, 164404, 194908 |
| 4869 | ADG42763 | 4869 | 35373 | 65877, 96381, 126885, 157389, 187893 | 11885 | AHN00717 | 11885 | 42389 | 72893, 103397, 133901, 164405, 194909 |
| 4870 | ADG42773 | 4870 | 35374 | 65878, 96382, 126886, 157390, 187894 | 11886 | AHN00764 | 11886 | 42390 | 72894, 103398, 133902, 164406, 194910 |
| 4871 | ADG42783 | 4871 | 35375 | 65879, 96383, 126887, 157391, 187895 | 11887 | AHN96323 | 11887 | 42391 | 72895, 103399, 133903, 164407, 194911 |

FIG. 1 continued

| | | | | | | | | | |
|---|---|---|---|---|---|---|---|---|---|
| 4872 | ADG42793 | 4872 | 35376 | 65880, 96384, 126888, 157392, 187896 | 11888 | AHN96442 | 11888 | 42392 | 72896, 103400, 133904, 164408, 194912 |
| 4873 | ADG42803 | 4873 | 35377 | 65881, 96385, 126889, 157393, 187897 | 11889 | AHN96443 | 11889 | 42393 | 72897, 103401, 133905, 164409, 194913 |
| 4874 | ADG42813 | 4874 | 35378 | 65882, 96386, 126890, 157394, 187898 | 11890 | AHN96444 | 11890 | 42394 | 72898, 103402, 133906, 164410, 194914 |
| 4875 | ADG42823 | 4875 | 35379 | 65883, 96387, 126891, 157395, 187899 | 11891 | AHN96445 | 11891 | 42395 | 72899, 103403, 133907, 164411, 194915 |
| 4876 | ADG42833 | 4876 | 35380 | 65884, 96388, 126892, 157396, 187900 | 11892 | AHN96447 | 11892 | 42396 | 72900, 103404, 133908, 164412, 194916 |
| 4877 | ADG42843 | 4877 | 35381 | 65885, 96389, 126893, 157397, 187901 | 11893 | AHV83765 | 11893 | 42397 | 72901, 103405, 133909, 164413, 194917 |
| 4878 | ADG42853 | 4878 | 35382 | 65886, 96390, 126894, 157398, 187902 | 11894 | AHV83766 | 11894 | 42398 | 72902, 103406, 133910, 164414, 194918 |
| 4879 | ADG42863 | 4879 | 35383 | 65887, 96391, 126895, 157399, 187903 | 11895 | AHV83767 | 11895 | 42399 | 72903, 103407, 133911, 164415, 194919 |
| 4880 | ADG42883 | 4880 | 35384 | 65888, 96392, 126896, 157400, 187904 | 11896 | AHV83768 | 11896 | 42400 | 72904, 103408, 133912, 164416, 194920 |
| 4881 | ADG42893 | 4881 | 35385 | 65889, 96393, 126897, 157401, 187905 | 11897 | AHV83770 | 11897 | 42401 | 72905, 103409, 133913, 164417, 194921 |
| 4882 | ADG42903 | 4882 | 35386 | 65890, 96394, 126898, 157402, 187906 | 11898 | AHV83771 | 11898 | 42402 | 72906, 103410, 133914, 164418, 194922 |
| 4883 | ADG42913 | 4883 | 35387 | 65891, 96395, 126899, 157403, 187907 | 11899 | AHV83772 | 11899 | 42403 | 72907, 103411, 133915, 164419, 194923 |
| 4884 | ADG42923 | 4884 | 35388 | 65892, 96396, 126900, 157404, 187908 | 11900 | AHV83773 | 11900 | 42404 | 72908, 103412, 133916, 164420, 194924 |
| 4885 | ADG57087 | 4885 | 35389 | 65893, 96397, 126901, 157405, 187909 | 11901 | AHV83774 | 11901 | 42405 | 72909, 103413, 133917, 164421, 194925 |
| 4886 | ADG57088 | 4886 | 35390 | 65894, 96398, 126902, 157406, 187910 | 11902 | AHV83775 | 11902 | 42406 | 72910, 103414, 133918, 164422, 194926 |
| 4887 | ADG57089 | 4887 | 35391 | 65895, 96399, 126903, 157407, 187911 | 11903 | AHV83776 | 11903 | 42407 | 72911, 103415, 133919, 164423, 194927 |
| 4888 | ADG57090 | 4888 | 35392 | 65896, 96400, 126904, 157408, 187912 | 11904 | AHV83777 | 11904 | 42408 | 72912, 103416, 133920, 164424, 194928 |
| 4889 | ADG57091 | 4889 | 35393 | 65897, 96401, 126905, 157409, 187913 | 11905 | AHV83778 | 11905 | 42409 | 72913, 103417, 133921, 164425, 194929 |

FIG. 1 continued

| | | | | | | | | | |
|---|---|---|---|---|---|---|---|---|---|
| 4890 | ADG57092 | 4890 | 35394 | 65898, 96402, 126906, 157410, 187914 | 11906 | AHV83779 | 11906 | 42410 | 72914, 103418, 133922, 164426, 194930 |
| 4891 | ADG57093 | 4891 | 35395 | 65899, 96403, 126907, 157411, 187915 | 11907 | AHV83780 | 11907 | 42411 | 72915, 103419, 133923, 164427, 194931 |
| 4892 | ADG57094 | 4892 | 35396 | 65900, 96404, 126908, 157412, 187916 | 11908 | AHV83781 | 11908 | 42412 | 72916, 103420, 133924, 164428, 194932 |
| 4893 | ADG57095 | 4893 | 35397 | 65901, 96405, 126909, 157413, 187917 | 11909 | AHV83782 | 11909 | 42413 | 72917, 103421, 133925, 164429, 194933 |
| 4894 | ADG57097 | 4894 | 35398 | 65902, 96406, 126910, 157414, 187918 | 11910 | AHV83783 | 11910 | 42414 | 72918, 103422, 133926, 164430, 194934 |
| 4895 | ADG57098 | 4895 | 35399 | 65903, 96407, 126911, 157415, 187919 | 11911 | AHV83784 | 11911 | 42415 | 72919, 103423, 133927, 164431, 194935 |
| 4896 | ADG57099 | 4896 | 35400 | 65904, 96408, 126912, 157416, 187920 | 11912 | AHV83785 | 11912 | 42416 | 72920, 103424, 133928, 164432, 194936 |
| 4897 | ADG57100 | 4897 | 35401 | 65905, 96409, 126913, 157417, 187921 | 11913 | AHV83787 | 11913 | 42417 | 72921, 103425, 133929, 164433, 194937 |
| 4898 | ADG58939 | 4898 | 35402 | 65906, 96410, 126914, 157418, 187922 | 11914 | AHV83788 | 11914 | 42418 | 72922, 103426, 133930, 164434, 194938 |
| 4899 | ADG58940 | 4899 | 35403 | 65907, 96411, 126915, 157419, 187923 | 11915 | AHV83789 | 11915 | 42419 | 72923, 103427, 133931, 164435, 194939 |
| 4900 | ADG58941 | 4900 | 35404 | 65908, 96412, 126916, 157420, 187924 | 11916 | AHV83790 | 11916 | 42420 | 72924, 103428, 133932, 164436, 194940 |
| 4901 | ADG58942 | 4901 | 35405 | 65909, 96413, 126917, 157421, 187925 | 11917 | AHV83791 | 11917 | 42421 | 72925, 103429, 133933, 164437, 194941 |
| 4902 | ADG58943 | 4902 | 35406 | 65910, 96414, 126918, 157422, 187926 | 11918 | AHV83792 | 11918 | 42422 | 72926, 103430, 133934, 164438, 194942 |
| 4903 | ADG58944 | 4903 | 35407 | 65911, 96415, 126919, 157423, 187927 | 11919 | AHV83793 | 11919 | 42423 | 72927, 103431, 133935, 164439, 194943 |
| 4904 | ADG58946 | 4904 | 35408 | 65912, 96416, 126920, 157424, 187928 | 11920 | AHV83794 | 11920 | 42424 | 72928, 103432, 133936, 164440, 194944 |
| 4905 | ADG58947 | 4905 | 35409 | 65913, 96417, 126921, 157425, 187929 | 11921 | AHV83795 | 11921 | 42425 | 72929, 103433, 133937, 164441, 194945 |
| 4906 | ADG58948 | 4906 | 35410 | 65914, 96418, 126922, 157426, 187930 | 11922 | AHV83796 | 11922 | 42426 | 72930, 103434, 133938, 164442, 194946 |
| 4907 | ADG58949 | 4907 | 35411 | 65915, 96419, 126923, 157427, 187931 | 11923 | AHV83798 | 11923 | 42427 | 72931, 103435, 133939, 164443, 194947 |

FIG. 1 continued

| | | | | | | | | | |
|---|---|---|---|---|---|---|---|---|---|
| 4908 | ADG58951 | 4908 | 35412 | 65916, 96420, 126924, 157428, 187932 | 11924 | AHV83799 | 11924 | 42428 | 72932, 103436, 133940, 164444, 194948 |
| 4909 | ADG58952 | 4909 | 35413 | 65917, 96421, 126925, 157429, 187933 | 11925 | AHV83800 | 11925 | 42429 | 72933, 103437, 133941, 164445, 194949 |
| 4910 | ADG58953 | 4910 | 35414 | 65918, 96422, 126926, 157430, 187934 | 11926 | AHV83801 | 11926 | 42430 | 72934, 103438, 133942, 164446, 194950 |
| 4911 | ADG58954 | 4911 | 35415 | 65919, 96423, 126927, 157431, 187935 | 11927 | AHV83802 | 11927 | 42431 | 72935, 103439, 133943, 164447, 194951 |
| 4912 | ADG58955 | 4912 | 35416 | 65920, 96424, 126928, 157432, 187936 | 11928 | AHV83803 | 11928 | 42432 | 72936, 103440, 133944, 164448, 194952 |
| 4913 | ADG58956 | 4913 | 35417 | 65921, 96425, 126929, 157433, 187937 | 11929 | AHV83804 | 11929 | 42433 | 72937, 103441, 133945, 164449, 194953 |
| 4914 | ADG58957 | 4914 | 35418 | 65922, 96426, 126930, 157434, 187938 | 11930 | AHV83805 | 11930 | 42434 | 72938, 103442, 133946, 164450, 194954 |
| 4915 | ADG58959 | 4915 | 35419 | 65923, 96427, 126931, 157435, 187939 | 11931 | AHV83806 | 11931 | 42435 | 72939, 103443, 133947, 164451, 194955 |
| 4916 | ADG58960 | 4916 | 35420 | 65924, 96428, 126932, 157436, 187940 | 11932 | AHV83807 | 11932 | 42436 | 72940, 103444, 133948, 164452, 194956 |
| 4917 | ADG58961 | 4917 | 35421 | 65925, 96429, 126933, 157437, 187941 | 11933 | AHV83808 | 11933 | 42437 | 72941, 103445, 133949, 164453, 194957 |
| 4918 | ADG58962 | 4918 | 35422 | 65926, 96430, 126934, 157438, 187942 | 11934 | AHV83809 | 11934 | 42438 | 72942, 103446, 133950, 164454, 194958 |
| 4919 | ADG58963 | 4919 | 35423 | 65927, 96431, 126935, 157439, 187943 | 11935 | AHV83810 | 11935 | 42439 | 72943, 103447, 133951, 164455, 194959 |
| 4920 | ADG58964 | 4920 | 35424 | 65928, 96432, 126936, 157440, 187944 | 11936 | AHV83812 | 11936 | 42440 | 72944, 103448, 133952, 164456, 194960 |
| 4921 | ADG58965 | 4921 | 35425 | 65929, 96433, 126937, 157441, 187945 | 11937 | AHV83813 | 11937 | 42441 | 72945, 103449, 133953, 164457, 194961 |
| 4922 | ADG58966 | 4922 | 35426 | 65930, 96434, 126938, 157442, 187946 | 11938 | AHV83814 | 11938 | 42442 | 72946, 103450, 133954, 164458, 194962 |
| 4923 | ADG58967 | 4923 | 35427 | 65931, 96435, 126939, 157443, 187947 | 11939 | AHV83815 | 11939 | 42443 | 72947, 103451, 133955, 164459, 194963 |
| 4924 | ADG58968 | 4924 | 35428 | 65932, 96436, 126940, 157444, 187948 | 11940 | AHV83816 | 11940 | 42444 | 72948, 103452, 133956, 164460, 194964 |
| 4925 | ADG59628 | 4925 | 35429 | 65933, 96437, 126941, 157445, 187949 | 11941 | AHV83817 | 11941 | 42445 | 72949, 103453, 133957, 164461, 194965 |

FIG. 1 continued

| | | | | | | | | | |
|---|---|---|---|---|---|---|---|---|---|
| 4926 | ADG59629 | 4926 | 35430 | 65934, 96438, 126942, 157446, 187950 | 11942 | AHV83818 | 11942 | 42446 | 72950, 103454, 133958, 164462, 194966 |
| 4927 | ADG59630 | 4927 | 35431 | 65935, 96439, 126943, 157447, 187951 | 11943 | AHV83819 | 11943 | 42447 | 72951, 103455, 133959, 164463, 194967 |
| 4928 | ADG59631 | 4928 | 35432 | 65936, 96440, 126944, 157448, 187952 | 11944 | AHV83821 | 11944 | 42448 | 72952, 103456, 133960, 164464, 194968 |
| 4929 | ADG59632 | 4929 | 35433 | 65937, 96441, 126945, 157449, 187953 | 11945 | AHV83822 | 11945 | 42449 | 72953, 103457, 133961, 164465, 194969 |
| 4930 | ADG59633 | 4930 | 35434 | 65938, 96442, 126946, 157450, 187954 | 11946 | AHV83823 | 11946 | 42450 | 72954, 103458, 133962, 164466, 194970 |
| 4931 | ADG59634 | 4931 | 35435 | 65939, 96443, 126947, 157451, 187955 | 11947 | AHV83824 | 11947 | 42451 | 72955, 103459, 133963, 164467, 194971 |
| 4932 | ADG59635 | 4932 | 35436 | 65940, 96444, 126948, 157452, 187956 | 11948 | AHV83825 | 11948 | 42452 | 72956, 103460, 133964, 164468, 194972 |
| 4933 | ADG59636 | 4933 | 35437 | 65941, 96445, 126949, 157453, 187957 | 11949 | AHV83826 | 11949 | 42453 | 72957, 103461, 133965, 164469, 194973 |
| 4934 | ADG59638 | 4934 | 35438 | 65942, 96446, 126950, 157454, 187958 | 11950 | AHV83827 | 11950 | 42454 | 72958, 103462, 133966, 164470, 194974 |
| 4935 | ADG59639 | 4935 | 35439 | 65943, 96447, 126951, 157455, 187959 | 11951 | AHV83828 | 11951 | 42455 | 72959, 103463, 133967, 164471, 194975 |
| 4936 | ADG59641 | 4936 | 35440 | 65944, 96448, 126952, 157456, 187960 | 11952 | AHV83829 | 11952 | 42456 | 72960, 103464, 133968, 164472, 194976 |
| 4937 | ADG59643 | 4937 | 35441 | 65945, 96449, 126953, 157457, 187961 | 11953 | AHV83830 | 11953 | 42457 | 72961, 103465, 133969, 164473, 194977 |
| 4938 | ADG59644 | 4938 | 35442 | 65946, 96450, 126954, 157458, 187962 | 11954 | AHV83831 | 11954 | 42458 | 72962, 103466, 133970, 164474, 194978 |
| 4939 | ADG59646 | 4939 | 35443 | 65947, 96451, 126955, 157459, 187963 | 11955 | AHV83832 | 11955 | 42459 | 72963, 103467, 133971, 164475, 194979 |
| 4940 | ADG59647 | 4940 | 35444 | 65948, 96452, 126956, 157460, 187964 | 11956 | AHV83833 | 11956 | 42460 | 72964, 103468, 133972, 164476, 194980 |
| 4941 | ADG59648 | 4941 | 35445 | 65949, 96453, 126957, 157461, 187965 | 11957 | AHV83834 | 11957 | 42461 | 72965, 103469, 133973, 164477, 194981 |
| 4942 | ADG59649 | 4942 | 35446 | 65950, 96454, 126958, 157462, 187966 | 11958 | AHV83836 | 11958 | 42462 | 72966, 103470, 133974, 164478, 194982 |
| 4943 | ADG59650 | 4943 | 35447 | 65951, 96455, 126959, 157463, 187967 | 11959 | AHV83837 | 11959 | 42463 | 72967, 103471, 133975, 164479, 194983 |

FIG. 1 continued

| | | | | | | | | | |
|---|---|---|---|---|---|---|---|---|---|
| 4944 | ADG59651 | 4944 | 35448 | 65952, 96456, 126960, 157464, 187968 | 11960 | AHV83838 | 11960 | 42464 | 72968, 103472, 133976, 164480, 194984 |
| 4945 | ADG59652 | 4945 | 35449 | 65953, 96457, 126961, 157465, 187969 | 11961 | AHV83839 | 11961 | 42465 | 72969, 103473, 133977, 164481, 194985 |
| 4946 | ADG59653 | 4946 | 35450 | 65954, 96458, 126962, 157466, 187970 | 11962 | AHV83840 | 11962 | 42466 | 72970, 103474, 133978, 164482, 194986 |
| 4947 | ADG59655 | 4947 | 35451 | 65955, 96459, 126963, 157467, 187971 | 11963 | AHV83841 | 11963 | 42467 | 72971, 103475, 133979, 164483, 194987 |
| 4948 | ADG59656 | 4948 | 35452 | 65956, 96460, 126964, 157468, 187972 | 11964 | AHV83842 | 11964 | 42468 | 72972, 103476, 133980, 164484, 194988 |
| 4949 | ADG59657 | 4949 | 35453 | 65957, 96461, 126965, 157469, 187973 | 11965 | AHV83843 | 11965 | 42469 | 72973, 103477, 133981, 164485, 194989 |
| 4950 | ADG59658 | 4950 | 35454 | 65958, 96462, 126966, 157470, 187974 | 11966 | AHV83844 | 11966 | 42470 | 72974, 103478, 133982, 164486, 194990 |
| 4951 | ADG59659 | 4951 | 35455 | 65959, 96463, 126967, 157471, 187975 | 11967 | AHV83845 | 11967 | 42471 | 72975, 103479, 133983, 164487, 194991 |
| 4952 | ADG59660 | 4952 | 35456 | 65960, 96464, 126968, 157472, 187976 | 11968 | AHV83846 | 11968 | 42472 | 72976, 103480, 133984, 164488, 194992 |
| 4953 | ADG59662 | 4953 | 35457 | 65961, 96465, 126969, 157473, 187977 | 11969 | AHV83847 | 11969 | 42473 | 72977, 103481, 133985, 164489, 194993 |
| 4954 | ADG59663 | 4954 | 35458 | 65962, 96466, 126970, 157474, 187978 | 11970 | AHV83848 | 11970 | 42474 | 72978, 103482, 133986, 164490, 194994 |
| 4955 | ADG59664 | 4955 | 35459 | 65963, 96467, 126971, 157475, 187979 | 11971 | AHV83849 | 11971 | 42475 | 72979, 103483, 133987, 164491, 194995 |
| 4956 | ADG59666 | 4956 | 35460 | 65964, 96468, 126972, 157476, 187980 | 11972 | AHV83850 | 11972 | 42476 | 72980, 103484, 133988, 164492, 194996 |
| 4957 | ADG59667 | 4957 | 35461 | 65965, 96469, 126973, 157477, 187981 | 11973 | AHV83851 | 11973 | 42477 | 72981, 103485, 133989, 164493, 194997 |
| 4958 | ADG59669 | 4958 | 35462 | 65966, 96470, 126974, 157478, 187982 | 11974 | AHV83852 | 11974 | 42478 | 72982, 103486, 133990, 164494, 194998 |
| 4959 | ADG59670 | 4959 | 35463 | 65967, 96471, 126975, 157479, 187983 | 11975 | AHV83853 | 11975 | 42479 | 72983, 103487, 133991, 164495, 194999 |
| 4960 | ADG59671 | 4960 | 35464 | 65968, 96472, 126976, 157480, 187984 | 11976 | AHV83855 | 11976 | 42480 | 72984, 103488, 133992, 164496, 195000 |
| 4961 | ADG59672 | 4961 | 35465 | 65969, 96473, 126977, 157481, 187985 | 11977 | AHV83856 | 11977 | 42481 | 72985, 103489, 133993, 164497, 195001 |

FIG. 1 continued

| | | | | | | | | | |
|---|---|---|---|---|---|---|---|---|---|
| 4962 | ADG59673 | 4962 | 35466 | 65970, 96474, 126978, 157482, 187986 | 11978 | AHV83857 | 11978 | 42482 | 72986, 103490, 133994, 164498, 195002 |
| 4963 | ADG59674 | 4963 | 35467 | 65971, 96475, 126979, 157483, 187987 | 11979 | AHV83858 | 11979 | 42483 | 72987, 103491, 133995, 164499, 195003 |
| 4964 | ADG59675 | 4964 | 35468 | 65972, 96476, 126980, 157484, 187988 | 11980 | AHV83859 | 11980 | 42484 | 72988, 103492, 133996, 164500, 195004 |
| 4965 | ADG59676 | 4965 | 35469 | 65973, 96477, 126981, 157485, 187989 | 11981 | AHV83861 | 11981 | 42485 | 72989, 103493, 133997, 164501, 195005 |
| 4966 | ADG59678 | 4966 | 35470 | 65974, 96478, 126982, 157486, 187990 | 11982 | AHV83862 | 11982 | 42486 | 72990, 103494, 133998, 164502, 195006 |
| 4967 | ADG59680 | 4967 | 35471 | 65975, 96479, 126983, 157487, 187991 | 11983 | AHV83863 | 11983 | 42487 | 72991, 103495, 133999, 164503, 195007 |
| 4968 | ADG59681 | 4968 | 35472 | 65976, 96480, 126984, 157488, 187992 | 11984 | AHV83864 | 11984 | 42488 | 72992, 103496, 134000, 164504, 195008 |
| 4969 | ADG59683 | 4969 | 35473 | 65977, 96481, 126985, 157489, 187993 | 11985 | AHV83866 | 11985 | 42489 | 72993, 103497, 134001, 164505, 195009 |
| 4970 | ADG59684 | 4970 | 35474 | 65978, 96482, 126986, 157490, 187994 | 11986 | AHV83867 | 11986 | 42490 | 72994, 103498, 134002, 164506, 195010 |
| 4971 | ADG59685 | 4971 | 35475 | 65979, 96483, 126987, 157491, 187995 | 11987 | AHV83868 | 11987 | 42491 | 72995, 103499, 134003, 164507, 195011 |
| 4972 | ADG59686 | 4972 | 35476 | 65980, 96484, 126988, 157492, 187996 | 11988 | AHV83869 | 11988 | 42492 | 72996, 103500, 134004, 164508, 195012 |
| 4973 | ADG59687 | 4973 | 35477 | 65981, 96485, 126989, 157493, 187997 | 11989 | AHV83870 | 11989 | 42493 | 72997, 103501, 134005, 164509, 195013 |
| 4974 | ADG59688 | 4974 | 35478 | 65982, 96486, 126990, 157494, 187998 | 11990 | AHV83871 | 11990 | 42494 | 72998, 103502, 134006, 164510, 195014 |
| 4975 | ADG59689 | 4975 | 35479 | 65983, 96487, 126991, 157495, 187999 | 11991 | AHV83872 | 11991 | 42495 | 72999, 103503, 134007, 164511, 195015 |
| 4976 | ADG59691 | 4976 | 35480 | 65984, 96488, 126992, 157496, 188000 | 11992 | AHV83873 | 11992 | 42496 | 73000, 103504, 134008, 164512, 195016 |
| 4977 | ADG59693 | 4977 | 35481 | 65985, 96489, 126993, 157497, 188001 | 11993 | AHV83874 | 11993 | 42497 | 73001, 103505, 134009, 164513, 195017 |
| 4978 | ADG59696 | 4978 | 35482 | 65986, 96490, 126994, 157498, 188002 | 11994 | AHV83875 | 11994 | 42498 | 73002, 103506, 134010, 164514, 195018 |
| 4979 | ADG59697 | 4979 | 35483 | 65987, 96491, 126995, 157499, 188003 | 11995 | AHV83876 | 11995 | 42499 | 73003, 103507, 134011, 164515, 195019 |

FIG. 1 continued

| | | | | | | | | | |
|---|---|---|---|---|---|---|---|---|---|
| 4980 | ADG59700 | 4980 | 35484 | 65988, 96492, 126996, 157500, 188004 | 11996 | AHV83877 | 11996 | 42500 | 73004, 103508, 134012, 164516, 195020 |
| 4981 | ADG59701 | 4981 | 35485 | 65989, 96493, 126997, 157501, 188005 | 11997 | AHV83878 | 11997 | 42501 | 73005, 103509, 134013, 164517, 195021 |
| 4982 | ADG59702 | 4982 | 35486 | 65990, 96494, 126998, 157502, 188006 | 11998 | AHV83879 | 11998 | 42502 | 73006, 103510, 134014, 164518, 195022 |
| 4983 | ADG59703 | 4983 | 35487 | 65991, 96495, 126999, 157503, 188007 | 11999 | AHV83881 | 11999 | 42503 | 73007, 103511, 134015, 164519, 195023 |
| 4984 | ADG76646 | 4984 | 35488 | 65992, 96496, 127000, 157504, 188008 | 12000 | AHV83882 | 12000 | 42504 | 73008, 103512, 134016, 164520, 195024 |
| 4985 | ADG76652 | 4985 | 35489 | 65993, 96497, 127001, 157505, 188009 | 12001 | AHV83883 | 12001 | 42505 | 73009, 103513, 134017, 164521, 195025 |
| 4986 | ADH01808 | 4986 | 35490 | 65994, 96498, 127002, 157506, 188010 | 12002 | AHV83884 | 12002 | 42506 | 73010, 103514, 134018, 164522, 195026 |
| 4987 | ADH01818 | 4987 | 35491 | 65995, 96499, 127003, 157507, 188011 | 12003 | AHV83885 | 12003 | 42507 | 73011, 103515, 134019, 164523, 195027 |
| 4988 | ADH01828 | 4988 | 35492 | 65996, 96500, 127004, 157508, 188012 | 12004 | AHV83887 | 12004 | 42508 | 73012, 103516, 134020, 164524, 195028 |
| 4989 | ADH01838 | 4989 | 35493 | 65997, 96501, 127005, 157509, 188013 | 12005 | AHV83888 | 12005 | 42509 | 73013, 103517, 134021, 164525, 195029 |
| 4990 | ADH01848 | 4990 | 35494 | 65998, 96502, 127006, 157510, 188014 | 12006 | AHV83889 | 12006 | 42510 | 73014, 103518, 134022, 164526, 195030 |
| 4991 | ADH01858 | 4991 | 35495 | 65999, 96503, 127007, 157511, 188015 | 12007 | AHV83890 | 12007 | 42511 | 73015, 103519, 134023, 164527, 195031 |
| 4992 | ADH01868 | 4992 | 35496 | 66000, 96504, 127008, 157512, 188016 | 12008 | AHV83891 | 12008 | 42512 | 73016, 103520, 134024, 164528, 195032 |
| 4993 | ADH01878 | 4993 | 35497 | 66001, 96505, 127009, 157513, 188017 | 12009 | AHV83893 | 12009 | 42513 | 73017, 103521, 134025, 164529, 195033 |
| 4994 | ADH01888 | 4994 | 35498 | 66002, 96506, 127010, 157514, 188018 | 12010 | AHV83894 | 12010 | 42514 | 73018, 103522, 134026, 164530, 195034 |
| 4995 | ADH01898 | 4995 | 35499 | 66003, 96507, 127011, 157515, 188019 | 12011 | AHV83895 | 12011 | 42515 | 73019, 103523, 134027, 164531, 195035 |
| 4996 | ADH01908 | 4996 | 35500 | 66004, 96508, 127012, 157516, 188020 | 12012 | AHV83896 | 12012 | 42516 | 73020, 103524, 134028, 164532, 195036 |
| 4997 | ADH01918 | 4997 | 35501 | 66005, 96509, 127013, 157517, 188021 | 12013 | AHV83897 | 12013 | 42517 | 73021, 103525, 134029, 164533, 195037 |

FIG. 1 continued

| | | | | | | | | | |
|---|---|---|---|---|---|---|---|---|---|
| 4998 | ADH01928 | 4998 | 35502 | 66006, 96510, 127014, 157518, 188022 | 12014 | AHV83898 | 12014 | 42518 | 73022, 103526, 134030, 164534, 195038 |
| 4999 | ADH01938 | 4999 | 35503 | 66007, 96511, 127015, 157519, 188023 | 12015 | AHV83899 | 12015 | 42519 | 73023, 103527, 134031, 164535, 195039 |
| 5000 | ADH01948 | 5000 | 35504 | 66008, 96512, 127016, 157520, 188024 | 12016 | AHV83900 | 12016 | 42520 | 73024, 103528, 134032, 164536, 195040 |
| 5001 | ADH01958 | 5001 | 35505 | 66009, 96513, 127017, 157521, 188025 | 12017 | AHV83901 | 12017 | 42521 | 73025, 103529, 134033, 164537, 195041 |
| 5002 | ADH01968 | 5002 | 35506 | 66010, 96514, 127018, 157522, 188026 | 12018 | AHV83902 | 12018 | 42522 | 73026, 103530, 134034, 164538, 195042 |
| 5003 | ADH01978 | 5003 | 35507 | 66011, 96515, 127019, 157523, 188027 | 12019 | AHV83903 | 12019 | 42523 | 73027, 103531, 134035, 164539, 195043 |
| 5004 | ADH01988 | 5004 | 35508 | 66012, 96516, 127020, 157524, 188028 | 12020 | AHV83904 | 12020 | 42524 | 73028, 103532, 134036, 164540, 195044 |
| 5005 | ADH01998 | 5005 | 35509 | 66013, 96517, 127021, 157525, 188029 | 12021 | AHV83905 | 12021 | 42525 | 73029, 103533, 134037, 164541, 195045 |
| 5006 | ADH02008 | 5006 | 35510 | 66014, 96518, 127022, 157526, 188030 | 12022 | AHV83906 | 12022 | 42526 | 73030, 103534, 134038, 164542, 195046 |
| 5007 | ADI24508 | 5007 | 35511 | 66015, 96519, 127023, 157527, 188031 | 12023 | AHV83907 | 12023 | 42527 | 73031, 103535, 134039, 164543, 195047 |
| 5008 | ADI24515 | 5008 | 35512 | 66016, 96520, 127024, 157528, 188032 | 12024 | AHV83908 | 12024 | 42528 | 73032, 103536, 134040, 164544, 195048 |
| 5009 | ADI24517 | 5009 | 35513 | 66017, 96521, 127025, 157529, 188033 | 12025 | AHV83911 | 12025 | 42529 | 73033, 103537, 134041, 164545, 195049 |
| 5010 | ADI24519 | 5010 | 35514 | 66018, 96522, 127026, 157530, 188034 | 12026 | AHV83912 | 12026 | 42530 | 73034, 103538, 134042, 164546, 195050 |
| 5011 | ADI24521 | 5011 | 35515 | 66019, 96523, 127027, 157531, 188035 | 12027 | AHV83913 | 12027 | 42531 | 73035, 103539, 134043, 164547, 195051 |
| 5012 | ADI24523 | 5012 | 35516 | 66020, 96524, 127028, 157532, 188036 | 12028 | AHV83915 | 12028 | 42532 | 73036, 103540, 134044, 164548, 195052 |
| 5013 | ADI24525 | 5013 | 35517 | 66021, 96525, 127029, 157533, 188037 | 12029 | AHV83916 | 12029 | 42533 | 73037, 103541, 134045, 164549, 195053 |
| 5014 | ADI24527 | 5014 | 35518 | 66022, 96526, 127030, 157534, 188038 | 12030 | AHV83917 | 12030 | 42534 | 73038, 103542, 134046, 164550, 195054 |
| 5015 | ADI24529 | 5015 | 35519 | 66023, 96527, 127031, 157535, 188039 | 12031 | AHV83919 | 12031 | 42535 | 73039, 103543, 134047, 164551, 195055 |

FIG. 1 continued

| | | | | | | | | | |
|---|---|---|---|---|---|---|---|---|---|
| 5016 | ADI24531 | 5016 | 35520 | 66024, 96528, 127032, 157536, 188040 | 12032 | AHV83920 | 12032 | 42536 | 73040, 103544, 134048, 164552, 195056 |
| 5017 | ADI24536 | 5017 | 35521 | 66025, 96529, 127033, 157537, 188041 | 12033 | AHV83921 | 12033 | 42537 | 73041, 103545, 134049, 164553, 195057 |
| 5018 | ADI24546 | 5018 | 35522 | 66026, 96530, 127034, 157538, 188042 | 12034 | AHV83922 | 12034 | 42538 | 73042, 103546, 134050, 164554, 195058 |
| 5019 | ADI24553 | 5019 | 35523 | 66027, 96531, 127035, 157539, 188043 | 12035 | AHV83923 | 12035 | 42539 | 73043, 103547, 134051, 164555, 195059 |
| 5020 | ADI24555 | 5020 | 35524 | 66028, 96532, 127036, 157540, 188044 | 12036 | AHV83924 | 12036 | 42540 | 73044, 103548, 134052, 164556, 195060 |
| 5021 | ADI24557 | 5021 | 35525 | 66029, 96533, 127037, 157541, 188045 | 12037 | AHV83925 | 12037 | 42541 | 73045, 103549, 134053, 164557, 195061 |
| 5022 | ADI24559 | 5022 | 35526 | 66030, 96534, 127038, 157542, 188046 | 12038 | AHV83926 | 12038 | 42542 | 73046, 103550, 134054, 164558, 195062 |
| 5023 | ADI24561 | 5023 | 35527 | 66031, 96535, 127039, 157543, 188047 | 12039 | AHV83927 | 12039 | 42543 | 73047, 103551, 134055, 164559, 195063 |
| 5024 | ADI24563 | 5024 | 35528 | 66032, 96536, 127040, 157544, 188048 | 12040 | AHV83928 | 12040 | 42544 | 73048, 103552, 134056, 164560, 195064 |
| 5025 | ADI24565 | 5025 | 35529 | 66033, 96537, 127041, 157545, 188049 | 12041 | AHV83929 | 12041 | 42545 | 73049, 103553, 134057, 164561, 195065 |
| 5026 | ADI24567 | 5026 | 35530 | 66034, 96538, 127042, 157546, 188050 | 12042 | AHV83930 | 12042 | 42546 | 73050, 103554, 134058, 164562, 195066 |
| 5027 | ADI24569 | 5027 | 35531 | 66035, 96539, 127043, 157547, 188051 | 12043 | AHV83931 | 12043 | 42547 | 73051, 103555, 134059, 164563, 195067 |
| 5028 | ADI24571 | 5028 | 35532 | 66036, 96540, 127044, 157548, 188052 | 12044 | AHV83932 | 12044 | 42548 | 73052, 103556, 134060, 164564, 195068 |
| 5029 | ADI24573 | 5029 | 35533 | 66037, 96541, 127045, 157549, 188053 | 12045 | AHV83933 | 12045 | 42549 | 73053, 103557, 134061, 164565, 195069 |
| 5030 | ADI24575 | 5030 | 35534 | 66038, 96542, 127046, 157550, 188054 | 12046 | AHV83934 | 12046 | 42550 | 73054, 103558, 134062, 164566, 195070 |
| 5031 | ADI24577 | 5031 | 35535 | 66039, 96543, 127047, 157551, 188055 | 12047 | AHV83935 | 12047 | 42551 | 73055, 103559, 134063, 164567, 195071 |
| 5032 | ADI24581 | 5032 | 35536 | 66040, 96544, 127048, 157552, 188056 | 12048 | AHV83937 | 12048 | 42552 | 73056, 103560, 134064, 164568, 195072 |
| 5033 | ADI24583 | 5033 | 35537 | 66041, 96545, 127049, 157553, 188057 | 12049 | AHV83938 | 12049 | 42553 | 73057, 103561, 134065, 164569, 195073 |

FIG. 1 continued

| | | | | | | | | | |
|---|---|---|---|---|---|---|---|---|---|
| 5034 | ADI24590 | 5034 | 35538 | 66042, 96546, 127050, 157554, 188058 | 12050 | AHV83939 | 12050 | 42554 | 73058, 103562, 134066, 164570, 195074 |
| 5035 | ADI24597 | 5035 | 35539 | 66043, 96547, 127051, 157555, 188059 | 12051 | AHV83940 | 12051 | 42555 | 73059, 103563, 134067, 164571, 195075 |
| 5036 | ADI24612 | 5036 | 35540 | 66044, 96548, 127052, 157556, 188060 | 12052 | AHV83941 | 12052 | 42556 | 73060, 103564, 134068, 164572, 195076 |
| 5037 | ADI24619 | 5037 | 35541 | 66045, 96549, 127053, 157557, 188061 | 12053 | AHV83943 | 12053 | 42557 | 73061, 103565, 134069, 164573, 195077 |
| 5038 | ADI24621 | 5038 | 35542 | 66046, 96550, 127054, 157558, 188062 | 12054 | AHV83944 | 12054 | 42558 | 73062, 103566, 134070, 164574, 195078 |
| 5039 | ADI48184 | 5039 | 35543 | 66047, 96551, 127055, 157559, 188063 | 12055 | AHV83945 | 12055 | 42559 | 73063, 103567, 134071, 164575, 195079 |
| 5040 | ADI48186 | 5040 | 35544 | 66048, 96552, 127056, 157560, 188064 | 12056 | AHV83947 | 12056 | 42560 | 73064, 103568, 134072, 164576, 195080 |
| 5041 | ADI48188 | 5041 | 35545 | 66049, 96553, 127057, 157561, 188065 | 12057 | AHV83948 | 12057 | 42561 | 73065, 103569, 134073, 164577, 195081 |
| 5042 | ADI48190 | 5042 | 35546 | 66050, 96554, 127058, 157562, 188066 | 12058 | AHV83949 | 12058 | 42562 | 73066, 103570, 134074, 164578, 195082 |
| 5043 | ADI48192 | 5043 | 35547 | 66051, 96555, 127059, 157563, 188067 | 12059 | AHV83950 | 12059 | 42563 | 73067, 103571, 134075, 164579, 195083 |
| 5044 | ADI48194 | 5044 | 35548 | 66052, 96556, 127060, 157564, 188068 | 12060 | AHV83953 | 12060 | 42564 | 73068, 103572, 134076, 164580, 195084 |
| 5045 | ADI48196 | 5045 | 35549 | 66053, 96557, 127061, 157565, 188069 | 12061 | AHV83954 | 12061 | 42565 | 73069, 103573, 134077, 164581, 195085 |
| 5046 | ADI48198 | 5046 | 35550 | 66054, 96558, 127062, 157566, 188070 | 12062 | AHV83956 | 12062 | 42566 | 73070, 103574, 134078, 164582, 195086 |
| 5047 | ADI48200 | 5047 | 35551 | 66055, 96559, 127063, 157567, 188071 | 12063 | AHZ13523 | 12063 | 42567 | 73071, 103575, 134079, 164583, 195087 |
| 5048 | ADI48202 | 5048 | 35552 | 66056, 96560, 127064, 157568, 188072 | 12064 | AHZ13582 | 12064 | 42568 | 73072, 103576, 134080, 164584, 195088 |
| 5049 | ADI48204 | 5049 | 35553 | 66057, 96561, 127065, 157569, 188073 | 12065 | AHZ35584 | 12065 | 42569 | 73073, 103577, 134081, 164585, 195089 |
| 5050 | ADI48208 | 5050 | 35554 | 66058, 96562, 127066, 157570, 188074 | 12066 | AHZ35608 | 12066 | 42570 | 73074, 103578, 134082, 164586, 195090 |
| 5051 | ADI48210 | 5051 | 35555 | 66059, 96563, 127067, 157571, 188075 | 12067 | AHZ35620 | 12067 | 42571 | 73075, 103579, 134083, 164587, 195091 |

FIG. 1 continued

| | | | | | | | | | |
|---|---|---|---|---|---|---|---|---|---|
| 5052 | ADI48212 | 5052 | 35556 | 66060, 96564, 127068, 157572, 188076 | 12068 | AHZ35632 | 12068 | 42572 | 73076, 103580, 134084, 164588, 195092 |
| 5053 | ADI48214 | 5053 | 35557 | 66061, 96565, 127069, 157573, 188077 | 12069 | AHZ35644 | 12069 | 42573 | 73077, 103581, 134085, 164589, 195093 |
| 5054 | ADI48216 | 5054 | 35558 | 66062, 96566, 127070, 157574, 188078 | 12070 | AHZ35656 | 12070 | 42574 | 73078, 103582, 134086, 164590, 195094 |
| 5055 | ADI48218 | 5055 | 35559 | 66063, 96567, 127071, 157575, 188079 | 12071 | AHZ35668 | 12071 | 42575 | 73079, 103583, 134087, 164591, 195095 |
| 5056 | ADI48220 | 5056 | 35560 | 66064, 96568, 127072, 157576, 188080 | 12072 | AHZ35680 | 12072 | 42576 | 73080, 103584, 134088, 164592, 195096 |
| 5057 | ADI48622 | 5057 | 35561 | 66065, 96569, 127073, 157577, 188081 | 12073 | AHZ35692 | 12073 | 42577 | 73081, 103585, 134089, 164593, 195097 |
| 5058 | ADI48632 | 5058 | 35562 | 66066, 96570, 127074, 157578, 188082 | 12074 | AHZ35716 | 12074 | 42578 | 73082, 103586, 134090, 164594, 195098 |
| 5059 | ADI48642 | 5059 | 35563 | 66067, 96571, 127075, 157579, 188083 | 12075 | AHZ35728 | 12075 | 42579 | 73083, 103587, 134091, 164595, 195099 |
| 5060 | ADI48652 | 5060 | 35564 | 66068, 96572, 127076, 157580, 188084 | 12076 | AHZ35740 | 12076 | 42580 | 73084, 103588, 134092, 164596, 195100 |
| 5061 | ADI48672 | 5061 | 35565 | 66069, 96573, 127077, 157581, 188085 | 12077 | AHZ35752 | 12077 | 42581 | 73085, 103589, 134093, 164597, 195101 |
| 5062 | ADI48682 | 5062 | 35566 | 66070, 96574, 127078, 157582, 188086 | 12078 | AHZ35764 | 12078 | 42582 | 73086, 103590, 134094, 164598, 195102 |
| 5063 | ADI48692 | 5063 | 35567 | 66071, 96575, 127079, 157583, 188087 | 12079 | AHZ35776 | 12079 | 42583 | 73087, 103591, 134095, 164599, 195103 |
| 5064 | ADI48702 | 5064 | 35568 | 66072, 96576, 127080, 157584, 188088 | 12080 | AHZ35823 | 12080 | 42584 | 73088, 103592, 134096, 164600, 195104 |
| 5065 | ADI48712 | 5065 | 35569 | 66073, 96577, 127081, 157585, 188089 | 12081 | AHZ35834 | 12081 | 42585 | 73089, 103593, 134097, 164601, 195105 |
| 5066 | ADI48722 | 5066 | 35570 | 66074, 96578, 127082, 157586, 188090 | 12082 | AHZ35845 | 12082 | 42586 | 73090, 103594, 134098, 164602, 195106 |
| 5067 | ADI48732 | 5067 | 35571 | 66075, 96579, 127083, 157587, 188091 | 12083 | AHZ35856 | 12083 | 42587 | 73091, 103595, 134099, 164603, 195107 |
| 5068 | ADI48742 | 5068 | 35572 | 66076, 96580, 127084, 157588, 188092 | 12084 | AHZ35867 | 12084 | 42588 | 73092, 103596, 134100, 164604, 195108 |
| 5069 | ADI48752 | 5069 | 35573 | 66077, 96581, 127085, 157589, 188093 | 12085 | AHZ35879 | 12085 | 42589 | 73093, 103597, 134101, 164605, 195109 |

FIG. 1 continued

| | | | | | | | | | |
|---|---|---|---|---|---|---|---|---|---|
| 5070 | ADI48762 | 5070 | 35574 | 66078, 96582, 127086, 157590, 188094 | 12086 | AHZ35891 | 12086 | 42590 | 73094, 103598, 134102, 164606, 195110 |
| 5071 | ADI48772 | 5071 | 35575 | 66079, 96583, 127087, 157591, 188095 | 12087 | AHZ35902 | 12087 | 42591 | 73095, 103599, 134103, 164607, 195111 |
| 5072 | ADI48782 | 5072 | 35576 | 66080, 96584, 127088, 157592, 188096 | 12088 | AHZ35913 | 12088 | 42592 | 73096, 103600, 134104, 164608, 195112 |
| 5073 | ADI48792 | 5073 | 35577 | 66081, 96585, 127089, 157593, 188097 | 12089 | AHZ35924 | 12089 | 42593 | 73097, 103601, 134105, 164609, 195113 |
| 5074 | ADI49029 | 5074 | 35578 | 66082, 96586, 127090, 157594, 188098 | 12090 | AHZ35935 | 12090 | 42594 | 73098, 103602, 134106, 164610, 195114 |
| 5075 | ADI49240 | 5075 | 35579 | 66083, 96587, 127091, 157595, 188099 | 12091 | AHZ35946 | 12091 | 42595 | 73099, 103603, 134107, 164611, 195115 |
| 5076 | ADI49260 | 5076 | 35580 | 66084, 96588, 127092, 157596, 188100 | 12092 | AHZ35958 | 12092 | 42596 | 73100, 103604, 134108, 164612, 195116 |
| 5077 | ADI49270 | 5077 | 35581 | 66085, 96589, 127093, 157597, 188101 | 12093 | AHZ35980 | 12093 | 42597 | 73101, 103605, 134109, 164613, 195117 |
| 5078 | ADI49280 | 5078 | 35582 | 66086, 96590, 127094, 157598, 188102 | 12094 | AHZ35991 | 12094 | 42598 | 73102, 103606, 134110, 164614, 195118 |
| 5079 | ADI49312 | 5079 | 35583 | 66087, 96591, 127095, 157599, 188103 | 12095 | AHZ36002 | 12095 | 42599 | 73103, 103607, 134111, 164615, 195119 |
| 5080 | ADI49322 | 5080 | 35584 | 66088, 96592, 127096, 157600, 188104 | 12096 | AHZ36013 | 12096 | 42600 | 73104, 103608, 134112, 164616, 195120 |
| 5081 | ADI49332 | 5081 | 35585 | 66089, 96593, 127097, 157601, 188105 | 12097 | AHZ36024 | 12097 | 42601 | 73105, 103609, 134113, 164617, 195121 |
| 5082 | ADI49342 | 5082 | 35586 | 66090, 96594, 127098, 157602, 188106 | 12098 | AHZ36035 | 12098 | 42602 | 73106, 103610, 134114, 164618, 195122 |
| 5083 | ADI49352 | 5083 | 35587 | 66091, 96595, 127099, 157603, 188107 | 12099 | AHZ36047 | 12099 | 42603 | 73107, 103611, 134115, 164619, 195123 |
| 5084 | ADI49362 | 5084 | 35588 | 66092, 96596, 127100, 157604, 188108 | 12100 | AHZ36059 | 12100 | 42604 | 73108, 103612, 134116, 164620, 195124 |
| 5085 | ADI49382 | 5085 | 35589 | 66093, 96597, 127101, 157605, 188109 | 12101 | AHZ36070 | 12101 | 42605 | 73109, 103613, 134117, 164621, 195125 |
| 5086 | ADI49392 | 5086 | 35590 | 66094, 96598, 127102, 157606, 188110 | 12102 | AHZ36081 | 12102 | 42606 | 73110, 103614, 134118, 164622, 195126 |
| 5087 | ADI49717 | 5087 | 35591 | 66095, 96599, 127103, 157607, 188111 | 12103 | AHZ36092 | 12103 | 42607 | 73111, 103615, 134119, 164623, 195127 |

FIG. 1 continued

| | | | | | | | | | |
|---|---|---|---|---|---|---|---|---|---|
| 5088 | ADI49727 | 5088 | 35592 | 66096, 96600, 127104, 157608, 188112 | 12104 | AHZ36103 | 12104 | 42608 | 73112, 103616, 134120, 164624, 195128 |
| 5089 | ADI49737 | 5089 | 35593 | 66097, 96601, 127105, 157609, 188113 | 12105 | AHZ36114 | 12105 | 42609 | 73113, 103617, 134121, 164625, 195129 |
| 5090 | ADI49747 | 5090 | 35594 | 66098, 96602, 127106, 157610, 188114 | 12106 | AHZ36125 | 12106 | 42610 | 73114, 103618, 134122, 164626, 195130 |
| 5091 | ADI49757 | 5091 | 35595 | 66099, 96603, 127107, 157611, 188115 | 12107 | AHZ36136 | 12107 | 42611 | 73115, 103619, 134123, 164627, 195131 |
| 5092 | ADI49767 | 5092 | 35596 | 66100, 96604, 127108, 157612, 188116 | 12108 | AHZ36147 | 12108 | 42612 | 73116, 103620, 134124, 164628, 195132 |
| 5093 | ADI49777 | 5093 | 35597 | 66101, 96605, 127109, 157613, 188117 | 12109 | AHZ36158 | 12109 | 42613 | 73117, 103621, 134125, 164629, 195133 |
| 5094 | ADI49787 | 5094 | 35598 | 66102, 96606, 127110, 157614, 188118 | 12110 | AHZ36169 | 12110 | 42614 | 73118, 103622, 134126, 164630, 195134 |
| 5095 | ADI49822 | 5095 | 35599 | 66103, 96607, 127111, 157615, 188119 | 12111 | AHZ36180 | 12111 | 42615 | 73119, 103623, 134127, 164631, 195135 |
| 5096 | ADI50027 | 5096 | 35600 | 66104, 96608, 127112, 157616, 188120 | 12112 | AHZ36191 | 12112 | 42616 | 73120, 103624, 134128, 164632, 195136 |
| 5097 | ADI52834 | 5097 | 35601 | 66105, 96609, 127113, 157617, 188121 | 12113 | AHZ36203 | 12113 | 42617 | 73121, 103625, 134129, 164633, 195137 |
| 5098 | ADI52835 | 5098 | 35602 | 66106, 96610, 127114, 157618, 188122 | 12114 | AHZ36215 | 12114 | 42618 | 73122, 103626, 134130, 164634, 195138 |
| 5099 | ADI52836 | 5099 | 35603 | 66107, 96611, 127115, 157619, 188123 | 12115 | AHZ36226 | 12115 | 42619 | 73123, 103627, 134131, 164635, 195139 |
| 5100 | ADI52837 | 5100 | 35604 | 66108, 96612, 127116, 157620, 188124 | 12116 | AHZ36238 | 12116 | 42620 | 73124, 103628, 134132, 164636, 195140 |
| 5101 | ADI72915 | 5101 | 35605 | 66109, 96613, 127117, 157621, 188125 | 12117 | AHZ36249 | 12117 | 42621 | 73125, 103629, 134133, 164637, 195141 |
| 5102 | ADI72916 | 5102 | 35606 | 66110, 96614, 127118, 157622, 188126 | 12118 | AHZ36260 | 12118 | 42622 | 73126, 103630, 134134, 164638, 195142 |
| 5103 | ADI72917 | 5103 | 35607 | 66111, 96615, 127119, 157623, 188127 | 12119 | AHZ36271 | 12119 | 42623 | 73127, 103631, 134135, 164639, 195143 |
| 5104 | ADI72918 | 5104 | 35608 | 66112, 96616, 127120, 157624, 188128 | 12120 | AHZ36283 | 12120 | 42624 | 73128, 103632, 134136, 164640, 195144 |
| 5105 | ADI72919 | 5105 | 35609 | 66113, 96617, 127121, 157625, 188129 | 12121 | AHZ36294 | 12121 | 42625 | 73129, 103633, 134137, 164641, 195145 |

FIG. 1 continued

| | | | | | | | | | |
|---|---|---|---|---|---|---|---|---|---|
| 5106 | ADI72920 | 5106 | 35610 | 66114, 96618, 127122, 157626, 188130 | 12122 | AHZ36306 | 12122 | 42626 | 73130, 103634, 134138, 164642, 195146 |
| 5107 | ADI72921 | 5107 | 35611 | 66115, 96619, 127123, 157627, 188131 | 12123 | AHZ36317 | 12123 | 42627 | 73131, 103635, 134139, 164643, 195147 |
| 5108 | ADI72922 | 5108 | 35612 | 66116, 96620, 127124, 157628, 188132 | 12124 | AHZ36328 | 12124 | 42628 | 73132, 103636, 134140, 164644, 195148 |
| 5109 | ADI72923 | 5109 | 35613 | 66117, 96621, 127125, 157629, 188133 | 12125 | AHZ36339 | 12125 | 42629 | 73133, 103637, 134141, 164645, 195149 |
| 5110 | ADI72924 | 5110 | 35614 | 66118, 96622, 127126, 157630, 188134 | 12126 | AHZ36362 | 12126 | 42630 | 73134, 103638, 134142, 164646, 195150 |
| 5111 | ADI72925 | 5111 | 35615 | 66119, 96623, 127127, 157631, 188135 | 12127 | AHZ36385 | 12127 | 42631 | 73135, 103639, 134143, 164647, 195151 |
| 5112 | ADI72926 | 5112 | 35616 | 66120, 96624, 127128, 157632, 188136 | 12128 | AHZ36397 | 12128 | 42632 | 73136, 103640, 134144, 164648, 195152 |
| 5113 | ADI72927 | 5113 | 35617 | 66121, 96625, 127129, 157633, 188137 | 12129 | AHZ36409 | 12129 | 42633 | 73137, 103641, 134145, 164649, 195153 |
| 5114 | ADI72928 | 5114 | 35618 | 66122, 96626, 127130, 157634, 188138 | 12130 | AHZ36433 | 12130 | 42634 | 73138, 103642, 134146, 164650, 195154 |
| 5115 | ADI72929 | 5115 | 35619 | 66123, 96627, 127131, 157635, 188139 | 12131 | AHZ36445 | 12131 | 42635 | 73139, 103643, 134147, 164651, 195155 |
| 5116 | ADI72930 | 5116 | 35620 | 66124, 96628, 127132, 157636, 188140 | 12132 | AHZ36457 | 12132 | 42636 | 73140, 103644, 134148, 164652, 195156 |
| 5117 | ADI72931 | 5117 | 35621 | 66125, 96629, 127133, 157637, 188141 | 12133 | AHZ36469 | 12133 | 42637 | 73141, 103645, 134149, 164653, 195157 |
| 5118 | ADI72932 | 5118 | 35622 | 66126, 96630, 127134, 157638, 188142 | 12134 | AHZ36481 | 12134 | 42638 | 73142, 103646, 134150, 164654, 195158 |
| 5119 | ADI75818 | 5119 | 35623 | 66127, 96631, 127135, 157639, 188143 | 12135 | AHZ36493 | 12135 | 42639 | 73143, 103647, 134151, 164655, 195159 |
| 5120 | ADI75851 | 5120 | 35624 | 66128, 96632, 127136, 157640, 188144 | 12136 | AHZ36505 | 12136 | 42640 | 73144, 103648, 134152, 164656, 195160 |
| 5121 | ADI75884 | 5121 | 35625 | 66129, 96633, 127137, 157641, 188145 | 12137 | AHZ36517 | 12137 | 42641 | 73145, 103649, 134153, 164657, 195161 |
| 5122 | ADI75917 | 5122 | 35626 | 66130, 96634, 127138, 157642, 188146 | 12138 | AHZ36529 | 12138 | 42642 | 73146, 103650, 134154, 164658, 195162 |
| 5123 | ADI77349 | 5123 | 35627 | 66131, 96635, 127139, 157643, 188147 | 12139 | AHZ36541 | 12139 | 42643 | 73147, 103651, 134155, 164659, 195163 |

FIG. 1 continued

| | | | | | | | | | |
|---|---|---|---|---|---|---|---|---|---|
| 5124 | ADI77360 | 5124 | 35628 | 66132, 96636, 127140, 157644, 188148 | 12140 | AHZ36553 | 12140 | 42644 | 73148, 103652, 134156, 164660, 195164 |
| 5125 | ADI99498 | 5125 | 35629 | 66133, 96637, 127141, 157645, 188149 | 12141 | AHZ36565 | 12141 | 42645 | 73149, 103653, 134157, 164661, 195165 |
| 5126 | ADI99560 | 5126 | 35630 | 66134, 96638, 127142, 157646, 188150 | 12142 | AHZ36577 | 12142 | 42646 | 73150, 103654, 134158, 164662, 195166 |
| 5127 | ADI99570 | 5127 | 35631 | 66135, 96639, 127143, 157647, 188151 | 12143 | AHZ36589 | 12143 | 42647 | 73151, 103655, 134159, 164663, 195167 |
| 5128 | ADI99580 | 5128 | 35632 | 66136, 96640, 127144, 157648, 188152 | 12144 | AHZ36601 | 12144 | 42648 | 73152, 103656, 134160, 164664, 195168 |
| 5129 | ADI99590 | 5129 | 35633 | 66137, 96641, 127145, 157649, 188153 | 12145 | AHZ36613 | 12145 | 42649 | 73153, 103657, 134161, 164665, 195169 |
| 5130 | ADI99610 | 5130 | 35634 | 66138, 96642, 127146, 157650, 188154 | 12146 | AHZ36625 | 12146 | 42650 | 73154, 103658, 134162, 164666, 195170 |
| 5131 | ADI99620 | 5131 | 35635 | 66139, 96643, 127147, 157651, 188155 | 12147 | AHZ36637 | 12147 | 42651 | 73155, 103659, 134163, 164667, 195171 |
| 5132 | ADI99630 | 5132 | 35636 | 66140, 96644, 127148, 157652, 188156 | 12148 | AHZ36649 | 12148 | 42652 | 73156, 103660, 134164, 164668, 195172 |
| 5133 | ADI99640 | 5133 | 35637 | 66141, 96645, 127149, 157653, 188157 | 12149 | AHZ36661 | 12149 | 42653 | 73157, 103661, 134165, 164669, 195173 |
| 5134 | ADI99660 | 5134 | 35638 | 66142, 96646, 127150, 157654, 188158 | 12150 | AHZ36673 | 12150 | 42654 | 73158, 103662, 134166, 164670, 195174 |
| 5135 | ADI99670 | 5135 | 35639 | 66143, 96647, 127151, 157655, 188159 | 12151 | AHZ36685 | 12151 | 42655 | 73159, 103663, 134167, 164671, 195175 |
| 5136 | ADI99680 | 5136 | 35640 | 66144, 96648, 127152, 157656, 188160 | 12152 | AHZ39698 | 12152 | 42656 | 73160, 103664, 134168, 164672, 195176 |
| 5137 | ADI99690 | 5137 | 35641 | 66145, 96649, 127153, 157657, 188161 | 12153 | AHZ39722 | 12153 | 42657 | 73161, 103665, 134169, 164673, 195177 |
| 5138 | ADI99700 | 5138 | 35642 | 66146, 96650, 127154, 157658, 188162 | 12154 | AHZ39734 | 12154 | 42658 | 73162, 103666, 134170, 164674, 195178 |
| 5139 | ADI99710 | 5139 | 35643 | 66147, 96651, 127155, 157659, 188163 | 12155 | AHZ39746 | 12155 | 42659 | 73163, 103667, 134171, 164675, 195179 |
| 5140 | ADI99720 | 5140 | 35644 | 66148, 96652, 127156, 157660, 188164 | 12156 | AHZ39758 | 12156 | 42660 | 73164, 103668, 134172, 164676, 195180 |
| 5141 | ADI99730 | 5141 | 35645 | 66149, 96653, 127157, 157661, 188165 | 12157 | AHZ39770 | 12157 | 42661 | 73165, 103669, 134173, 164677, 195181 |

FIG. 1 continued

| | | | | | | | | | |
|---|---|---|---|---|---|---|---|---|---|
| 5142 | ADJ00497 | 5142 | 35646 | 66150, 96654, 127158, 157662, 188166 | 12158 | AHZ39782 | 12158 | 42662 | 73166, 103670, 134174, 164678, 195182 |
| 5143 | ADJ00498 | 5143 | 35647 | 66151, 96655, 127159, 157663, 188167 | 12159 | AHZ39794 | 12159 | 42663 | 73167, 103671, 134175, 164679, 195183 |
| 5144 | ADJ00501 | 5144 | 35648 | 66152, 96656, 127160, 157664, 188168 | 12160 | AHZ39806 | 12160 | 42664 | 73168, 103672, 134176, 164680, 195184 |
| 5145 | ADJ18163 | 5145 | 35649 | 66153, 96657, 127161, 157665, 188169 | 12161 | AHZ39818 | 12161 | 42665 | 73169, 103673, 134177, 164681, 195185 |
| 5146 | ADJ18165 | 5146 | 35650 | 66154, 96658, 127162, 157666, 188170 | 12162 | AHZ39841 | 12162 | 42666 | 73170, 103674, 134178, 164682, 195186 |
| 5147 | ADJ18167 | 5147 | 35651 | 66155, 96659, 127163, 157667, 188171 | 12163 | AHZ39853 | 12163 | 42667 | 73171, 103675, 134179, 164683, 195187 |
| 5148 | ADJ18169 | 5148 | 35652 | 66156, 96660, 127164, 157668, 188172 | 12164 | AHZ39865 | 12164 | 42668 | 73172, 103676, 134180, 164684, 195188 |
| 5149 | ADJ18171 | 5149 | 35653 | 66157, 96661, 127165, 157669, 188173 | 12165 | AHZ39877 | 12165 | 42669 | 73173, 103677, 134181, 164685, 195189 |
| 5150 | ADJ18173 | 5150 | 35654 | 66158, 96662, 127166, 157670, 188174 | 12166 | AHZ39889 | 12166 | 42670 | 73174, 103678, 134182, 164686, 195190 |
| 5151 | ADJ18175 | 5151 | 35655 | 66159, 96663, 127167, 157671, 188175 | 12167 | AHZ39913 | 12167 | 42671 | 73175, 103679, 134183, 164687, 195191 |
| 5152 | ADJ18177 | 5152 | 35656 | 66160, 96664, 127168, 157672, 188176 | 12168 | AHZ39925 | 12168 | 42672 | 73176, 103680, 134184, 164688, 195192 |
| 5153 | ADJ40444 | 5153 | 35657 | 66161, 96665, 127169, 157673, 188177 | 12169 | AHZ39937 | 12169 | 42673 | 73177, 103681, 134185, 164689, 195193 |
| 5154 | ADJ40454 | 5154 | 35658 | 66162, 96666, 127170, 157674, 188178 | 12170 | AHZ39949 | 12170 | 42674 | 73178, 103682, 134186, 164690, 195194 |
| 5155 | ADJ40464 | 5155 | 35659 | 66163, 96667, 127171, 157675, 188179 | 12171 | AHZ39961 | 12171 | 42675 | 73179, 103683, 134187, 164691, 195195 |
| 5156 | ADJ40474 | 5156 | 35660 | 66164, 96668, 127172, 157676, 188180 | 12172 | AHZ39973 | 12172 | 42676 | 73180, 103684, 134188, 164692, 195196 |
| 5157 | ADJ40494 | 5157 | 35661 | 66165, 96669, 127173, 157677, 188181 | 12173 | AHZ39985 | 12173 | 42677 | 73181, 103685, 134189, 164693, 195197 |
| 5158 | ADJ40514 | 5158 | 35662 | 66166, 96670, 127174, 157678, 188182 | 12174 | AHZ39997 | 12174 | 42678 | 73182, 103686, 134190, 164694, 195198 |
| 5159 | ADJ40524 | 5159 | 35663 | 66167, 96671, 127175, 157679, 188183 | 12175 | AHZ40009 | 12175 | 42679 | 73183, 103687, 134191, 164695, 195199 |

FIG. 1 continued

| | | | | | | | | | |
|---|---|---|---|---|---|---|---|---|---|
| 5160 | ADJ40534 | 5160 | 35664 | 66168, 96672, 127176, 157680, 188184 | 12176 | AHZ40021 | 12176 | 42680 | 73184, 103688, 134192, 164696, 195200 |
| 5161 | ADJ40554 | 5161 | 35665 | 66169, 96673, 127177, 157681, 188185 | 12177 | AHZ40033 | 12177 | 42681 | 73185, 103689, 134193, 164697, 195201 |
| 5162 | ADJ40564 | 5162 | 35666 | 66170, 96674, 127178, 157682, 188186 | 12178 | AHZ40045 | 12178 | 42682 | 73186, 103690, 134194, 164698, 195202 |
| 5163 | ADJ40574 | 5163 | 35667 | 66171, 96675, 127179, 157683, 188187 | 12179 | AHZ40060 | 12179 | 42683 | 73187, 103691, 134195, 164699, 195203 |
| 5164 | ADJ40584 | 5164 | 35668 | 66172, 96676, 127180, 157684, 188188 | 12180 | AHZ40072 | 12180 | 42684 | 73188, 103692, 134196, 164700, 195204 |
| 5165 | ADJ40594 | 5165 | 35669 | 66173, 96677, 127181, 157685, 188189 | 12181 | AHZ40084 | 12181 | 42685 | 73189, 103693, 134197, 164701, 195205 |
| 5166 | ADJ40604 | 5166 | 35670 | 66174, 96678, 127182, 157686, 188190 | 12182 | AHZ40096 | 12182 | 42686 | 73190, 103694, 134198, 164702, 195206 |
| 5167 | ADJ40614 | 5167 | 35671 | 66175, 96679, 127183, 157687, 188191 | 12183 | AHZ40108 | 12183 | 42687 | 73191, 103695, 134199, 164703, 195207 |
| 5168 | ADJ40634 | 5168 | 35672 | 66176, 96680, 127184, 157688, 188192 | 12184 | AHZ40120 | 12184 | 42688 | 73192, 103696, 134200, 164704, 195208 |
| 5169 | ADJ40644 | 5169 | 35673 | 66177, 96681, 127185, 157689, 188193 | 12185 | AHZ40130 | 12185 | 42689 | 73193, 103697, 134201, 164705, 195209 |
| 5170 | ADJ40654 | 5170 | 35674 | 66178, 96682, 127186, 157690, 188194 | 12186 | AHZ40142 | 12186 | 42690 | 73194, 103698, 134202, 164706, 195210 |
| 5171 | ADJ40664 | 5171 | 35675 | 66179, 96683, 127187, 157691, 188195 | 12187 | AHZ40154 | 12187 | 42691 | 73195, 103699, 134203, 164707, 195211 |
| 5172 | ADJ40674 | 5172 | 35676 | 66180, 96684, 127188, 157692, 188196 | 12188 | AHZ40166 | 12188 | 42692 | 73196, 103700, 134204, 164708, 195212 |
| 5173 | ADJ41816 | 5173 | 35677 | 66181, 96685, 127189, 157693, 188197 | 12189 | AHZ40177 | 12189 | 42693 | 73197, 103701, 134205, 164709, 195213 |
| 5174 | ADJ56640 | 5174 | 35678 | 66182, 96686, 127190, 157694, 188198 | 12190 | AHZ40189 | 12190 | 42694 | 73198, 103702, 134206, 164710, 195214 |
| 5175 | ADJ56650 | 5175 | 35679 | 66183, 96687, 127191, 157695, 188199 | 12191 | AHZ40201 | 12191 | 42695 | 73199, 103703, 134207, 164711, 195215 |
| 5176 | ADJ67983 | 5176 | 35680 | 66184, 96688, 127192, 157696, 188200 | 12192 | AHZ40213 | 12192 | 42696 | 73200, 103704, 134208, 164712, 195216 |
| 5177 | ADJ67984 | 5177 | 35681 | 66185, 96689, 127193, 157697, 188201 | 12193 | AHZ40225 | 12193 | 42697 | 73201, 103705, 134209, 164713, 195217 |

FIG. 1 continued

| | | | | | | | | | |
|---|---|---|---|---|---|---|---|---|---|
| 5178 | ADJ67985 | 5178 | 35682 | 66186, 96690, 127194, 157698, 188202 | 12194 | AHZ40237 | 12194 | 42698 | 73202, 103706, 134210, 164714, 195218 |
| 5179 | ADJ80241 | 5179 | 35683 | 66187, 96691, 127195, 157699, 188203 | 12195 | AHZ40249 | 12195 | 42699 | 73203, 103707, 134211, 164715, 195219 |
| 5180 | ADJ80242 | 5180 | 35684 | 66188, 96692, 127196, 157700, 188204 | 12196 | AHZ40261 | 12196 | 42700 | 73204, 103708, 134212, 164716, 195220 |
| 5181 | ADJ80243 | 5181 | 35685 | 66189, 96693, 127197, 157701, 188205 | 12197 | AHZ40273 | 12197 | 42701 | 73205, 103709, 134213, 164717, 195221 |
| 5182 | ADJ80634 | 5182 | 35686 | 66190, 96694, 127198, 157702, 188206 | 12198 | AHZ40285 | 12198 | 42702 | 73206, 103710, 134214, 164718, 195222 |
| 5183 | ADJ80644 | 5183 | 35687 | 66191, 96695, 127199, 157703, 188207 | 12199 | AHZ40297 | 12199 | 42703 | 73207, 103711, 134215, 164719, 195223 |
| 5184 | ADJ80654 | 5184 | 35688 | 66192, 96696, 127200, 157704, 188208 | 12200 | AHZ40309 | 12200 | 42704 | 73208, 103712, 134216, 164720, 195224 |
| 5185 | ADJ80674 | 5185 | 35689 | 66193, 96697, 127201, 157705, 188209 | 12201 | AHZ40321 | 12201 | 42705 | 73209, 103713, 134217, 164721, 195225 |
| 5186 | ADJ80684 | 5186 | 35690 | 66194, 96698, 127202, 157706, 188210 | 12202 | AHZ40333 | 12202 | 42706 | 73210, 103714, 134218, 164722, 195226 |
| 5187 | ADJ80694 | 5187 | 35691 | 66195, 96699, 127203, 157707, 188211 | 12203 | AHZ40345 | 12203 | 42707 | 73211, 103715, 134219, 164723, 195227 |
| 5188 | ADJ80704 | 5188 | 35692 | 66196, 96700, 127204, 157708, 188212 | 12204 | AHZ40357 | 12204 | 42708 | 73212, 103716, 134220, 164724, 195228 |
| 5189 | ADJ80714 | 5189 | 35693 | 66197, 96701, 127205, 157709, 188213 | 12205 | AHZ40369 | 12205 | 42709 | 73213, 103717, 134221, 164725, 195229 |
| 5190 | ADJ80724 | 5190 | 35694 | 66198, 96702, 127206, 157710, 188214 | 12206 | AHZ40381 | 12206 | 42710 | 73214, 103718, 134222, 164726, 195230 |
| 5191 | ADJ80734 | 5191 | 35695 | 66199, 96703, 127207, 157711, 188215 | 12207 | AHZ40393 | 12207 | 42711 | 73215, 103719, 134223, 164727, 195231 |
| 5192 | ADJ80744 | 5192 | 35696 | 66200, 96704, 127208, 157712, 188216 | 12208 | AHZ40405 | 12208 | 42712 | 73216, 103720, 134224, 164728, 195232 |
| 5193 | ADJ80754 | 5193 | 35697 | 66201, 96705, 127209, 157713, 188217 | 12209 | AHZ40417 | 12209 | 42713 | 73217, 103721, 134225, 164729, 195233 |
| 5194 | ADJ80774 | 5194 | 35698 | 66202, 96706, 127210, 157714, 188218 | 12210 | AHZ40429 | 12210 | 42714 | 73218, 103722, 134226, 164730, 195234 |
| 5195 | ADJ80784 | 5195 | 35699 | 66203, 96707, 127211, 157715, 188219 | 12211 | AHZ40441 | 12211 | 42715 | 73219, 103723, 134227, 164731, 195235 |

FIG. 1 continued

| | | | | | | | | | |
|---|---|---|---|---|---|---|---|---|---|
| 5196 | ADJ80794 | 5196 | 35700 | 66204, 96708, 127212, 157716, 188220 | 12212 | AHZ40453 | 12212 | 42716 | 73220, 103724, 134228, 164732, 195236 |
| 5197 | ADJ80804 | 5197 | 35701 | 66205, 96709, 127213, 157717, 188221 | 12213 | AHZ40465 | 12213 | 42717 | 73221, 103725, 134229, 164733, 195237 |
| 5198 | ADJ80814 | 5198 | 35702 | 66206, 96710, 127214, 157718, 188222 | 12214 | AHZ40477 | 12214 | 42718 | 73222, 103726, 134230, 164734, 195238 |
| 5199 | ADJ80834 | 5199 | 35703 | 66207, 96711, 127215, 157719, 188223 | 12215 | AHZ40489 | 12215 | 42719 | 73223, 103727, 134231, 164735, 195239 |
| 5200 | ADJ80848 | 5200 | 35704 | 66208, 96712, 127216, 157720, 188224 | 12216 | AHZ40500 | 12216 | 42720 | 73224, 103728, 134232, 164736, 195240 |
| 5201 | ADJ80858 | 5201 | 35705 | 66209, 96713, 127217, 157721, 188225 | 12217 | AHZ40512 | 12217 | 42721 | 73225, 103729, 134233, 164737, 195241 |
| 5202 | ADJ80868 | 5202 | 35706 | 66210, 96714, 127218, 157722, 188226 | 12218 | AHZ40524 | 12218 | 42722 | 73226, 103730, 134234, 164738, 195242 |
| 5203 | ADJ80883 | 5203 | 35707 | 66211, 96715, 127219, 157723, 188227 | 12219 | AHZ40536 | 12219 | 42723 | 73227, 103731, 134235, 164739, 195243 |
| 5204 | ADJ80893 | 5204 | 35708 | 66212, 96716, 127220, 157724, 188228 | 12220 | AHZ40548 | 12220 | 42724 | 73228, 103732, 134236, 164740, 195244 |
| 5205 | ADJ80910 | 5205 | 35709 | 66213, 96717, 127221, 157725, 188229 | 12221 | AHZ40572 | 12221 | 42725 | 73229, 103733, 134237, 164741, 195245 |
| 5206 | ADJ80927 | 5206 | 35710 | 66214, 96718, 127222, 157726, 188230 | 12222 | AHZ40583 | 12222 | 42726 | 73230, 103734, 134238, 164742, 195246 |
| 5207 | ADJ80937 | 5207 | 35711 | 66215, 96719, 127223, 157727, 188231 | 12223 | AHZ40595 | 12223 | 42727 | 73231, 103735, 134239, 164743, 195247 |
| 5208 | ADJ80947 | 5208 | 35712 | 66216, 96720, 127224, 157728, 188232 | 12224 | AHZ40606 | 12224 | 42728 | 73232, 103736, 134240, 164744, 195248 |
| 5209 | ADJ80967 | 5209 | 35713 | 66217, 96721, 127225, 157729, 188233 | 12225 | AHZ40618 | 12225 | 42729 | 73233, 103737, 134241, 164745, 195249 |
| 5210 | ADJ80977 | 5210 | 35714 | 66218, 96722, 127226, 157730, 188234 | 12226 | AHZ40626 | 12226 | 42730 | 73234, 103738, 134242, 164746, 195250 |
| 5211 | ADJ80993 | 5211 | 35715 | 66219, 96723, 127227, 157731, 188235 | 12227 | AHZ40638 | 12227 | 42731 | 73235, 103739, 134243, 164747, 195251 |
| 5212 | ADJ81003 | 5212 | 35716 | 66220, 96724, 127228, 157732, 188236 | 12228 | AHZ40650 | 12228 | 42732 | 73236, 103740, 134244, 164748, 195252 |
| 5213 | ADJ81013 | 5213 | 35717 | 66221, 96725, 127229, 157733, 188237 | 12229 | AHZ40662 | 12229 | 42733 | 73237, 103741, 134245, 164749, 195253 |

FIG. 1 continued

| | | | | | | | | | |
|---|---|---|---|---|---|---|---|---|---|
| 5214 | ADJ81023 | 5214 | 35718 | 66222, 96726, 127230, 157734, 188238 | 12230 | AHZ40674 | 12230 | 42734 | 73238, 103742, 134246, 164750, 195254 |
| 5215 | ADJ81033 | 5215 | 35719 | 66223, 96727, 127231, 157735, 188239 | 12231 | AHZ40686 | 12231 | 42735 | 73239, 103743, 134247, 164751, 195255 |
| 5216 | ADJ81043 | 5216 | 35720 | 66224, 96728, 127232, 157736, 188240 | 12232 | AHZ40698 | 12232 | 42736 | 73240, 103744, 134248, 164752, 195256 |
| 5217 | ADJ81053 | 5217 | 35721 | 66225, 96729, 127233, 157737, 188241 | 12233 | AHZ40710 | 12233 | 42737 | 73241, 103745, 134249, 164753, 195257 |
| 5218 | ADJ81063 | 5218 | 35722 | 66226, 96730, 127234, 157738, 188242 | 12234 | AHZ40722 | 12234 | 42738 | 73242, 103746, 134250, 164754, 195258 |
| 5219 | ADJ84772 | 5219 | 35723 | 66227, 96731, 127235, 157739, 188243 | 12235 | AHZ40734 | 12235 | 42739 | 73243, 103747, 134251, 164755, 195259 |
| 5220 | ADJ88782 | 5220 | 35724 | 66228, 96732, 127236, 157740, 188244 | 12236 | AHZ40746 | 12236 | 42740 | 73244, 103748, 134252, 164756, 195260 |
| 5221 | ADK21733 | 5221 | 35725 | 66229, 96733, 127237, 157741, 188245 | 12237 | AHZ40758 | 12237 | 42741 | 73245, 103749, 134253, 164757, 195261 |
| 5222 | ADK21743 | 5222 | 35726 | 66230, 96734, 127238, 157742, 188246 | 12238 | AHZ40782 | 12238 | 42742 | 73246, 103750, 134254, 164758, 195262 |
| 5223 | ADK21753 | 5223 | 35727 | 66231, 96735, 127239, 157743, 188247 | 12239 | AHZ40793 | 12239 | 42743 | 73247, 103751, 134255, 164759, 195263 |
| 5224 | ADK21763 | 5224 | 35728 | 66232, 96736, 127240, 157744, 188248 | 12240 | AHZ40804 | 12240 | 42744 | 73248, 103752, 134256, 164760, 195264 |
| 5225 | ADK21773 | 5225 | 35729 | 66233, 96737, 127241, 157745, 188249 | 12241 | AHZ40815 | 12241 | 42745 | 73249, 103753, 134257, 164761, 195265 |
| 5226 | ADK21783 | 5226 | 35730 | 66234, 96738, 127242, 157746, 188250 | 12242 | AHZ40826 | 12242 | 42746 | 73250, 103754, 134258, 164762, 195266 |
| 5227 | ADK21813 | 5227 | 35731 | 66235, 96739, 127243, 157747, 188251 | 12243 | AHZ40848 | 12243 | 42747 | 73251, 103755, 134259, 164763, 195267 |
| 5228 | ADK21823 | 5228 | 35732 | 66236, 96740, 127244, 157748, 188252 | 12244 | AHZ40881 | 12244 | 42748 | 73252, 103756, 134260, 164764, 195268 |
| 5229 | ADK21833 | 5229 | 35733 | 66237, 96741, 127245, 157749, 188253 | 12245 | AHZ40892 | 12245 | 42749 | 73253, 103757, 134261, 164765, 195269 |
| 5230 | ADK21843 | 5230 | 35734 | 66238, 96742, 127246, 157750, 188254 | 12246 | AHZ40914 | 12246 | 42750 | 73254, 103758, 134262, 164766, 195270 |
| 5231 | ADK21853 | 5231 | 35735 | 66239, 96743, 127247, 157751, 188255 | 12247 | AHZ40925 | 12247 | 42751 | 73255, 103759, 134263, 164767, 195271 |

FIG. 1 continued

| | | | | | | | | | |
|---|---|---|---|---|---|---|---|---|---|
| 5232 | ADK21863 | 5232 | 35736 | 66240, 96744, 127248, 157752, 188256 | 12248 | AHZ40936 | 12248 | 42752 | 73256, 103760, 134264, 164768, 195272 |
| 5233 | ADK21873 | 5233 | 35737 | 66241, 96745, 127249, 157753, 188257 | 12249 | AHZ40947 | 12249 | 42753 | 73257, 103761, 134265, 164769, 195273 |
| 5234 | ADK21883 | 5234 | 35738 | 66242, 96746, 127250, 157754, 188258 | 12250 | AHZ40958 | 12250 | 42754 | 73258, 103762, 134266, 164770, 195274 |
| 5235 | ADK21893 | 5235 | 35739 | 66243, 96747, 127251, 157755, 188259 | 12251 | AHZ40969 | 12251 | 42755 | 73259, 103763, 134267, 164771, 195275 |
| 5236 | ADK21903 | 5236 | 35740 | 66244, 96748, 127252, 157756, 188260 | 12252 | AHZ40980 | 12252 | 42756 | 73260, 103764, 134268, 164772, 195276 |
| 5237 | ADK21913 | 5237 | 35741 | 66245, 96749, 127253, 157757, 188261 | 12253 | AHZ40991 | 12253 | 42757 | 73261, 103765, 134269, 164773, 195277 |
| 5238 | ADK21923 | 5238 | 35742 | 66246, 96750, 127254, 157758, 188262 | 12254 | AHZ41002 | 12254 | 42758 | 73262, 103766, 134270, 164774, 195278 |
| 5239 | ADK21933 | 5239 | 35743 | 66247, 96751, 127255, 157759, 188263 | 12255 | AHZ41013 | 12255 | 42759 | 73263, 103767, 134271, 164775, 195279 |
| 5240 | ADK21943 | 5240 | 35744 | 66248, 96752, 127256, 157760, 188264 | 12256 | AHZ41024 | 12256 | 42760 | 73264, 103768, 134272, 164776, 195280 |
| 5241 | ADK21953 | 5241 | 35745 | 66249, 96753, 127257, 157761, 188265 | 12257 | AHZ41035 | 12257 | 42761 | 73265, 103769, 134273, 164777, 195281 |
| 5242 | ADK32390 | 5242 | 35746 | 66250, 96754, 127258, 157762, 188266 | 12258 | AHZ41046 | 12258 | 42762 | 73266, 103770, 134274, 164778, 195282 |
| 5243 | ADK32400 | 5243 | 35747 | 66251, 96755, 127259, 157763, 188267 | 12259 | AHZ41057 | 12259 | 42763 | 73267, 103771, 134275, 164779, 195283 |
| 5244 | ADK32420 | 5244 | 35748 | 66252, 96756, 127260, 157764, 188268 | 12260 | AHZ41068 | 12260 | 42764 | 73268, 103772, 134276, 164780, 195284 |
| 5245 | ADK32430 | 5245 | 35749 | 66253, 96757, 127261, 157765, 188269 | 12261 | AHZ41079 | 12261 | 42765 | 73269, 103773, 134277, 164781, 195285 |
| 5246 | ADK32440 | 5246 | 35750 | 66254, 96758, 127262, 157766, 188270 | 12262 | AHZ41090 | 12262 | 42766 | 73270, 103774, 134278, 164782, 195286 |
| 5247 | ADK32450 | 5247 | 35751 | 66255, 96759, 127263, 157767, 188271 | 12263 | AHZ41101 | 12263 | 42767 | 73271, 103775, 134279, 164783, 195287 |
| 5248 | ADK32460 | 5248 | 35752 | 66256, 96760, 127264, 157768, 188272 | 12264 | AHZ41112 | 12264 | 42768 | 73272, 103776, 134280, 164784, 195288 |
| 5249 | ADK32470 | 5249 | 35753 | 66257, 96761, 127265, 157769, 188273 | 12265 | AHZ41123 | 12265 | 42769 | 73273, 103777, 134281, 164785, 195289 |

FIG. 1 continued

| | | | | | | | | | |
|---|---|---|---|---|---|---|---|---|---|
| 5250 | ADK32480 | 5250 | 35754 | 66258, 96762, 127266, 157770, 188274 | 12266 | AHZ41134 | 12266 | 42770 | 73274, 103778, 134282, 164786, 195290 |
| 5251 | ADK32490 | 5251 | 35755 | 66259, 96763, 127267, 157771, 188275 | 12267 | AHZ41145 | 12267 | 42771 | 73275, 103779, 134283, 164787, 195291 |
| 5252 | ADK32502 | 5252 | 35756 | 66260, 96764, 127268, 157772, 188276 | 12268 | AHZ41156 | 12268 | 42772 | 73276, 103780, 134284, 164788, 195292 |
| 5253 | ADK32637 | 5253 | 35757 | 66261, 96765, 127269, 157773, 188277 | 12269 | AHZ41167 | 12269 | 42773 | 73277, 103781, 134285, 164789, 195293 |
| 5254 | ADK32647 | 5254 | 35758 | 66262, 96766, 127270, 157774, 188278 | 12270 | AHZ41178 | 12270 | 42774 | 73278, 103782, 134286, 164790, 195294 |
| 5255 | ADK32657 | 5255 | 35759 | 66263, 96767, 127271, 157775, 188279 | 12271 | AHZ41189 | 12271 | 42775 | 73279, 103783, 134287, 164791, 195295 |
| 5256 | ADK32677 | 5256 | 35760 | 66264, 96768, 127272, 157776, 188280 | 12272 | AHZ41246 | 12272 | 42776 | 73280, 103784, 134288, 164792, 195296 |
| 5257 | ADK32687 | 5257 | 35761 | 66265, 96769, 127273, 157777, 188281 | 12273 | AHZ41263 | 12273 | 42777 | 73281, 103785, 134289, 164793, 195297 |
| 5258 | ADK32697 | 5258 | 35762 | 66266, 96770, 127274, 157778, 188282 | 12274 | AHZ41281 | 12274 | 42778 | 73282, 103786, 134290, 164794, 195298 |
| 5259 | ADK32776 | 5259 | 35763 | 66267, 96771, 127275, 157779, 188283 | 12275 | AHZ41292 | 12275 | 42779 | 73283, 103787, 134291, 164795, 195299 |
| 5260 | ADK33621 | 5260 | 35764 | 66268, 96772, 127276, 157780, 188284 | 12276 | AHZ41303 | 12276 | 42780 | 73284, 103788, 134292, 164796, 195300 |
| 5261 | ADK33631 | 5261 | 35765 | 66269, 96773, 127277, 157781, 188285 | 12277 | AHZ41314 | 12277 | 42781 | 73285, 103789, 134293, 164797, 195301 |
| 5262 | ADK33641 | 5262 | 35766 | 66270, 96774, 127278, 157782, 188286 | 12278 | AHZ41325 | 12278 | 42782 | 73286, 103790, 134294, 164798, 195302 |
| 5263 | ADK33651 | 5263 | 35767 | 66271, 96775, 127279, 157783, 188287 | 12279 | AHZ41336 | 12279 | 42783 | 73287, 103791, 134295, 164799, 195303 |
| 5264 | ADK33661 | 5264 | 35768 | 66272, 96776, 127280, 157784, 188288 | 12280 | AHZ41347 | 12280 | 42784 | 73288, 103792, 134296, 164800, 195304 |
| 5265 | ADK33671 | 5265 | 35769 | 66273, 96777, 127281, 157785, 188289 | 12281 | AHZ41358 | 12281 | 42785 | 73289, 103793, 134297, 164801, 195305 |
| 5266 | ADK33681 | 5266 | 35770 | 66274, 96778, 127282, 157786, 188290 | 12282 | AHZ41366 | 12282 | 42786 | 73290, 103794, 134298, 164802, 195306 |
| 5267 | ADK33691 | 5267 | 35771 | 66275, 96779, 127283, 157787, 188291 | 12283 | AHZ41377 | 12283 | 42787 | 73291, 103795, 134299, 164803, 195307 |

FIG. 1 continued

| | | | | | | | | | |
|---|---|---|---|---|---|---|---|---|---|
| 5268 | ADK33701 | 5268 | 35772 | 66276, 96780, 127284, 157788, 188292 | 12284 | AHZ41388 | 12284 | 42788 | 73292, 103796, 134300, 164804, 195308 |
| 5269 | ADK33711 | 5269 | 35773 | 66277, 96781, 127285, 157789, 188293 | 12285 | AHZ41410 | 12285 | 42789 | 73293, 103797, 134301, 164805, 195309 |
| 5270 | ADK33721 | 5270 | 35774 | 66278, 96782, 127286, 157790, 188294 | 12286 | AHZ41432 | 12286 | 42790 | 73294, 103798, 134302, 164806, 195310 |
| 5271 | ADK33731 | 5271 | 35775 | 66279, 96783, 127287, 157791, 188295 | 12287 | AHZ41441 | 12287 | 42791 | 73295, 103799, 134303, 164807, 195311 |
| 5272 | ADK33741 | 5272 | 35776 | 66280, 96784, 127288, 157792, 188296 | 12288 | AHZ41452 | 12288 | 42792 | 73296, 103800, 134304, 164808, 195312 |
| 5273 | ADK33751 | 5273 | 35777 | 66281, 96785, 127289, 157793, 188297 | 12289 | AHZ41463 | 12289 | 42793 | 73297, 103801, 134305, 164809, 195313 |
| 5274 | ADK33761 | 5274 | 35778 | 66282, 96786, 127290, 157794, 188298 | 12290 | AHZ41473 | 12290 | 42794 | 73298, 103802, 134306, 164810, 195314 |
| 5275 | ADK33771 | 5275 | 35779 | 66283, 96787, 127291, 157795, 188299 | 12291 | AHZ41484 | 12291 | 42795 | 73299, 103803, 134307, 164811, 195315 |
| 5276 | ADK33781 | 5276 | 35780 | 66284, 96788, 127292, 157796, 188300 | 12292 | AHZ41495 | 12292 | 42796 | 73300, 103804, 134308, 164812, 195316 |
| 5277 | ADK33791 | 5277 | 35781 | 66285, 96789, 127293, 157797, 188301 | 12293 | AHZ41506 | 12293 | 42797 | 73301, 103805, 134309, 164813, 195317 |
| 5278 | ADK33801 | 5278 | 35782 | 66286, 96790, 127294, 157798, 188302 | 12294 | AHZ41517 | 12294 | 42798 | 73302, 103806, 134310, 164814, 195318 |
| 5279 | ADK33811 | 5279 | 35783 | 66287, 96791, 127295, 157799, 188303 | 12295 | AHZ41528 | 12295 | 42799 | 73303, 103807, 134311, 164815, 195319 |
| 5280 | ADK33821 | 5280 | 35784 | 66288, 96792, 127296, 157800, 188304 | 12296 | AHZ41539 | 12296 | 42800 | 73304, 103808, 134312, 164816, 195320 |
| 5281 | ADK33831 | 5281 | 35785 | 66289, 96793, 127297, 157801, 188305 | 12297 | AHZ41550 | 12297 | 42801 | 73305, 103809, 134313, 164817, 195321 |
| 5282 | ADK33841 | 5282 | 35786 | 66290, 96794, 127298, 157802, 188306 | 12298 | AHZ41561 | 12298 | 42802 | 73306, 103810, 134314, 164818, 195322 |
| 5283 | ADK33851 | 5283 | 35787 | 66291, 96795, 127299, 157803, 188307 | 12299 | AHZ41572 | 12299 | 42803 | 73307, 103811, 134315, 164819, 195323 |
| 5284 | ADK33861 | 5284 | 35788 | 66292, 96796, 127300, 157804, 188308 | 12300 | AHZ41583 | 12300 | 42804 | 73308, 103812, 134316, 164820, 195324 |
| 5285 | ADK33871 | 5285 | 35789 | 66293, 96797, 127301, 157805, 188309 | 12301 | AHZ41594 | 12301 | 42805 | 73309, 103813, 134317, 164821, 195325 |

FIG. 1 continued

| | | | | | | | | | |
|---|---|---|---|---|---|---|---|---|---|
| 5286 | ADK33881 | 5286 | 35790 | 66294, 96798, 127302, 157806, 188310 | 12302 | AHZ41605 | 12302 | 42806 | 73310, 103814, 134318, 164822, 195326 |
| 5287 | ADK33891 | 5287 | 35791 | 66295, 96799, 127303, 157807, 188311 | 12303 | AHZ41616 | 12303 | 42807 | 73311, 103815, 134319, 164823, 195327 |
| 5288 | ADK33901 | 5288 | 35792 | 66296, 96800, 127304, 157808, 188312 | 12304 | AHZ41627 | 12304 | 42808 | 73312, 103816, 134320, 164824, 195328 |
| 5289 | ADK33911 | 5289 | 35793 | 66297, 96801, 127305, 157809, 188313 | 12305 | AHZ41638 | 12305 | 42809 | 73313, 103817, 134321, 164825, 195329 |
| 5290 | ADK33931 | 5290 | 35794 | 66298, 96802, 127306, 157810, 188314 | 12306 | AHZ41649 | 12306 | 42810 | 73314, 103818, 134322, 164826, 195330 |
| 5291 | ADK33941 | 5291 | 35795 | 66299, 96803, 127307, 157811, 188315 | 12307 | AHZ41660 | 12307 | 42811 | 73315, 103819, 134323, 164827, 195331 |
| 5292 | ADK33951 | 5292 | 35796 | 66300, 96804, 127308, 157812, 188316 | 12308 | AHZ41671 | 12308 | 42812 | 73316, 103820, 134324, 164828, 195332 |
| 5293 | ADK33961 | 5293 | 35797 | 66301, 96805, 127309, 157813, 188317 | 12309 | AHZ41682 | 12309 | 42813 | 73317, 103821, 134325, 164829, 195333 |
| 5294 | ADK45312 | 5294 | 35798 | 66302, 96806, 127310, 157814, 188318 | 12310 | AHZ41693 | 12310 | 42814 | 73318, 103822, 134326, 164830, 195334 |
| 5295 | ADK45410 | 5295 | 35799 | 66303, 96807, 127311, 157815, 188319 | 12311 | AHZ41704 | 12311 | 42815 | 73319, 103823, 134327, 164831, 195335 |
| 5296 | ADK45421 | 5296 | 35800 | 66304, 96808, 127312, 157816, 188320 | 12312 | AHZ41715 | 12312 | 42816 | 73320, 103824, 134328, 164832, 195336 |
| 5297 | ADK45432 | 5297 | 35801 | 66305, 96809, 127313, 157817, 188321 | 12313 | AHZ41726 | 12313 | 42817 | 73321, 103825, 134329, 164833, 195337 |
| 5298 | ADK45443 | 5298 | 35802 | 66306, 96810, 127314, 157818, 188322 | 12314 | AHZ41737 | 12314 | 42818 | 73322, 103826, 134330, 164834, 195338 |
| 5299 | ADK48798 | 5299 | 35803 | 66307, 96811, 127315, 157819, 188323 | 12315 | AHZ41748 | 12315 | 42819 | 73323, 103827, 134331, 164835, 195339 |
| 5300 | ADK62683 | 5300 | 35804 | 66308, 96812, 127316, 157820, 188324 | 12316 | AHZ41759 | 12316 | 42820 | 73324, 103828, 134332, 164836, 195340 |
| 5301 | ADK62693 | 5301 | 35805 | 66309, 96813, 127317, 157821, 188325 | 12317 | AHZ42561 | 12317 | 42821 | 73325, 103829, 134333, 164837, 195341 |
| 5302 | ADK62703 | 5302 | 35806 | 66310, 96814, 127318, 157822, 188326 | 12318 | AHZ42572 | 12318 | 42822 | 73326, 103830, 134334, 164838, 195342 |
| 5303 | ADK64992 | 5303 | 35807 | 66311, 96815, 127319, 157823, 188327 | 12319 | AHZ42584 | 12319 | 42823 | 73327, 103831, 134335, 164839, 195343 |

FIG. 1 continued

| | | | | | | | | | |
|---|---|---|---|---|---|---|---|---|---|
| 5304 | ADK65001 | 5304 | 35808 | 66312, 96816, 127320, 157824, 188328 | 12320 | AHZ42596 | 12320 | 42824 | 73328, 103832, 134336, 164840, 195344 |
| 5305 | ADK65009 | 5305 | 35809 | 66313, 96817, 127321, 157825, 188329 | 12321 | AHZ42608 | 12321 | 42825 | 73329, 103833, 134337, 164841, 195345 |
| 5306 | ADK87287 | 5306 | 35810 | 66314, 96818, 127322, 157826, 188330 | 12322 | AHZ42619 | 12322 | 42826 | 73330, 103834, 134338, 164842, 195346 |
| 5307 | ADK87288 | 5307 | 35811 | 66315, 96819, 127323, 157827, 188331 | 12323 | AHZ42631 | 12323 | 42827 | 73331, 103835, 134339, 164843, 195347 |
| 5308 | ADK87289 | 5308 | 35812 | 66316, 96820, 127324, 157828, 188332 | 12324 | AHZ42643 | 12324 | 42828 | 73332, 103836, 134340, 164844, 195348 |
| 5309 | ADK87291 | 5309 | 35813 | 66317, 96821, 127325, 157829, 188333 | 12325 | AHZ42654 | 12325 | 42829 | 73333, 103837, 134341, 164845, 195349 |
| 5310 | ADK87293 | 5310 | 35814 | 66318, 96822, 127326, 157830, 188334 | 12326 | AHZ42666 | 12326 | 42830 | 73334, 103838, 134342, 164846, 195350 |
| 5311 | ADK87295 | 5311 | 35815 | 66319, 96823, 127327, 157831, 188335 | 12327 | AHZ42678 | 12327 | 42831 | 73335, 103839, 134343, 164847, 195351 |
| 5312 | ADK87296 | 5312 | 35816 | 66320, 96824, 127328, 157832, 188336 | 12328 | AHZ42690 | 12328 | 42832 | 73336, 103840, 134344, 164848, 195352 |
| 5313 | ADK87298 | 5313 | 35817 | 66321, 96825, 127329, 157833, 188337 | 12329 | AHZ42701 | 12329 | 42833 | 73337, 103841, 134345, 164849, 195353 |
| 5314 | ADK87300 | 5314 | 35818 | 66322, 96826, 127330, 157834, 188338 | 12330 | AHZ42713 | 12330 | 42834 | 73338, 103842, 134346, 164850, 195354 |
| 5315 | ADK87302 | 5315 | 35819 | 66323, 96827, 127331, 157835, 188339 | 12331 | AHZ42725 | 12331 | 42835 | 73339, 103843, 134347, 164851, 195355 |
| 5316 | ADK87304 | 5316 | 35820 | 66324, 96828, 127332, 157836, 188340 | 12332 | AHZ42737 | 12332 | 42836 | 73340, 103844, 134348, 164852, 195356 |
| 5317 | ADK87306 | 5317 | 35821 | 66325, 96829, 127333, 157837, 188341 | 12333 | AHZ42748 | 12333 | 42837 | 73341, 103845, 134349, 164853, 195357 |
| 5318 | ADK87308 | 5318 | 35822 | 66326, 96830, 127334, 157838, 188342 | 12334 | AHZ42760 | 12334 | 42838 | 73342, 103846, 134350, 164854, 195358 |
| 5319 | ADK87309 | 5319 | 35823 | 66327, 96831, 127335, 157839, 188343 | 12335 | AHZ42772 | 12335 | 42839 | 73343, 103847, 134351, 164855, 195359 |
| 5320 | ADK87310 | 5320 | 35824 | 66328, 96832, 127336, 157840, 188344 | 12336 | AHZ42784 | 12336 | 42840 | 73344, 103848, 134352, 164856, 195360 |
| 5321 | ADK87311 | 5321 | 35825 | 66329, 96833, 127337, 157841, 188345 | 12337 | AHZ42796 | 12337 | 42841 | 73345, 103849, 134353, 164857, 195361 |

FIG. 1 continued

| | | | | | | | | | |
|---|---|---|---|---|---|---|---|---|---|
| 5322 | ADK87313 | 5322 | 35826 | 66330, 96834, 127338, 157842, 188346 | 12338 | AHZ42808 | 12338 | 42842 | 73346, 103850, 134354, 164858, 195362 |
| 5323 | ADK87315 | 5323 | 35827 | 66331, 96835, 127339, 157843, 188347 | 12339 | AHZ42820 | 12339 | 42843 | 73347, 103851, 134355, 164859, 195363 |
| 5324 | ADK87317 | 5324 | 35828 | 66332, 96836, 127340, 157844, 188348 | 12340 | AHZ42831 | 12340 | 42844 | 73348, 103852, 134356, 164860, 195364 |
| 5325 | ADK87319 | 5325 | 35829 | 66333, 96837, 127341, 157845, 188349 | 12341 | AHZ42843 | 12341 | 42845 | 73349, 103853, 134357, 164861, 195365 |
| 5326 | ADK87321 | 5326 | 35830 | 66334, 96838, 127342, 157846, 188350 | 12342 | AHZ42855 | 12342 | 42846 | 73350, 103854, 134358, 164862, 195366 |
| 5327 | ADK87323 | 5327 | 35831 | 66335, 96839, 127343, 157847, 188351 | 12343 | AHZ42867 | 12343 | 42847 | 73351, 103855, 134359, 164863, 195367 |
| 5328 | ADK87325 | 5328 | 35832 | 66336, 96840, 127344, 157848, 188352 | 12344 | AHZ42879 | 12344 | 42848 | 73352, 103856, 134360, 164864, 195368 |
| 5329 | ADK87326 | 5329 | 35833 | 66337, 96841, 127345, 157849, 188353 | 12345 | AHZ42891 | 12345 | 42849 | 73353, 103857, 134361, 164865, 195369 |
| 5330 | ADK87328 | 5330 | 35834 | 66338, 96842, 127346, 157850, 188354 | 12346 | AHZ42903 | 12346 | 42850 | 73354, 103858, 134362, 164866, 195370 |
| 5331 | ADK87334 | 5331 | 35835 | 66339, 96843, 127347, 157851, 188355 | 12347 | AHZ42915 | 12347 | 42851 | 73355, 103859, 134363, 164867, 195371 |
| 5332 | ADK87336 | 5332 | 35836 | 66340, 96844, 127348, 157852, 188356 | 12348 | AHZ59747 | 12348 | 42852 | 73356, 103860, 134364, 164868, 195372 |
| 5333 | ADK87338 | 5333 | 35837 | 66341, 96845, 127349, 157853, 188357 | 12349 | AHZ59759 | 12349 | 42853 | 73357, 103861, 134365, 164869, 195373 |
| 5334 | ADK90193 | 5334 | 35838 | 66342, 96846, 127350, 157854, 188358 | 12350 | AHZ59771 | 12350 | 42854 | 73358, 103862, 134366, 164870, 195374 |
| 5335 | ADK90194 | 5335 | 35839 | 66343, 96847, 127351, 157855, 188359 | 12351 | AHZ59795 | 12351 | 42855 | 73359, 103863, 134367, 164871, 195375 |
| 5336 | ADK90195 | 5336 | 35840 | 66344, 96848, 127352, 157856, 188360 | 12352 | AHZ59807 | 12352 | 42856 | 73360, 103864, 134368, 164872, 195376 |
| 5337 | ADK90196 | 5337 | 35841 | 66345, 96849, 127353, 157857, 188361 | 12353 | AHZ59819 | 12353 | 42857 | 73361, 103865, 134369, 164873, 195377 |
| 5338 | ADK90197 | 5338 | 35842 | 66346, 96850, 127354, 157858, 188362 | 12354 | AHZ59831 | 12354 | 42858 | 73362, 103866, 134370, 164874, 195378 |
| 5339 | ADK90198 | 5339 | 35843 | 66347, 96851, 127355, 157859, 188363 | 12355 | AHZ59843 | 12355 | 42859 | 73363, 103867, 134371, 164875, 195379 |

FIG. 1 continued

| | | | | | | | | | |
|---|---|---|---|---|---|---|---|---|---|
| 5340 | ADK90199 | 5340 | 35844 | 66348, 96852, 127356, 157860, 188364 | 12356 | AHZ59855 | 12356 | 42860 | 73364, 103868, 134372, 164876, 195380 |
| 5341 | ADK90200 | 5341 | 35845 | 66349, 96853, 127357, 157861, 188365 | 12357 | AHZ59867 | 12357 | 42861 | 73365, 103869, 134373, 164877, 195381 |
| 5342 | ADK90201 | 5342 | 35846 | 66350, 96854, 127358, 157862, 188366 | 12358 | AHZ59879 | 12358 | 42862 | 73366, 103870, 134374, 164878, 195382 |
| 5343 | ADK90202 | 5343 | 35847 | 66351, 96855, 127359, 157863, 188367 | 12359 | AHZ59915 | 12359 | 42863 | 73367, 103871, 134375, 164879, 195383 |
| 5344 | ADK90203 | 5344 | 35848 | 66352, 96856, 127360, 157864, 188368 | 12360 | AHZ59927 | 12360 | 42864 | 73368, 103872, 134376, 164880, 195384 |
| 5345 | ADK90204 | 5345 | 35849 | 66353, 96857, 127361, 157865, 188369 | 12361 | AHZ59939 | 12361 | 42865 | 73369, 103873, 134377, 164881, 195385 |
| 5346 | ADK94191 | 5346 | 35850 | 66354, 96858, 127362, 157866, 188370 | 12362 | AHZ59951 | 12362 | 42866 | 73370, 103874, 134378, 164882, 195386 |
| 5347 | ADK94202 | 5347 | 35851 | 66355, 96859, 127363, 157867, 188371 | 12363 | AHZ59963 | 12363 | 42867 | 73371, 103875, 134379, 164883, 195387 |
| 5348 | ADK94213 | 5348 | 35852 | 66356, 96860, 127364, 157868, 188372 | 12364 | AHZ59988 | 12364 | 42868 | 73372, 103876, 134380, 164884, 195388 |
| 5349 | ADK94224 | 5349 | 35853 | 66357, 96861, 127365, 157869, 188373 | 12365 | AHZ60000 | 12365 | 42869 | 73373, 103877, 134381, 164885, 195389 |
| 5350 | ADK94257 | 5350 | 35854 | 66358, 96862, 127366, 157870, 188374 | 12366 | AHZ60012 | 12366 | 42870 | 73374, 103878, 134382, 164886, 195390 |
| 5351 | ADK94268 | 5351 | 35855 | 66359, 96863, 127367, 157871, 188375 | 12367 | AHZ60024 | 12367 | 42871 | 73375, 103879, 134383, 164887, 195391 |
| 5352 | ADK94279 | 5352 | 35856 | 66360, 96864, 127368, 157872, 188376 | 12368 | AHZ60036 | 12368 | 42872 | 73376, 103880, 134384, 164888, 195392 |
| 5353 | ADK94290 | 5353 | 35857 | 66361, 96865, 127369, 157873, 188377 | 12369 | AHZ60048 | 12369 | 42873 | 73377, 103881, 134385, 164889, 195393 |
| 5354 | ADK94301 | 5354 | 35858 | 66362, 96866, 127370, 157874, 188378 | 12370 | AHZ60060 | 12370 | 42874 | 73378, 103882, 134386, 164890, 195394 |
| 5355 | ADK94323 | 5355 | 35859 | 66363, 96867, 127371, 157875, 188379 | 12371 | AHZ60072 | 12371 | 42875 | 73379, 103883, 134387, 164891, 195395 |
| 5356 | ADK94441 | 5356 | 35860 | 66364, 96868, 127372, 157876, 188380 | 12372 | AHZ60084 | 12372 | 42876 | 73380, 103884, 134388, 164892, 195396 |
| 5357 | ADK94476 | 5357 | 35861 | 66365, 96869, 127373, 157877, 188381 | 12373 | AHZ60096 | 12373 | 42877 | 73381, 103885, 134389, 164893, 195397 |

FIG. 1 continued

| | | | | | | | | | |
|---|---|---|---|---|---|---|---|---|---|
| 5358 | ADK94487 | 5358 | 35862 | 66366, 96870, 127374, 157878, 188382 | 12374 | AIC64889 | 12374 | 42878 | 73382, 103886, 134390, 164894, 195398 |
| 5359 | ADK94498 | 5359 | 35863 | 66367, 96871, 127375, 157879, 188383 | 12375 | AIC73738 | 12375 | 42879 | 73383, 103887, 134391, 164895, 195399 |
| 5360 | ADK94509 | 5360 | 35864 | 66368, 96872, 127376, 157880, 188384 | 12376 | AIC73739 | 12376 | 42880 | 73384, 103888, 134392, 164896, 195400 |
| 5361 | ADK94520 | 5361 | 35865 | 66369, 96873, 127377, 157881, 188385 | 12377 | AIC73740 | 12377 | 42881 | 73385, 103889, 134393, 164897, 195401 |
| 5362 | ADK94531 | 5362 | 35866 | 66370, 96874, 127378, 157882, 188386 | 12378 | AIC73741 | 12378 | 42882 | 73386, 103890, 134394, 164898, 195402 |
| 5363 | ADK94542 | 5363 | 35867 | 66371, 96875, 127379, 157883, 188387 | 12379 | AIC73742 | 12379 | 42883 | 73387, 103891, 134395, 164899, 195403 |
| 5364 | ADK94553 | 5364 | 35868 | 66372, 96876, 127380, 157884, 188388 | 12380 | AIC73743 | 12380 | 42884 | 73388, 103892, 134396, 164900, 195404 |
| 5365 | ADK94564 | 5365 | 35869 | 66373, 96877, 127381, 157885, 188389 | 12381 | AIC73744 | 12381 | 42885 | 73389, 103893, 134397, 164901, 195405 |
| 5366 | ADK98501 | 5366 | 35870 | 66374, 96878, 127382, 157886, 188390 | 12382 | AIC73745 | 12382 | 42886 | 73390, 103894, 134398, 164902, 195406 |
| 5367 | ADK98503 | 5367 | 35871 | 66375, 96879, 127383, 157887, 188391 | 12383 | AIC73746 | 12383 | 42887 | 73391, 103895, 134399, 164903, 195407 |
| 5368 | ADK98623 | 5368 | 35872 | 66376, 96880, 127384, 157888, 188392 | 12384 | AIC73747 | 12384 | 42888 | 73392, 103896, 134400, 164904, 195408 |
| 5369 | ADK98634 | 5369 | 35873 | 66377, 96881, 127385, 157889, 188393 | 12385 | AIC73748 | 12385 | 42889 | 73393, 103897, 134401, 164905, 195409 |
| 5370 | ADK98645 | 5370 | 35874 | 66378, 96882, 127386, 157890, 188394 | 12386 | AIC73749 | 12386 | 42890 | 73394, 103898, 134402, 164906, 195410 |
| 5371 | ADK98656 | 5371 | 35875 | 66379, 96883, 127387, 157891, 188395 | 12387 | AIC73750 | 12387 | 42891 | 73395, 103899, 134403, 164907, 195411 |
| 5372 | ADK98667 | 5372 | 35876 | 66380, 96884, 127388, 157892, 188396 | 12388 | AIC73754 | 12388 | 42892 | 73396, 103900, 134404, 164908, 195412 |
| 5373 | ADK98678 | 5373 | 35877 | 66381, 96885, 127389, 157893, 188397 | 12389 | AIC73755 | 12389 | 42893 | 73397, 103901, 134405, 164909, 195413 |
| 5374 | ADK98689 | 5374 | 35878 | 66382, 96886, 127390, 157894, 188398 | 12390 | AIC73756 | 12390 | 42894 | 73398, 103902, 134406, 164910, 195414 |
| 5375 | ADK98700 | 5375 | 35879 | 66383, 96887, 127391, 157895, 188399 | 12391 | AIC73757 | 12391 | 42895 | 73399, 103903, 134407, 164911, 195415 |

FIG. 1 continued

| | | | | | | | | | |
|---|---|---|---|---|---|---|---|---|---|
| 5376 | ADK98711 | 5376 | 35880 | 66384, 96888, 127392, 157896, 188400 | 12392 | AIC73758 | 12392 | 42896 | 73400, 103904, 134408, 164912, 195416 |
| 5377 | ADK98722 | 5377 | 35881 | 66385, 96889, 127393, 157897, 188401 | 12393 | AIC73760 | 12393 | 42897 | 73401, 103905, 134409, 164913, 195417 |
| 5378 | ADK98733 | 5378 | 35882 | 66386, 96890, 127394, 157898, 188402 | 12394 | AIC73761 | 12394 | 42898 | 73402, 103906, 134410, 164914, 195418 |
| 5379 | ADK98744 | 5379 | 35883 | 66387, 96891, 127395, 157899, 188403 | 12395 | AIC73762 | 12395 | 42899 | 73403, 103907, 134411, 164915, 195419 |
| 5380 | ADK98777 | 5380 | 35884 | 66388, 96892, 127396, 157900, 188404 | 12396 | AIC73763 | 12396 | 42900 | 73404, 103908, 134412, 164916, 195420 |
| 5381 | ADK98788 | 5381 | 35885 | 66389, 96893, 127397, 157901, 188405 | 12397 | AIC73765 | 12397 | 42901 | 73405, 103909, 134413, 164917, 195421 |
| 5382 | ADK98799 | 5382 | 35886 | 66390, 96894, 127398, 157902, 188406 | 12398 | AIC73766 | 12398 | 42902 | 73406, 103910, 134414, 164918, 195422 |
| 5383 | ADK98810 | 5383 | 35887 | 66391, 96895, 127399, 157903, 188407 | 12399 | AIC73767 | 12399 | 42903 | 73407, 103911, 134415, 164919, 195423 |
| 5384 | ADK98821 | 5384 | 35888 | 66392, 96896, 127400, 157904, 188408 | 12400 | AIC73768 | 12400 | 42904 | 73408, 103912, 134416, 164920, 195424 |
| 5385 | ADK98832 | 5385 | 35889 | 66393, 96897, 127401, 157905, 188409 | 12401 | AIC73769 | 12401 | 42905 | 73409, 103913, 134417, 164921, 195425 |
| 5386 | ADK98843 | 5386 | 35890 | 66394, 96898, 127402, 157906, 188410 | 12402 | AIC73770 | 12402 | 42906 | 73410, 103914, 134418, 164922, 195426 |
| 5387 | ADK98854 | 5387 | 35891 | 66395, 96899, 127403, 157907, 188411 | 12403 | AIC73771 | 12403 | 42907 | 73411, 103915, 134419, 164923, 195427 |
| 5388 | ADK98865 | 5388 | 35892 | 66396, 96900, 127404, 157908, 188412 | 12404 | AIC73772 | 12404 | 42908 | 73412, 103916, 134420, 164924, 195428 |
| 5389 | ADK98876 | 5389 | 35893 | 66397, 96901, 127405, 157909, 188413 | 12405 | AIC73773 | 12405 | 42909 | 73413, 103917, 134421, 164925, 195429 |
| 5390 | ADK98887 | 5390 | 35894 | 66398, 96902, 127406, 157910, 188414 | 12406 | AIC73775 | 12406 | 42910 | 73414, 103918, 134422, 164926, 195430 |
| 5391 | ADK98898 | 5391 | 35895 | 66399, 96903, 127407, 157911, 188415 | 12407 | AIC73776 | 12407 | 42911 | 73415, 103919, 134423, 164927, 195431 |
| 5392 | ADK98909 | 5392 | 35896 | 66400, 96904, 127408, 157912, 188416 | 12408 | AIC73777 | 12408 | 42912 | 73416, 103920, 134424, 164928, 195432 |
| 5393 | ADK98920 | 5393 | 35897 | 66401, 96905, 127409, 157913, 188417 | 12409 | AIC73778 | 12409 | 42913 | 73417, 103921, 134425, 164929, 195433 |

FIG. 1 continued

| | | | | | | | | | |
|---|---|---|---|---|---|---|---|---|---|
| 5394 | ADK98931 | 5394 | 35898 | 66402, 96906, 127410, 157914, 188418 | 12410 | AIC73779 | 12410 | 42914 | 73418, 103922, 134426, 164930, 195434 |
| 5395 | ADK98942 | 5395 | 35899 | 66403, 96907, 127411, 157915, 188419 | 12411 | AIC73780 | 12411 | 42915 | 73419, 103923, 134427, 164931, 195435 |
| 5396 | ADK98953 | 5396 | 35900 | 66404, 96908, 127412, 157916, 188420 | 12412 | AIC73781 | 12412 | 42916 | 73420, 103924, 134428, 164932, 195436 |
| 5397 | ADK98964 | 5397 | 35901 | 66405, 96909, 127413, 157917, 188421 | 12413 | AIC73782 | 12413 | 42917 | 73421, 103925, 134429, 164933, 195437 |
| 5398 | ADK98975 | 5398 | 35902 | 66406, 96910, 127414, 157918, 188422 | 12414 | AIC73783 | 12414 | 42918 | 73422, 103926, 134430, 164934, 195438 |
| 5399 | ADK98986 | 5399 | 35903 | 66407, 96911, 127415, 157919, 188423 | 12415 | AIC73784 | 12415 | 42919 | 73423, 103927, 134431, 164935, 195439 |
| 5400 | ADK98997 | 5400 | 35904 | 66408, 96912, 127416, 157920, 188424 | 12416 | AIC73785 | 12416 | 42920 | 73424, 103928, 134432, 164936, 195440 |
| 5401 | ADK99008 | 5401 | 35905 | 66409, 96913, 127417, 157921, 188425 | 12417 | AIC73786 | 12417 | 42921 | 73425, 103929, 134433, 164937, 195441 |
| 5402 | ADK99030 | 5402 | 35906 | 66410, 96914, 127418, 157922, 188426 | 12418 | AIC73787 | 12418 | 42922 | 73426, 103930, 134434, 164938, 195442 |
| 5403 | ADK99041 | 5403 | 35907 | 66411, 96915, 127419, 157923, 188427 | 12419 | AIC73788 | 12419 | 42923 | 73427, 103931, 134435, 164939, 195443 |
| 5404 | ADK99063 | 5404 | 35908 | 66412, 96916, 127420, 157924, 188428 | 12420 | AIC73789 | 12420 | 42924 | 73428, 103932, 134436, 164940, 195444 |
| 5405 | ADK99085 | 5405 | 35909 | 66413, 96917, 127421, 157925, 188429 | 12421 | AIC73790 | 12421 | 42925 | 73429, 103933, 134437, 164941, 195445 |
| 5406 | ADK99096 | 5406 | 35910 | 66414, 96918, 127422, 157926, 188430 | 12422 | AIC73791 | 12422 | 42926 | 73430, 103934, 134438, 164942, 195446 |
| 5407 | ADK99107 | 5407 | 35911 | 66415, 96919, 127423, 157927, 188431 | 12423 | AIC73792 | 12423 | 42927 | 73431, 103935, 134439, 164943, 195447 |
| 5408 | ADK99118 | 5408 | 35912 | 66416, 96920, 127424, 157928, 188432 | 12424 | AIC73793 | 12424 | 42928 | 73432, 103936, 134440, 164944, 195448 |
| 5409 | ADK99129 | 5409 | 35913 | 66417, 96921, 127425, 157929, 188433 | 12425 | AIC73794 | 12425 | 42929 | 73433, 103937, 134441, 164945, 195449 |
| 5410 | ADK99140 | 5410 | 35914 | 66418, 96922, 127426, 157930, 188434 | 12426 | AIC73796 | 12426 | 42930 | 73434, 103938, 134442, 164946, 195450 |
| 5411 | ADK99151 | 5411 | 35915 | 66419, 96923, 127427, 157931, 188435 | 12427 | AIC73797 | 12427 | 42931 | 73435, 103939, 134443, 164947, 195451 |

FIG. 1 continued

| | | | | | | | | | |
|---|---|---|---|---|---|---|---|---|---|
| 5412 | ADK99162 | 5412 | 35916 | 66420, 96924, 127428, 157932, 188436 | 12428 | AIC73798 | 12428 | 42932 | 73436, 103940, 134444, 164948, 195452 |
| 5413 | ADK99173 | 5413 | 35917 | 66421, 96925, 127429, 157933, 188437 | 12429 | AIC73800 | 12429 | 42933 | 73437, 103941, 134445, 164949, 195453 |
| 5414 | ADK99184 | 5414 | 35918 | 66422, 96926, 127430, 157934, 188438 | 12430 | AIC73801 | 12430 | 42934 | 73438, 103942, 134446, 164950, 195454 |
| 5415 | ADK99195 | 5415 | 35919 | 66423, 96927, 127431, 157935, 188439 | 12431 | AIC73802 | 12431 | 42935 | 73439, 103943, 134447, 164951, 195455 |
| 5416 | ADK99206 | 5416 | 35920 | 66424, 96928, 127432, 157936, 188440 | 12432 | AIC73803 | 12432 | 42936 | 73440, 103944, 134448, 164952, 195456 |
| 5417 | ADK99217 | 5417 | 35921 | 66425, 96929, 127433, 157937, 188441 | 12433 | AIC73804 | 12433 | 42937 | 73441, 103945, 134449, 164953, 195457 |
| 5418 | ADK99228 | 5418 | 35922 | 66426, 96930, 127434, 157938, 188442 | 12434 | AIC73805 | 12434 | 42938 | 73442, 103946, 134450, 164954, 195458 |
| 5419 | ADK99239 | 5419 | 35923 | 66427, 96931, 127435, 157939, 188443 | 12435 | AIC73806 | 12435 | 42939 | 73443, 103947, 134451, 164955, 195459 |
| 5420 | ADK99250 | 5420 | 35924 | 66428, 96932, 127436, 157940, 188444 | 12436 | AIC73807 | 12436 | 42940 | 73444, 103948, 134452, 164956, 195460 |
| 5421 | ADK99261 | 5421 | 35925 | 66429, 96933, 127437, 157941, 188445 | 12437 | AIC73808 | 12437 | 42941 | 73445, 103949, 134453, 164957, 195461 |
| 5422 | ADK99283 | 5422 | 35926 | 66430, 96934, 127438, 157942, 188446 | 12438 | AIC73809 | 12438 | 42942 | 73446, 103950, 134454, 164958, 195462 |
| 5423 | ADK99294 | 5423 | 35927 | 66431, 96935, 127439, 157943, 188447 | 12439 | AIC73810 | 12439 | 42943 | 73447, 103951, 134455, 164959, 195463 |
| 5424 | ADK99305 | 5424 | 35928 | 66432, 96936, 127440, 157944, 188448 | 12440 | AIC73813 | 12440 | 42944 | 73448, 103952, 134456, 164960, 195464 |
| 5425 | ADL27989 | 5425 | 35929 | 66433, 96937, 127441, 157945, 188449 | 12441 | AIC73815 | 12441 | 42945 | 73449, 103953, 134457, 164961, 195465 |
| 5426 | ADL28000 | 5426 | 35930 | 66434, 96938, 127442, 157946, 188450 | 12442 | AIC73817 | 12442 | 42946 | 73450, 103954, 134458, 164962, 195466 |
| 5427 | ADL28011 | 5427 | 35931 | 66435, 96939, 127443, 157947, 188451 | 12443 | AIC73819 | 12443 | 42947 | 73451, 103955, 134459, 164963, 195467 |
| 5428 | ADL28022 | 5428 | 35932 | 66436, 96940, 127444, 157948, 188452 | 12444 | AIC73820 | 12444 | 42948 | 73452, 103956, 134460, 164964, 195468 |
| 5429 | ADL28033 | 5429 | 35933 | 66437, 96941, 127445, 157949, 188453 | 12445 | AIC73821 | 12445 | 42949 | 73453, 103957, 134461, 164965, 195469 |

FIG. 1 continued

| | | | | | | | | | |
|---|---|---|---|---|---|---|---|---|---|
| 5430 | ADL28044 | 5430 | 35934 | 66438, 96942, 127446, 157950, 188454 | 12446 | AIC73824 | 12446 | 42950 | 73454, 103958, 134462, 164966, 195470 |
| 5431 | ADL28055 | 5431 | 35935 | 66439, 96943, 127447, 157951, 188455 | 12447 | AIC73825 | 12447 | 42951 | 73455, 103959, 134463, 164967, 195471 |
| 5432 | ADL28066 | 5432 | 35936 | 66440, 96944, 127448, 157952, 188456 | 12448 | AIC73827 | 12448 | 42952 | 73456, 103960, 134464, 164968, 195472 |
| 5433 | ADL28077 | 5433 | 35937 | 66441, 96945, 127449, 157953, 188457 | 12449 | AIC73828 | 12449 | 42953 | 73457, 103961, 134465, 164969, 195473 |
| 5434 | ADL28088 | 5434 | 35938 | 66442, 96946, 127450, 157954, 188458 | 12450 | AIC73830 | 12450 | 42954 | 73458, 103962, 134466, 164970, 195474 |
| 5435 | ADL28099 | 5435 | 35939 | 66443, 96947, 127451, 157955, 188459 | 12451 | AIC73833 | 12451 | 42955 | 73459, 103963, 134467, 164971, 195475 |
| 5436 | ADL28110 | 5436 | 35940 | 66444, 96948, 127452, 157956, 188460 | 12452 | AIC73834 | 12452 | 42956 | 73460, 103964, 134468, 164972, 195476 |
| 5437 | ADL28126 | 5437 | 35941 | 66445, 96949, 127453, 157957, 188461 | 12453 | AIC73835 | 12453 | 42957 | 73461, 103965, 134469, 164973, 195477 |
| 5438 | ADL28137 | 5438 | 35942 | 66446, 96950, 127454, 157958, 188462 | 12454 | AIC73836 | 12454 | 42958 | 73462, 103966, 134470, 164974, 195478 |
| 5439 | ADL28148 | 5439 | 35943 | 66447, 96951, 127455, 157959, 188463 | 12455 | AIC73837 | 12455 | 42959 | 73463, 103967, 134471, 164975, 195479 |
| 5440 | ADL28170 | 5440 | 35944 | 66448, 96952, 127456, 157960, 188464 | 12456 | AIC73838 | 12456 | 42960 | 73464, 103968, 134472, 164976, 195480 |
| 5441 | ADL28181 | 5441 | 35945 | 66449, 96953, 127457, 157961, 188465 | 12457 | AIC73839 | 12457 | 42961 | 73465, 103969, 134473, 164977, 195481 |
| 5442 | ADL28192 | 5442 | 35946 | 66450, 96954, 127458, 157962, 188466 | 12458 | AIC73840 | 12458 | 42962 | 73466, 103970, 134474, 164978, 195482 |
| 5443 | ADL28203 | 5443 | 35947 | 66451, 96955, 127459, 157963, 188467 | 12459 | AIC73841 | 12459 | 42963 | 73467, 103971, 134475, 164979, 195483 |
| 5444 | ADL28214 | 5444 | 35948 | 66452, 96956, 127460, 157964, 188468 | 12460 | AIC73842 | 12460 | 42964 | 73468, 103972, 134476, 164980, 195484 |
| 5445 | ADL28225 | 5445 | 35949 | 66453, 96957, 127461, 157965, 188469 | 12461 | AID48082 | 12461 | 42965 | 73469, 103973, 134477, 164981, 195485 |
| 5446 | ADL28236 | 5446 | 35950 | 66454, 96958, 127462, 157966, 188470 | 12462 | AID70444 | 12462 | 42966 | 73470, 103974, 134478, 164982, 195486 |
| 5447 | ADL28247 | 5447 | 35951 | 66455, 96959, 127463, 157967, 188471 | 12463 | AID70445 | 12463 | 42967 | 73471, 103975, 134479, 164983, 195487 |

FIG. 1 continued

| | | | | | | | | | |
|---|---|---|---|---|---|---|---|---|---|
| 5448 | ADL28258 | 5448 | 35952 | 66456, 96960, 127464, 157968, 188472 | 12464 | AID70446 | 12464 | 42968 | 73472, 103976, 134480, 164984, 195488 |
| 5449 | ADL28370 | 5449 | 35953 | 66457, 96961, 127465, 157969, 188473 | 12465 | AID70447 | 12465 | 42969 | 73473, 103977, 134481, 164985, 195489 |
| 5450 | ADL29672 | 5450 | 35954 | 66458, 96962, 127466, 157970, 188474 | 12466 | AID70448 | 12466 | 42970 | 73474, 103978, 134482, 164986, 195490 |
| 5451 | ADL29682 | 5451 | 35955 | 66459, 96963, 127467, 157971, 188475 | 12467 | AID70449 | 12467 | 42971 | 73475, 103979, 134483, 164987, 195491 |
| 5452 | ADL29692 | 5452 | 35956 | 66460, 96964, 127468, 157972, 188476 | 12468 | AID70450 | 12468 | 42972 | 73476, 103980, 134484, 164988, 195492 |
| 5453 | ADL29702 | 5453 | 35957 | 66461, 96965, 127469, 157973, 188477 | 12469 | AID70451 | 12469 | 42973 | 73477, 103981, 134485, 164989, 195493 |
| 5454 | ADL29730 | 5454 | 35958 | 66462, 96966, 127470, 157974, 188478 | 12470 | AID70452 | 12470 | 42974 | 73478, 103982, 134486, 164990, 195494 |
| 5455 | ADL29740 | 5455 | 35959 | 66463, 96967, 127471, 157975, 188479 | 12471 | AID70453 | 12471 | 42975 | 73479, 103983, 134487, 164991, 195495 |
| 5456 | ADL29750 | 5456 | 35960 | 66464, 96968, 127472, 157976, 188480 | 12472 | AID70454 | 12472 | 42976 | 73480, 103984, 134488, 164992, 195496 |
| 5457 | ADL29760 | 5457 | 35961 | 66465, 96969, 127473, 157977, 188481 | 12473 | AID70455 | 12473 | 42977 | 73481, 103985, 134489, 164993, 195497 |
| 5458 | ADL29770 | 5458 | 35962 | 66466, 96970, 127474, 157978, 188482 | 12474 | AID70456 | 12474 | 42978 | 73482, 103986, 134490, 164994, 195498 |
| 5459 | ADL29780 | 5459 | 35963 | 66467, 96971, 127475, 157979, 188483 | 12475 | AID70457 | 12475 | 42979 | 73483, 103987, 134491, 164995, 195499 |
| 5460 | ADL29879 | 5460 | 35964 | 66468, 96972, 127476, 157980, 188484 | 12476 | AID70458 | 12476 | 42980 | 73484, 103988, 134492, 164996, 195500 |
| 5461 | ADL32017 | 5461 | 35965 | 66469, 96973, 127477, 157981, 188485 | 12477 | AID70459 | 12477 | 42981 | 73485, 103989, 134493, 164997, 195501 |
| 5462 | ADL32037 | 5462 | 35966 | 66470, 96974, 127478, 157982, 188486 | 12478 | AID70460 | 12478 | 42982 | 73486, 103990, 134494, 164998, 195502 |
| 5463 | ADL32047 | 5463 | 35967 | 66471, 96975, 127479, 157983, 188487 | 12479 | AID70461 | 12479 | 42983 | 73487, 103991, 134495, 164999, 195503 |
| 5464 | ADL32057 | 5464 | 35968 | 66472, 96976, 127480, 157984, 188488 | 12480 | AID70463 | 12480 | 42984 | 73488, 103992, 134496, 165000, 195504 |
| 5465 | ADL32090 | 5465 | 35969 | 66473, 96977, 127481, 157985, 188489 | 12481 | AID70464 | 12481 | 42985 | 73489, 103993, 134497, 165001, 195505 |

FIG. 1 continued

| | | | | | | | | | |
|---|---|---|---|---|---|---|---|---|---|
| 5466 | ADL32114 | 5466 | 35970 | 66474, 96978, 127482, 157986, 188490 | 12482 | AID70465 | 12482 | 42986 | 73490, 103994, 134498, 165002, 195506 |
| 5467 | ADL32344 | 5467 | 35971 | 66475, 96979, 127483, 157987, 188491 | 12483 | AID70466 | 12483 | 42987 | 73491, 103995, 134499, 165003, 195507 |
| 5468 | ADL32354 | 5468 | 35972 | 66476, 96980, 127484, 157988, 188492 | 12484 | AID70467 | 12484 | 42988 | 73492, 103996, 134500, 165004, 195508 |
| 5469 | ADL32364 | 5469 | 35973 | 66477, 96981, 127485, 157989, 188493 | 12485 | AID70468 | 12485 | 42989 | 73493, 103997, 134501, 165005, 195509 |
| 5470 | ADL32374 | 5470 | 35974 | 66478, 96982, 127486, 157990, 188494 | 12486 | AID70469 | 12486 | 42990 | 73494, 103998, 134502, 165006, 195510 |
| 5471 | ADL32384 | 5471 | 35975 | 66479, 96983, 127487, 157991, 188495 | 12487 | AID70470 | 12487 | 42991 | 73495, 103999, 134503, 165007, 195511 |
| 5472 | ADL32394 | 5472 | 35976 | 66480, 96984, 127488, 157992, 188496 | 12488 | AID70471 | 12488 | 42992 | 73496, 104000, 134504, 165008, 195512 |
| 5473 | ADL32404 | 5473 | 35977 | 66481, 96985, 127489, 157993, 188497 | 12489 | AID70472 | 12489 | 42993 | 73497, 104001, 134505, 165009, 195513 |
| 5474 | ADL32414 | 5474 | 35978 | 66482, 96986, 127490, 157994, 188498 | 12490 | AID70473 | 12490 | 42994 | 73498, 104002, 134506, 165010, 195514 |
| 5475 | ADL32424 | 5475 | 35979 | 66483, 96987, 127491, 157995, 188499 | 12491 | AID70474 | 12491 | 42995 | 73499, 104003, 134507, 165011, 195515 |
| 5476 | ADL32434 | 5476 | 35980 | 66484, 96988, 127492, 157996, 188500 | 12492 | AID70475 | 12492 | 42996 | 73500, 104004, 134508, 165012, 195516 |
| 5477 | ADL32444 | 5477 | 35981 | 66485, 96989, 127493, 157997, 188501 | 12493 | AID70476 | 12493 | 42997 | 73501, 104005, 134509, 165013, 195517 |
| 5478 | ADL32454 | 5478 | 35982 | 66486, 96990, 127494, 157998, 188502 | 12494 | AID70477 | 12494 | 42998 | 73502, 104006, 134510, 165014, 195518 |
| 5479 | ADL32464 | 5479 | 35983 | 66487, 96991, 127495, 157999, 188503 | 12495 | AID70478 | 12495 | 42999 | 73503, 104007, 134511, 165015, 195519 |
| 5480 | ADL32484 | 5480 | 35984 | 66488, 96992, 127496, 158000, 188504 | 12496 | AID70632 | 12496 | 43000 | 73504, 104008, 134512, 165016, 195520 |
| 5481 | ADL32504 | 5481 | 35985 | 66489, 96993, 127497, 158001, 188505 | 12497 | AID70634 | 12497 | 43001 | 73505, 104009, 134513, 165017, 195521 |
| 5482 | ADL32514 | 5482 | 35986 | 66490, 96994, 127498, 158002, 188506 | 12498 | AIF72902 | 12498 | 43002 | 73506, 104010, 134514, 165018, 195522 |
| 5483 | ADL32524 | 5483 | 35987 | 66491, 96995, 127499, 158003, 188507 | 12499 | AIF72903 | 12499 | 43003 | 73507, 104011, 134515, 165019, 195523 |

FIG. 1 continued

| | | | | | | | | | |
|---|---|---|---|---|---|---|---|---|---|
| 5484 | ADL32544 | 5484 | 35988 | 66492, 96996, 127500, 158004, 188508 | 12500 | AIF72904 | 12500 | 43004 | 73508, 104012, 134516, 165020, 195524 |
| 5485 | ADL32554 | 5485 | 35989 | 66493, 96997, 127501, 158005, 188509 | 12501 | AIF72905 | 12501 | 43005 | 73509, 104013, 134517, 165021, 195525 |
| 5486 | ADL32670 | 5486 | 35990 | 66494, 96998, 127502, 158006, 188510 | 12502 | AIF72906 | 12502 | 43006 | 73510, 104014, 134518, 165022, 195526 |
| 5487 | ADL32690 | 5487 | 35991 | 66495, 96999, 127503, 158007, 188511 | 12503 | AIF72907 | 12503 | 43007 | 73511, 104015, 134519, 165023, 195527 |
| 5488 | ADL32710 | 5488 | 35992 | 66496, 97000, 127504, 158008, 188512 | 12504 | AIF72908 | 12504 | 43008 | 73512, 104016, 134520, 165024, 195528 |
| 5489 | ADL32720 | 5489 | 35993 | 66497, 97001, 127505, 158009, 188513 | 12505 | AIF72909 | 12505 | 43009 | 73513, 104017, 134521, 165025, 195529 |
| 5490 | ADL32730 | 5490 | 35994 | 66498, 97002, 127506, 158010, 188514 | 12506 | AIF72910 | 12506 | 43010 | 73514, 104018, 134522, 165026, 195530 |
| 5491 | ADL32740 | 5491 | 35995 | 66499, 97003, 127507, 158011, 188515 | 12507 | AIF72911 | 12507 | 43011 | 73515, 104019, 134523, 165027, 195531 |
| 5492 | ADL39137 | 5492 | 35996 | 66500, 97004, 127508, 158012, 188516 | 12508 | AIF72912 | 12508 | 43012 | 73516, 104020, 134524, 165028, 195532 |
| 5493 | ADL39148 | 5493 | 35997 | 66501, 97005, 127509, 158013, 188517 | 12509 | AIF72913 | 12509 | 43013 | 73517, 104021, 134525, 165029, 195533 |
| 5494 | ADL39159 | 5494 | 35998 | 66502, 97006, 127510, 158014, 188518 | 12510 | AIF72914 | 12510 | 43014 | 73518, 104022, 134526, 165030, 195534 |
| 5495 | ADL39170 | 5495 | 35999 | 66503, 97007, 127511, 158015, 188519 | 12511 | AIF72915 | 12511 | 43015 | 73519, 104023, 134527, 165031, 195535 |
| 5496 | ADL39203 | 5496 | 36000 | 66504, 97008, 127512, 158016, 188520 | 12512 | AIF72916 | 12512 | 43016 | 73520, 104024, 134528, 165032, 195536 |
| 5497 | ADL39214 | 5497 | 36001 | 66505, 97009, 127513, 158017, 188521 | 12513 | AIF72917 | 12513 | 43017 | 73521, 104025, 134529, 165033, 195537 |
| 5498 | ADL39225 | 5498 | 36002 | 66506, 97010, 127514, 158018, 188522 | 12514 | AIG44693 | 12514 | 43018 | 73522, 104026, 134530, 165034, 195538 |
| 5499 | ADL39236 | 5499 | 36003 | 66507, 97011, 127515, 158019, 188523 | 12515 | AIJ10728 | 12515 | 43019 | 73523, 104027, 134531, 165035, 195539 |
| 5500 | ADL39280 | 5500 | 36004 | 66508, 97012, 127516, 158020, 188524 | 12516 | AIJ10729 | 12516 | 43020 | 73524, 104028, 134532, 165036, 195540 |
| 5501 | ADL39291 | 5501 | 36005 | 66509, 97013, 127517, 158021, 188525 | 12517 | AIJ10730 | 12517 | 43021 | 73525, 104029, 134533, 165037, 195541 |

FIG. 1 continued

| | | | | | | | | | |
|---|---|---|---|---|---|---|---|---|---|
| 5502 | ADL39302 | 5502 | 36006 | 66510, 97014, 127518, 158022, 188526 | 12518 | AIJ10731 | 12518 | 43022 | 73526, 104030, 134534, 165038, 195542 |
| 5503 | ADL39313 | 5503 | 36007 | 66511, 97015, 127519, 158023, 188527 | 12519 | AIJ10732 | 12519 | 43023 | 73527, 104031, 134535, 165039, 195543 |
| 5504 | ADL39335 | 5504 | 36008 | 66512, 97016, 127520, 158024, 188528 | 12520 | AIJ10733 | 12520 | 43024 | 73528, 104032, 134536, 165040, 195544 |
| 5505 | ADL39368 | 5505 | 36009 | 66513, 97017, 127521, 158025, 188529 | 12521 | AIJ10734 | 12521 | 43025 | 73529, 104033, 134537, 165041, 195545 |
| 5506 | ADL39390 | 5506 | 36010 | 66514, 97018, 127522, 158026, 188530 | 12522 | AIJ10735 | 12522 | 43026 | 73530, 104034, 134538, 165042, 195546 |
| 5507 | ADL39401 | 5507 | 36011 | 66515, 97019, 127523, 158027, 188531 | 12523 | AIJ10736 | 12523 | 43027 | 73531, 104035, 134539, 165043, 195547 |
| 5508 | ADL39412 | 5508 | 36012 | 66516, 97020, 127524, 158028, 188532 | 12524 | AIJ10737 | 12524 | 43028 | 73532, 104036, 134540, 165044, 195548 |
| 5509 | ADL39423 | 5509 | 36013 | 66517, 97021, 127525, 158029, 188533 | 12525 | AIJ10738 | 12525 | 43029 | 73533, 104037, 134541, 165045, 195549 |
| 5510 | ADL39434 | 5510 | 36014 | 66518, 97022, 127526, 158030, 188534 | 12526 | AIJ10740 | 12526 | 43030 | 73534, 104038, 134542, 165046, 195550 |
| 5511 | ADL39445 | 5511 | 36015 | 66519, 97023, 127527, 158031, 188535 | 12527 | AIJ10741 | 12527 | 43031 | 73535, 104039, 134543, 165047, 195551 |
| 5512 | ADL39456 | 5512 | 36016 | 66520, 97024, 127528, 158032, 188536 | 12528 | AIJ10742 | 12528 | 43032 | 73536, 104040, 134544, 165048, 195552 |
| 5513 | ADL39467 | 5513 | 36017 | 66521, 97025, 127529, 158033, 188537 | 12529 | AIJ10743 | 12529 | 43033 | 73537, 104041, 134545, 165049, 195553 |
| 5514 | ADL41164 | 5514 | 36018 | 66522, 97026, 127530, 158034, 188538 | 12530 | AIJ10744 | 12530 | 43034 | 73538, 104042, 134546, 165050, 195554 |
| 5515 | ADL41173 | 5515 | 36019 | 66523, 97027, 127531, 158035, 188539 | 12531 | AIJ10745 | 12531 | 43035 | 73539, 104043, 134547, 165051, 195555 |
| 5516 | ADL60242 | 5516 | 36020 | 66524, 97028, 127532, 158036, 188540 | 12532 | AIJ10747 | 12532 | 43036 | 73540, 104044, 134548, 165052, 195556 |
| 5517 | ADL60253 | 5517 | 36021 | 66525, 97029, 127533, 158037, 188541 | 12533 | AIJ10748 | 12533 | 43037 | 73541, 104045, 134549, 165053, 195557 |
| 5518 | ADL60264 | 5518 | 36022 | 66526, 97030, 127534, 158038, 188542 | 12534 | AIJ10750 | 12534 | 43038 | 73542, 104046, 134550, 165054, 195558 |
| 5519 | ADL60275 | 5519 | 36023 | 66527, 97031, 127535, 158039, 188543 | 12535 | AIJ10752 | 12535 | 43039 | 73543, 104047, 134551, 165055, 195559 |

FIG. 1 continued

| | | | | | | | | | |
|---|---|---|---|---|---|---|---|---|---|
| 5520 | ADL60286 | 5520 | 36024 | 66528, 97032, 127536, 158040, 188544 | 12536 | AIJ10753 | 12536 | 43040 | 73544, 104048, 134552, 165056, 195560 |
| 5521 | ADL60297 | 5521 | 36025 | 66529, 97033, 127537, 158041, 188545 | 12537 | AIJ10754 | 12537 | 43041 | 73545, 104049, 134553, 165057, 195561 |
| 5522 | ADL60308 | 5522 | 36026 | 66530, 97034, 127538, 158042, 188546 | 12538 | AIJ10755 | 12538 | 43042 | 73546, 104050, 134554, 165058, 195562 |
| 5523 | ADL60341 | 5523 | 36027 | 66531, 97035, 127539, 158043, 188547 | 12539 | AIJ10756 | 12539 | 43043 | 73547, 104051, 134555, 165059, 195563 |
| 5524 | ADL60352 | 5524 | 36028 | 66532, 97036, 127540, 158044, 188548 | 12540 | AIJ10757 | 12540 | 43044 | 73548, 104052, 134556, 165060, 195564 |
| 5525 | ADL60363 | 5525 | 36029 | 66533, 97037, 127541, 158045, 188549 | 12541 | AIJ10758 | 12541 | 43045 | 73549, 104053, 134557, 165061, 195565 |
| 5526 | ADL60374 | 5526 | 36030 | 66534, 97038, 127542, 158046, 188550 | 12542 | AIJ10759 | 12542 | 43046 | 73550, 104054, 134558, 165062, 195566 |
| 5527 | ADM07135 | 5527 | 36031 | 66535, 97039, 127543, 158047, 188551 | 12543 | AIJ10760 | 12543 | 43047 | 73551, 104055, 134559, 165063, 195567 |
| 5528 | ADM07144 | 5528 | 36032 | 66536, 97040, 127544, 158048, 188552 | 12544 | AIJ10761 | 12544 | 43048 | 73552, 104056, 134560, 165064, 195568 |
| 5529 | ADM07154 | 5529 | 36033 | 66537, 97041, 127545, 158049, 188553 | 12545 | AIJ10762 | 12545 | 43049 | 73553, 104057, 134561, 165065, 195569 |
| 5530 | ADM07163 | 5530 | 36034 | 66538, 97042, 127546, 158050, 188554 | 12546 | AIJ10763 | 12546 | 43050 | 73554, 104058, 134562, 165066, 195570 |
| 5531 | ADM07460 | 5531 | 36035 | 66539, 97043, 127547, 158051, 188555 | 12547 | AIJ10764 | 12547 | 43051 | 73555, 104059, 134563, 165067, 195571 |
| 5532 | ADM07504 | 5532 | 36036 | 66540, 97044, 127548, 158052, 188556 | 12548 | AIJ10765 | 12548 | 43052 | 73556, 104060, 134564, 165068, 195572 |
| 5533 | ADM12806 | 5533 | 36037 | 66541, 97045, 127549, 158053, 188557 | 12549 | AIJ10766 | 12549 | 43053 | 73557, 104061, 134565, 165069, 195573 |
| 5534 | ADM12817 | 5534 | 36038 | 66542, 97046, 127550, 158054, 188558 | 12550 | AIJ10767 | 12550 | 43054 | 73558, 104062, 134566, 165070, 195574 |
| 5535 | ADM12828 | 5535 | 36039 | 66543, 97047, 127551, 158055, 188559 | 12551 | AIJ10768 | 12551 | 43055 | 73559, 104063, 134567, 165071, 195575 |
| 5536 | ADM12839 | 5536 | 36040 | 66544, 97048, 127552, 158056, 188560 | 12552 | AIJ10769 | 12552 | 43056 | 73560, 104064, 134568, 165072, 195576 |
| 5537 | ADM12850 | 5537 | 36041 | 66545, 97049, 127553, 158057, 188561 | 12553 | AIJ10770 | 12553 | 43057 | 73561, 104065, 134569, 165073, 195577 |

FIG. 1 continued

| | | | | | | | | | |
|---|---|---|---|---|---|---|---|---|---|
| 5538 | ADMI2861 | 5538 | 36042 | 66546, 97050, 127554, 158058, 188562 | 12554 | AIJI0771 | 12554 | 43058 | 73562, 104066, 134570, 165074, 195578 |
| 5539 | ADMI2871 | 5539 | 36043 | 66547, 97051, 127555, 158059, 188563 | 12555 | AIJI0772 | 12555 | 43059 | 73563, 104067, 134571, 165075, 195579 |
| 5540 | ADMI2881 | 5540 | 36044 | 66548, 97052, 127556, 158060, 188564 | 12556 | AIJI0773 | 12556 | 43060 | 73564, 104068, 134572, 165076, 195580 |
| 5541 | ADMI2891 | 5541 | 36045 | 66549, 97053, 127557, 158061, 188565 | 12557 | AIJI0774 | 12557 | 43061 | 73565, 104069, 134573, 165077, 195581 |
| 5542 | ADMI2901 | 5542 | 36046 | 66550, 97054, 127558, 158062, 188566 | 12558 | AIJI0776 | 12558 | 43062 | 73566, 104070, 134574, 165078, 195582 |
| 5543 | ADMI2911 | 5543 | 36047 | 66551, 97055, 127559, 158063, 188567 | 12559 | AIJI0777 | 12559 | 43063 | 73567, 104071, 134575, 165079, 195583 |
| 5544 | ADMI2921 | 5544 | 36048 | 66552, 97056, 127560, 158064, 188568 | 12560 | AIJI0778 | 12560 | 43064 | 73568, 104072, 134576, 165080, 195584 |
| 5545 | ADMI2931 | 5545 | 36049 | 66553, 97057, 127561, 158065, 188569 | 12561 | AIJI0780 | 12561 | 43065 | 73569, 104073, 134577, 165081, 195585 |
| 5546 | ADMI2941 | 5546 | 36050 | 66554, 97058, 127562, 158066, 188570 | 12562 | AIJI0781 | 12562 | 43066 | 73570, 104074, 134578, 165082, 195586 |
| 5547 | ADMI2951 | 5547 | 36051 | 66555, 97059, 127563, 158067, 188571 | 12563 | AIJI0782 | 12563 | 43067 | 73571, 104075, 134579, 165083, 195587 |
| 5548 | ADMI2961 | 5548 | 36052 | 66556, 97060, 127564, 158068, 188572 | 12564 | AIJI0783 | 12564 | 43068 | 73572, 104076, 134580, 165084, 195588 |
| 5549 | ADMI2971 | 5549 | 36053 | 66557, 97061, 127565, 158069, 188573 | 12565 | AIJI0784 | 12565 | 43069 | 73573, 104077, 134581, 165085, 195589 |
| 5550 | ADMI2981 | 5550 | 36054 | 66558, 97062, 127566, 158070, 188574 | 12566 | AIJI0785 | 12566 | 43070 | 73574, 104078, 134582, 165086, 195590 |
| 5551 | ADMI2991 | 5551 | 36055 | 66559, 97063, 127567, 158071, 188575 | 12567 | AIJI0786 | 12567 | 43071 | 73575, 104079, 134583, 165087, 195591 |
| 5552 | ADMI3001 | 5552 | 36056 | 66560, 97064, 127568, 158072, 188576 | 12568 | AIJI0787 | 12568 | 43072 | 73576, 104080, 134584, 165088, 195592 |
| 5553 | ADMI3011 | 5553 | 36057 | 66561, 97065, 127569, 158073, 188577 | 12569 | AIJI0788 | 12569 | 43073 | 73577, 104081, 134585, 165089, 195593 |
| 5554 | ADMI3021 | 5554 | 36058 | 66562, 97066, 127570, 158074, 188578 | 12570 | AIJI0789 | 12570 | 43074 | 73578, 104082, 134586, 165090, 195594 |
| 5555 | ADMI3031 | 5555 | 36059 | 66563, 97067, 127571, 158075, 188579 | 12571 | AIJI0790 | 12571 | 43075 | 73579, 104083, 134587, 165091, 195595 |

FIG. 1 continued

| | | | | | | | | | |
|---|---|---|---|---|---|---|---|---|---|
| 5556 | ADMI3041 | 5556 | 36060 | 66564, 97068, 127572, 158076, 188580 | 12572 | AIJ10791 | 12572 | 43076 | 73580, 104084, 134588, 165092, 195596 |
| 5557 | ADMI3051 | 5557 | 36061 | 66565, 97069, 127573, 158077, 188581 | 12573 | AIJ10792 | 12573 | 43077 | 73581, 104085, 134589, 165093, 195597 |
| 5558 | ADMI3061 | 5558 | 36062 | 66566, 97070, 127574, 158078, 188582 | 12574 | AIJ29347 | 12574 | 43078 | 73582, 104086, 134590, 165094, 195598 |
| 5559 | ADMI3071 | 5559 | 36063 | 66567, 97071, 127575, 158079, 188583 | 12575 | AIJ29349 | 12575 | 43079 | 73583, 104087, 134591, 165095, 195599 |
| 5560 | ADMI3081 | 5560 | 36064 | 66568, 97072, 127576, 158080, 188584 | 12576 | AIJ29351 | 12576 | 43080 | 73584, 104088, 134592, 165096, 195600 |
| 5561 | ADMI3091 | 5561 | 36065 | 66569, 97073, 127577, 158081, 188585 | 12577 | AIJ29353 | 12577 | 43081 | 73585, 104089, 134593, 165097, 195601 |
| 5562 | ADMI3101 | 5562 | 36066 | 66570, 97074, 127578, 158082, 188586 | 12578 | AIJ29355 | 12578 | 43082 | 73586, 104090, 134594, 165098, 195602 |
| 5563 | ADMI3111 | 5563 | 36067 | 66571, 97075, 127579, 158083, 188587 | 12579 | AIJ29357 | 12579 | 43083 | 73587, 104091, 134595, 165099, 195603 |
| 5564 | ADMI3121 | 5564 | 36068 | 66572, 97076, 127580, 158084, 188588 | 12580 | AIJ29359 | 12580 | 43084 | 73588, 104092, 134596, 165100, 195604 |
| 5565 | ADMI3131 | 5565 | 36069 | 66573, 97077, 127581, 158085, 188589 | 12581 | AIJ29361 | 12581 | 43085 | 73589, 104093, 134597, 165101, 195605 |
| 5566 | ADMI3141 | 5566 | 36070 | 66574, 97078, 127582, 158086, 188590 | 12582 | AIL93623 | 12582 | 43086 | 73590, 104094, 134598, 165102, 195606 |
| 5567 | ADMI3151 | 5567 | 36071 | 66575, 97079, 127583, 158087, 188591 | 12583 | AIL93634 | 12583 | 43087 | 73591, 104095, 134599, 165103, 195607 |
| 5568 | ADMI3161 | 5568 | 36072 | 66576, 97080, 127584, 158088, 188592 | 12584 | AIL93645 | 12584 | 43088 | 73592, 104096, 134600, 165104, 195608 |
| 5569 | ADMI3171 | 5569 | 36073 | 66577, 97081, 127585, 158089, 188593 | 12585 | AIL93657 | 12585 | 43089 | 73593, 104097, 134601, 165105, 195609 |
| 5570 | ADMI3181 | 5570 | 36074 | 66578, 97082, 127586, 158090, 188594 | 12586 | AIL93669 | 12586 | 43090 | 73594, 104098, 134602, 165106, 195610 |
| 5571 | ADMI3191 | 5571 | 36075 | 66579, 97083, 127587, 158091, 188595 | 12587 | AIL93681 | 12587 | 43091 | 73595, 104099, 134603, 165107, 195611 |
| 5572 | ADMI3211 | 5572 | 36076 | 66580, 97084, 127588, 158092, 188596 | 12588 | AIL93692 | 12588 | 43092 | 73596, 104100, 134604, 165108, 195612 |
| 5573 | ADMI3221 | 5573 | 36077 | 66581, 97085, 127589, 158093, 188597 | 12589 | AIL93716 | 12589 | 43093 | 73597, 104101, 134605, 165109, 195613 |

FIG. 1 continued

| | | | | | | | | | |
|---|---|---|---|---|---|---|---|---|---|
| 5574 | ADMI3231 | 5574 | 36078 | 66582, 97086, 127590, 158094, 188598 | 12590 | AIL93728 | 12590 | 43094 | 73598, 104102, 134606, 165110, 195614 |
| 5575 | ADMI3241 | 5575 | 36079 | 66583, 97087, 127591, 158095, 188599 | 12591 | AIL93740 | 12591 | 43095 | 73599, 104103, 134607, 165111, 195615 |
| 5576 | ADMI3251 | 5576 | 36080 | 66584, 97088, 127592, 158096, 188600 | 12592 | AIL93752 | 12592 | 43096 | 73600, 104104, 134608, 165112, 195616 |
| 5577 | ADMI3261 | 5577 | 36081 | 66585, 97089, 127593, 158097, 188601 | 12593 | AIL93764 | 12593 | 43097 | 73601, 104105, 134609, 165113, 195617 |
| 5578 | ADMI3271 | 5578 | 36082 | 66586, 97090, 127594, 158098, 188602 | 12594 | AIL93776 | 12594 | 43098 | 73602, 104106, 134610, 165114, 195618 |
| 5579 | ADMI3281 | 5579 | 36083 | 66587, 97091, 127595, 158099, 188603 | 12595 | AIL93788 | 12595 | 43099 | 73603, 104107, 134611, 165115, 195619 |
| 5580 | ADMI3291 | 5580 | 36084 | 66588, 97092, 127596, 158100, 188604 | 12596 | AIL93812 | 12596 | 43100 | 73604, 104108, 134612, 165116, 195620 |
| 5581 | ADMI3301 | 5581 | 36085 | 66589, 97093, 127597, 158101, 188605 | 12597 | AIL93824 | 12597 | 43101 | 73605, 104109, 134613, 165117, 195621 |
| 5582 | ADMI3311 | 5582 | 36086 | 66590, 97094, 127598, 158102, 188606 | 12598 | AIL93836 | 12598 | 43102 | 73606, 104110, 134614, 165118, 195622 |
| 5583 | ADMI3321 | 5583 | 36087 | 66591, 97095, 127599, 158103, 188607 | 12599 | AIL93847 | 12599 | 43103 | 73607, 104111, 134615, 165119, 195623 |
| 5584 | ADMI3331 | 5584 | 36088 | 66592, 97096, 127600, 158104, 188608 | 12600 | AIL93858 | 12600 | 43104 | 73608, 104112, 134616, 165120, 195624 |
| 5585 | ADMI3341 | 5585 | 36089 | 66593, 97097, 127601, 158105, 188609 | 12601 | AIL93870 | 12601 | 43105 | 73609, 104113, 134617, 165121, 195625 |
| 5586 | ADMI3351 | 5586 | 36090 | 66594, 97098, 127602, 158106, 188610 | 12602 | AIL93882 | 12602 | 43106 | 73610, 104114, 134618, 165122, 195626 |
| 5587 | ADMI3442 | 5587 | 36091 | 66595, 97099, 127603, 158107, 188611 | 12603 | AIL93894 | 12603 | 43107 | 73611, 104115, 134619, 165123, 195627 |
| 5588 | ADMI3443 | 5588 | 36092 | 66596, 97100, 127604, 158108, 188612 | 12604 | AIL93906 | 12604 | 43108 | 73612, 104116, 134620, 165124, 195628 |
| 5589 | ADMI3444 | 5589 | 36093 | 66597, 97101, 127605, 158109, 188613 | 12605 | AIL93917 | 12605 | 43109 | 73613, 104117, 134621, 165125, 195629 |
| 5590 | ADMI3445 | 5590 | 36094 | 66598, 97102, 127606, 158110, 188614 | 12606 | AIL93929 | 12606 | 43110 | 73614, 104118, 134622, 165126, 195630 |
| 5591 | ADMI3446 | 5591 | 36095 | 66599, 97103, 127607, 158111, 188615 | 12607 | AIL93940 | 12607 | 43111 | 73615, 104119, 134623, 165127, 195631 |

FIG. 1 continued

| | | | | | | | | | |
|---|---|---|---|---|---|---|---|---|---|
| 5592 | ADMI3447 | 5592 | 36096 | 66600, 97104, 127608, 158112, 188616 | 12608 | AIL93951 | 12608 | 43112 | 73616, 104120, 134624, 165128, 195632 |
| 5593 | ADMI3448 | 5593 | 36097 | 66601, 97105, 127609, 158113, 188617 | 12609 | AIL93963 | 12609 | 43113 | 73617, 104121, 134625, 165129, 195633 |
| 5594 | ADMI3449 | 5594 | 36098 | 66602, 97106, 127610, 158114, 188618 | 12610 | AIL93975 | 12610 | 43114 | 73618, 104122, 134626, 165130, 195634 |
| 5595 | ADMI3450 | 5595 | 36099 | 66603, 97107, 127611, 158115, 188619 | 12611 | AIL93987 | 12611 | 43115 | 73619, 104123, 134627, 165131, 195635 |
| 5596 | ADMI3451 | 5596 | 36100 | 66604, 97108, 127612, 158116, 188620 | 12612 | AIL93998 | 12612 | 43116 | 73620, 104124, 134628, 165132, 195636 |
| 5597 | ADMI3452 | 5597 | 36101 | 66605, 97109, 127613, 158117, 188621 | 12613 | AIL94010 | 12613 | 43117 | 73621, 104125, 134629, 165133, 195637 |
| 5598 | ADMI4467 | 5598 | 36102 | 66606, 97110, 127614, 158118, 188622 | 12614 | AIL94022 | 12614 | 43118 | 73622, 104126, 134630, 165134, 195638 |
| 5599 | ADMI4516 | 5599 | 36103 | 66607, 97111, 127615, 158119, 188623 | 12615 | AIL94046 | 12615 | 43119 | 73623, 104127, 134631, 165135, 195639 |
| 5600 | ADMI4525 | 5600 | 36104 | 66608, 97112, 127616, 158120, 188624 | 12616 | AIL94058 | 12616 | 43120 | 73624, 104128, 134632, 165136, 195640 |
| 5601 | ADMI4553 | 5601 | 36105 | 66609, 97113, 127617, 158121, 188625 | 12617 | AIL94069 | 12617 | 43121 | 73625, 104129, 134633, 165137, 195641 |
| 5602 | ADMI4562 | 5602 | 36106 | 66610, 97114, 127618, 158122, 188626 | 12618 | AIL94080 | 12618 | 43122 | 73626, 104130, 134634, 165138, 195642 |
| 5603 | ADMI4571 | 5603 | 36107 | 66611, 97115, 127619, 158123, 188627 | 12619 | AIL94235 | 12619 | 43123 | 73627, 104131, 134635, 165139, 195643 |
| 5604 | ADMI4580 | 5604 | 36108 | 66612, 97116, 127620, 158124, 188628 | 12620 | AIL94247 | 12620 | 43124 | 73628, 104132, 134636, 165140, 195644 |
| 5605 | ADMI4589 | 5605 | 36109 | 66613, 97117, 127621, 158125, 188629 | 12621 | AIL94258 | 12621 | 43125 | 73629, 104133, 134637, 165141, 195645 |
| 5606 | ADMI4599 | 5606 | 36110 | 66614, 97118, 127622, 158126, 188630 | 12622 | AIL94270 | 12622 | 43126 | 73630, 104134, 134638, 165142, 195646 |
| 5607 | ADMI4609 | 5607 | 36111 | 66615, 97119, 127623, 158127, 188631 | 12623 | AIL94282 | 12623 | 43127 | 73631, 104135, 134639, 165143, 195647 |
| 5608 | ADMI4618 | 5608 | 36112 | 66616, 97120, 127624, 158128, 188632 | 12624 | AIL94294 | 12624 | 43128 | 73632, 104136, 134640, 165144, 195648 |
| 5609 | ADMI4627 | 5609 | 36113 | 66617, 97121, 127625, 158129, 188633 | 12625 | AIL94306 | 12625 | 43129 | 73633, 104137, 134641, 165145, 195649 |

FIG. 1 continued

| | | | | | | | | | |
|---|---|---|---|---|---|---|---|---|---|
| 5610 | ADMI4655 | 5610 | 36114 | 66618, 97122, 127626, 158130, 188634 | 12626 | AIL94318 | 12626 | 43130 | 73634, 104138, 134642, 165146, 195650 |
| 5611 | ADMI4664 | 5611 | 36115 | 66619, 97123, 127627, 158131, 188635 | 12627 | AIL94330 | 12627 | 43131 | 73635, 104139, 134643, 165147, 195651 |
| 5612 | ADMI4673 | 5612 | 36116 | 66620, 97124, 127628, 158132, 188636 | 12628 | AIL94354 | 12628 | 43132 | 73636, 104140, 134644, 165148, 195652 |
| 5613 | ADMI4682 | 5613 | 36117 | 66621, 97125, 127629, 158133, 188637 | 12629 | AIL94365 | 12629 | 43133 | 73637, 104141, 134645, 165149, 195653 |
| 5614 | ADMI4691 | 5614 | 36118 | 66622, 97126, 127630, 158134, 188638 | 12630 | AIL94377 | 12630 | 43134 | 73638, 104142, 134646, 165150, 195654 |
| 5615 | ADMI4700 | 5615 | 36119 | 66623, 97127, 127631, 158135, 188639 | 12631 | AIL94389 | 12631 | 43135 | 73639, 104143, 134647, 165151, 195655 |
| 5616 | ADMI4709 | 5616 | 36120 | 66624, 97128, 127632, 158136, 188640 | 12632 | AIL94411 | 12632 | 43136 | 73640, 104144, 134648, 165152, 195656 |
| 5617 | ADMI4718 | 5617 | 36121 | 66625, 97129, 127633, 158137, 188641 | 12633 | AIL94423 | 12633 | 43137 | 73641, 104145, 134649, 165153, 195657 |
| 5618 | ADMI4728 | 5618 | 36122 | 66626, 97130, 127634, 158138, 188642 | 12634 | AIL94435 | 12634 | 43138 | 73642, 104146, 134650, 165154, 195658 |
| 5619 | ADMI4737 | 5619 | 36123 | 66627, 97131, 127635, 158139, 188643 | 12635 | AIL94446 | 12635 | 43139 | 73643, 104147, 134651, 165155, 195659 |
| 5620 | ADMI4746 | 5620 | 36124 | 66628, 97132, 127636, 158140, 188644 | 12636 | AIL94458 | 12636 | 43140 | 73644, 104148, 134652, 165156, 195660 |
| 5621 | ADMI4756 | 5621 | 36125 | 66629, 97133, 127637, 158141, 188645 | 12637 | AIL94470 | 12637 | 43141 | 73645, 104149, 134653, 165157, 195661 |
| 5622 | ADMI4765 | 5622 | 36126 | 66630, 97134, 127638, 158142, 188646 | 12638 | AIL94481 | 12638 | 43142 | 73646, 104150, 134654, 165158, 195662 |
| 5623 | ADMI4775 | 5623 | 36127 | 66631, 97135, 127639, 158143, 188647 | 12639 | AIL94493 | 12639 | 43143 | 73647, 104151, 134655, 165159, 195663 |
| 5624 | ADMI4802 | 5624 | 36128 | 66632, 97136, 127640, 158144, 188648 | 12640 | AIL94504 | 12640 | 43144 | 73648, 104152, 134656, 165160, 195664 |
| 5625 | ADMI4830 | 5625 | 36129 | 66633, 97137, 127641, 158145, 188649 | 12641 | AIL94515 | 12641 | 43145 | 73649, 104153, 134657, 165161, 195665 |
| 5626 | ADMI4848 | 5626 | 36130 | 66634, 97138, 127642, 158146, 188650 | 12642 | AIL94527 | 12642 | 43146 | 73650, 104154, 134658, 165162, 195666 |
| 5627 | ADMI4866 | 5627 | 36131 | 66635, 97139, 127643, 158147, 188651 | 12643 | AIL94539 | 12643 | 43147 | 73651, 104155, 134659, 165163, 195667 |

FIG. 1 continued

| | | | | | | | | | |
|---|---|---|---|---|---|---|---|---|---|
| 5628 | ADM14876 | 5628 | 36132 | 66636, 97140, 127644, 158148, 188652 | 12644 | AIL94550 | 12644 | 43148 | 73652, 104156, 134660, 165164, 195668 |
| 5629 | ADM14885 | 5629 | 36133 | 66637, 97141, 127645, 158149, 188653 | 12645 | AIL94561 | 12645 | 43149 | 73653, 104157, 134661, 165165, 195669 |
| 5630 | ADM14894 | 5630 | 36134 | 66638, 97142, 127646, 158150, 188654 | 12646 | AIL94573 | 12646 | 43150 | 73654, 104158, 134662, 165166, 195670 |
| 5631 | ADM14903 | 5631 | 36135 | 66639, 97143, 127647, 158151, 188655 | 12647 | AIL94584 | 12647 | 43151 | 73655, 104159, 134663, 165167, 195671 |
| 5632 | ADM14912 | 5632 | 36136 | 66640, 97144, 127648, 158152, 188656 | 12648 | AIL94595 | 12648 | 43152 | 73656, 104160, 134664, 165168, 195672 |
| 5633 | ADM14921 | 5633 | 36137 | 66641, 97145, 127649, 158153, 188657 | 12649 | AIL94606 | 12649 | 43153 | 73657, 104161, 134665, 165169, 195673 |
| 5634 | ADM14930 | 5634 | 36138 | 66642, 97146, 127650, 158154, 188658 | 12650 | AIL94618 | 12650 | 43154 | 73658, 104162, 134666, 165170, 195674 |
| 5635 | ADM14948 | 5635 | 36139 | 66643, 97147, 127651, 158155, 188659 | 12651 | AIL94629 | 12651 | 43155 | 73659, 104163, 134667, 165171, 195675 |
| 5636 | ADM14966 | 5636 | 36140 | 66644, 97148, 127652, 158156, 188660 | 12652 | AIL94640 | 12652 | 43156 | 73660, 104164, 134668, 165172, 195676 |
| 5637 | ADM14975 | 5637 | 36141 | 66645, 97149, 127653, 158157, 188661 | 12653 | AIL94652 | 12653 | 43157 | 73661, 104165, 134669, 165173, 195677 |
| 5638 | ADM14985 | 5638 | 36142 | 66646, 97150, 127654, 158158, 188662 | 12654 | AIL94663 | 12654 | 43158 | 73662, 104166, 134670, 165174, 195678 |
| 5639 | ADM23841 | 5639 | 36143 | 66647, 97151, 127655, 158159, 188663 | 12655 | AIL94674 | 12655 | 43159 | 73663, 104167, 134671, 165175, 195679 |
| 5640 | ADM23843 | 5640 | 36144 | 66648, 97152, 127656, 158160, 188664 | 12656 | AIL94697 | 12656 | 43160 | 73664, 104168, 134672, 165176, 195680 |
| 5641 | ADM23844 | 5641 | 36145 | 66649, 97153, 127657, 158161, 188665 | 12657 | AIL94709 | 12657 | 43161 | 73665, 104169, 134673, 165177, 195681 |
| 5642 | ADM23845 | 5642 | 36146 | 66650, 97154, 127658, 158162, 188666 | 12658 | AIL94720 | 12658 | 43162 | 73666, 104170, 134674, 165178, 195682 |
| 5643 | ADM23846 | 5643 | 36147 | 66651, 97155, 127659, 158163, 188667 | 12659 | AIL94731 | 12659 | 43163 | 73667, 104171, 134675, 165179, 195683 |
| 5644 | ADM23847 | 5644 | 36148 | 66652, 97156, 127660, 158164, 188668 | 12660 | AIL94743 | 12660 | 43164 | 73668, 104172, 134676, 165180, 195684 |
| 5645 | ADM23849 | 5645 | 36149 | 66653, 97157, 127661, 158165, 188669 | 12661 | AIL94754 | 12661 | 43165 | 73669, 104173, 134677, 165181, 195685 |

FIG. 1 continued

| | | | | | | | | | |
|---|---|---|---|---|---|---|---|---|---|
| 5646 | ADM23851 | 5646 | 36150 | 66654, 97158, 127662, 158166, 188670 | 12662 | AIL94765 | 12662 | 43166 | 73670, 104174, 134678, 165182, 195686 |
| 5647 | ADM23852 | 5647 | 36151 | 66655, 97159, 127663, 158167, 188671 | 12663 | AIL94777 | 12663 | 43167 | 73671, 104175, 134679, 165183, 195687 |
| 5648 | ADM23853 | 5648 | 36152 | 66656, 97160, 127664, 158168, 188672 | 12664 | AIL94789 | 12664 | 43168 | 73672, 104176, 134680, 165184, 195688 |
| 5649 | ADM23855 | 5649 | 36153 | 66657, 97161, 127665, 158169, 188673 | 12665 | AIL94800 | 12665 | 43169 | 73673, 104177, 134681, 165185, 195689 |
| 5650 | ADM23856 | 5650 | 36154 | 66658, 97162, 127666, 158170, 188674 | 12666 | AIL94811 | 12666 | 43170 | 73674, 104178, 134682, 165186, 195690 |
| 5651 | ADM25945 | 5651 | 36155 | 66659, 97163, 127667, 158171, 188675 | 12667 | AIL94823 | 12667 | 43171 | 73675, 104179, 134683, 165187, 195691 |
| 5652 | ADM25948 | 5652 | 36156 | 66660, 97164, 127668, 158172, 188676 | 12668 | AIL94835 | 12668 | 43172 | 73676, 104180, 134684, 165188, 195692 |
| 5653 | ADM26264 | 5653 | 36157 | 66661, 97165, 127669, 158173, 188677 | 12669 | AIL94847 | 12669 | 43173 | 73677, 104181, 134685, 165189, 195693 |
| 5654 | ADM26265 | 5654 | 36158 | 66662, 97166, 127670, 158174, 188678 | 12670 | AIL94859 | 12670 | 43174 | 73678, 104182, 134686, 165190, 195694 |
| 5655 | ADM26266 | 5655 | 36159 | 66663, 97167, 127671, 158175, 188679 | 12671 | AIL94871 | 12671 | 43175 | 73679, 104183, 134687, 165191, 195695 |
| 5656 | ADM26267 | 5656 | 36160 | 66664, 97168, 127672, 158176, 188680 | 12672 | AIL94883 | 12672 | 43176 | 73680, 104184, 134688, 165192, 195696 |
| 5657 | ADM26268 | 5657 | 36161 | 66665, 97169, 127673, 158177, 188681 | 12673 | AIL94894 | 12673 | 43177 | 73681, 104185, 134689, 165193, 195697 |
| 5658 | ADM26269 | 5658 | 36162 | 66666, 97170, 127674, 158178, 188682 | 12674 | AIL94906 | 12674 | 43178 | 73682, 104186, 134690, 165194, 195698 |
| 5659 | ADM26270 | 5659 | 36163 | 66667, 97171, 127675, 158179, 188683 | 12675 | AIL94918 | 12675 | 43179 | 73683, 104187, 134691, 165195, 195699 |
| 5660 | ADM26271 | 5660 | 36164 | 66668, 97172, 127676, 158180, 188684 | 12676 | AIL94930 | 12676 | 43180 | 73684, 104188, 134692, 165196, 195700 |
| 5661 | ADM26272 | 5661 | 36165 | 66669, 97173, 127677, 158181, 188685 | 12677 | AIL94942 | 12677 | 43181 | 73685, 104189, 134693, 165197, 195701 |
| 5662 | ADM26274 | 5662 | 36166 | 66670, 97174, 127678, 158182, 188686 | 12678 | AIL94954 | 12678 | 43182 | 73686, 104190, 134694, 165198, 195702 |
| 5663 | ADM26276 | 5663 | 36167 | 66671, 97175, 127679, 158183, 188687 | 12679 | AIL94965 | 12679 | 43183 | 73687, 104191, 134695, 165199, 195703 |

FIG. 1 continued

| | | | | | | | | | |
|---|---|---|---|---|---|---|---|---|---|
| 5664 | ADM26277 | 5664 | 36168 | 66672, 97176, 127680, 158184, 188688 | 12680 | AIM55837 | 12680 | 43184 | 73688, 104192, 134696, 165200, 195704 |
| 5665 | ADM26278 | 5665 | 36169 | 66673, 97177, 127681, 158185, 188689 | 12681 | AIM55848 | 12681 | 43185 | 73689, 104193, 134697, 165201, 195705 |
| 5666 | ADM26279 | 5666 | 36170 | 66674, 97178, 127682, 158186, 188690 | 12682 | AIM55859 | 12682 | 43186 | 73690, 104194, 134698, 165202, 195706 |
| 5667 | ADM26280 | 5667 | 36171 | 66675, 97179, 127683, 158187, 188691 | 12683 | AIM55870 | 12683 | 43187 | 73691, 104195, 134699, 165203, 195707 |
| 5668 | ADM26281 | 5668 | 36172 | 66676, 97180, 127684, 158188, 188692 | 12684 | AIM55881 | 12684 | 43188 | 73692, 104196, 134700, 165204, 195708 |
| 5669 | ADM26282 | 5669 | 36173 | 66677, 97181, 127685, 158189, 188693 | 12685 | AIM55893 | 12685 | 43189 | 73693, 104197, 134701, 165205, 195709 |
| 5670 | ADM26283 | 5670 | 36174 | 66678, 97182, 127686, 158190, 188694 | 12686 | AIM55904 | 12686 | 43190 | 73694, 104198, 134702, 165206, 195710 |
| 5671 | ADM26284 | 5671 | 36175 | 66679, 97183, 127687, 158191, 188695 | 12687 | AIM55915 | 12687 | 43191 | 73695, 104199, 134703, 165207, 195711 |
| 5672 | ADM26285 | 5672 | 36176 | 66680, 97184, 127688, 158192, 188696 | 12688 | AIM55926 | 12688 | 43192 | 73696, 104200, 134704, 165208, 195712 |
| 5673 | ADM26784 | 5673 | 36177 | 66681, 97185, 127689, 158193, 188697 | 12689 | AIM55937 | 12689 | 43193 | 73697, 104201, 134705, 165209, 195713 |
| 5674 | ADM26795 | 5674 | 36178 | 66682, 97186, 127690, 158194, 188698 | 12690 | AIM55948 | 12690 | 43194 | 73698, 104202, 134706, 165210, 195714 |
| 5675 | ADM26817 | 5675 | 36179 | 66683, 97187, 127691, 158195, 188699 | 12691 | AIM55962 | 12691 | 43195 | 73699, 104203, 134707, 165211, 195715 |
| 5676 | ADM31424 | 5676 | 36180 | 66684, 97188, 127692, 158196, 188700 | 12692 | AIM55984 | 12692 | 43196 | 73700, 104204, 134708, 165212, 195716 |
| 5677 | ADM31478 | 5677 | 36181 | 66685, 97189, 127693, 158197, 188701 | 12693 | AIM55995 | 12693 | 43197 | 73701, 104205, 134709, 165213, 195717 |
| 5678 | ADM31488 | 5678 | 36182 | 66686, 97190, 127694, 158198, 188702 | 12694 | AIM56017 | 12694 | 43198 | 73702, 104206, 134710, 165214, 195718 |
| 5679 | ADM31498 | 5679 | 36183 | 66687, 97191, 127695, 158199, 188703 | 12695 | AIM56028 | 12695 | 43199 | 73703, 104207, 134711, 165215, 195719 |
| 5680 | ADM31508 | 5680 | 36184 | 66688, 97192, 127696, 158200, 188704 | 12696 | AIM56039 | 12696 | 43200 | 73704, 104208, 134712, 165216, 195720 |
| 5681 | ADM31518 | 5681 | 36185 | 66689, 97193, 127697, 158201, 188705 | 12697 | AIM56050 | 12697 | 43201 | 73705, 104209, 134713, 165217, 195721 |

FIG. 1 continued

| | | | | | | | | | |
|---|---|---|---|---|---|---|---|---|---|
| 5682 | ADM31528 | 5682 | 36186 | 66690, 97194, 127698, 158202, 188706 | 12698 | AIM56061 | 12698 | 43202 | 73706, 104210, 134714, 165218, 195722 |
| 5683 | ADM31538 | 5683 | 36187 | 66691, 97195, 127699, 158203, 188707 | 12699 | AIM56072 | 12699 | 43203 | 73707, 104211, 134715, 165219, 195723 |
| 5684 | ADM31548 | 5684 | 36188 | 66692, 97196, 127700, 158204, 188708 | 12700 | AIM56083 | 12700 | 43204 | 73708, 104212, 134716, 165220, 195724 |
| 5685 | ADM31558 | 5685 | 36189 | 66693, 97197, 127701, 158205, 188709 | 12701 | AIM56105 | 12701 | 43205 | 73709, 104213, 134717, 165221, 195725 |
| 5686 | ADM31568 | 5686 | 36190 | 66694, 97198, 127702, 158206, 188710 | 12702 | AIM56116 | 12702 | 43206 | 73710, 104214, 134718, 165222, 195726 |
| 5687 | ADM31578 | 5687 | 36191 | 66695, 97199, 127703, 158207, 188711 | 12703 | AIM56127 | 12703 | 43207 | 73711, 104215, 134719, 165223, 195727 |
| 5688 | ADM31588 | 5688 | 36192 | 66696, 97200, 127704, 158208, 188712 | 12704 | AIM56138 | 12704 | 43208 | 73712, 104216, 134720, 165224, 195728 |
| 5689 | ADM31598 | 5689 | 36193 | 66697, 97201, 127705, 158209, 188713 | 12705 | AIM56149 | 12705 | 43209 | 73713, 104217, 134721, 165225, 195729 |
| 5690 | ADM31608 | 5690 | 36194 | 66698, 97202, 127706, 158210, 188714 | 12706 | AIM56160 | 12706 | 43210 | 73714, 104218, 134722, 165226, 195730 |
| 5691 | ADM31618 | 5691 | 36195 | 66699, 97203, 127707, 158211, 188715 | 12707 | AIM56171 | 12707 | 43211 | 73715, 104219, 134723, 165227, 195731 |
| 5692 | ADM31628 | 5692 | 36196 | 66700, 97204, 127708, 158212, 188716 | 12708 | AIM56182 | 12708 | 43212 | 73716, 104220, 134724, 165228, 195732 |
| 5693 | ADM31638 | 5693 | 36197 | 66701, 97205, 127709, 158213, 188717 | 12709 | AIM56193 | 12709 | 43213 | 73717, 104221, 134725, 165229, 195733 |
| 5694 | ADM31648 | 5694 | 36198 | 66702, 97206, 127710, 158214, 188718 | 12710 | AIM56204 | 12710 | 43214 | 73718, 104222, 134726, 165230, 195734 |
| 5695 | ADM31658 | 5695 | 36199 | 66703, 97207, 127711, 158215, 188719 | 12711 | AIM56215 | 12711 | 43215 | 73719, 104223, 134727, 165231, 195735 |
| 5696 | ADM31668 | 5696 | 36200 | 66704, 97208, 127712, 158216, 188720 | 12712 | AIM56226 | 12712 | 43216 | 73720, 104224, 134728, 165232, 195736 |
| 5697 | ADM31688 | 5697 | 36201 | 66705, 97209, 127713, 158217, 188721 | 12713 | AIM56237 | 12713 | 43217 | 73721, 104225, 134729, 165233, 195737 |
| 5698 | ADM31698 | 5698 | 36202 | 66706, 97210, 127714, 158218, 188722 | 12714 | AIM56259 | 12714 | 43218 | 73722, 104226, 134730, 165234, 195738 |
| 5699 | ADM31708 | 5699 | 36203 | 66707, 97211, 127715, 158219, 188723 | 12715 | AIM56270 | 12715 | 43219 | 73723, 104227, 134731, 165235, 195739 |

FIG. 1 continued

| | | | | | | | | | |
|---|---|---|---|---|---|---|---|---|---|
| 5700 | ADM31718 | 5700 | 36204 | 66708, 97212, 127716, 158220, 188724 | 12716 | AIM56281 | 12716 | 43220 | 73724, 104228, 134732, 165236, 195740 |
| 5701 | ADM31728 | 5701 | 36205 | 66709, 97213, 127717, 158221, 188725 | 12717 | AIM56292 | 12717 | 43221 | 73725, 104229, 134733, 165237, 195741 |
| 5702 | ADM31738 | 5702 | 36206 | 66710, 97214, 127718, 158222, 188726 | 12718 | AIM56303 | 12718 | 43222 | 73726, 104230, 134734, 165238, 195742 |
| 5703 | ADM31748 | 5703 | 36207 | 66711, 97215, 127719, 158223, 188727 | 12719 | AIM56314 | 12719 | 43223 | 73727, 104231, 134735, 165239, 195743 |
| 5704 | ADM31758 | 5704 | 36208 | 66712, 97216, 127720, 158224, 188728 | 12720 | AIM56325 | 12720 | 43224 | 73728, 104232, 134736, 165240, 195744 |
| 5705 | ADM31768 | 5705 | 36209 | 66713, 97217, 127721, 158225, 188729 | 12721 | AIM56336 | 12721 | 43225 | 73729, 104233, 134737, 165241, 195745 |
| 5706 | ADM31778 | 5706 | 36210 | 66714, 97218, 127722, 158226, 188730 | 12722 | AIM56347 | 12722 | 43226 | 73730, 104234, 134738, 165242, 195746 |
| 5707 | ADM31798 | 5707 | 36211 | 66715, 97219, 127723, 158227, 188731 | 12723 | AIM56358 | 12723 | 43227 | 73731, 104235, 134739, 165243, 195747 |
| 5708 | ADM31808 | 5708 | 36212 | 66716, 97220, 127724, 158228, 188732 | 12724 | AIM56369 | 12724 | 43228 | 73732, 104236, 134740, 165244, 195748 |
| 5709 | ADM31818 | 5709 | 36213 | 66717, 97221, 127725, 158229, 188733 | 12725 | AIM56380 | 12725 | 43229 | 73733, 104237, 134741, 165245, 195749 |
| 5710 | ADM31828 | 5710 | 36214 | 66718, 97222, 127726, 158230, 188734 | 12726 | AIM56391 | 12726 | 43230 | 73734, 104238, 134742, 165246, 195750 |
| 5711 | ADM31838 | 5711 | 36215 | 66719, 97223, 127727, 158231, 188735 | 12727 | AIM56402 | 12727 | 43231 | 73735, 104239, 134743, 165247, 195751 |
| 5712 | ADM31848 | 5712 | 36216 | 66720, 97224, 127728, 158232, 188736 | 12728 | AIM56413 | 12728 | 43232 | 73736, 104240, 134744, 165248, 195752 |
| 5713 | ADM31858 | 5713 | 36217 | 66721, 97225, 127729, 158233, 188737 | 12729 | AIM56425 | 12729 | 43233 | 73737, 104241, 134745, 165249, 195753 |
| 5714 | ADM31868 | 5714 | 36218 | 66722, 97226, 127730, 158234, 188738 | 12730 | AIM56436 | 12730 | 43234 | 73738, 104242, 134746, 165250, 195754 |
| 5715 | ADM31878 | 5715 | 36219 | 66723, 97227, 127731, 158235, 188739 | 12731 | AIM56447 | 12731 | 43235 | 73739, 104243, 134747, 165251, 195755 |
| 5716 | ADM31888 | 5716 | 36220 | 66724, 97228, 127732, 158236, 188740 | 12732 | AIM56469 | 12732 | 43236 | 73740, 104244, 134748, 165252, 195756 |
| 5717 | ADM31898 | 5717 | 36221 | 66725, 97229, 127733, 158237, 188741 | 12733 | AIM56480 | 12733 | 43237 | 73741, 104245, 134749, 165253, 195757 |

FIG. 1 continued

| | | | | | | | | | |
|---|---|---|---|---|---|---|---|---|---|
| 5718 | ADM31908 | 5718 | 36222 | 66726, 97230, 127734, 158238, 188742 | 12734 | AIM56491 | 12734 | 43238 | 73742, 104246, 134750, 165254, 195758 |
| 5719 | ADM31918 | 5719 | 36223 | 66727, 97231, 127735, 158239, 188743 | 12735 | AIM56502 | 12735 | 43239 | 73743, 104247, 134751, 165255, 195759 |
| 5720 | ADM31928 | 5720 | 36224 | 66728, 97232, 127736, 158240, 188744 | 12736 | AIM56513 | 12736 | 43240 | 73744, 104248, 134752, 165256, 195760 |
| 5721 | ADM31948 | 5721 | 36225 | 66729, 97233, 127737, 158241, 188745 | 12737 | AIM56524 | 12737 | 43241 | 73745, 104249, 134753, 165257, 195761 |
| 5722 | ADM31958 | 5722 | 36226 | 66730, 97234, 127738, 158242, 188746 | 12738 | AIM56535 | 12738 | 43242 | 73746, 104250, 134754, 165258, 195762 |
| 5723 | ADM31968 | 5723 | 36227 | 66731, 97235, 127739, 158243, 188747 | 12739 | AIM56546 | 12739 | 43243 | 73747, 104251, 134755, 165259, 195763 |
| 5724 | ADM31978 | 5724 | 36228 | 66732, 97236, 127740, 158244, 188748 | 12740 | AIM56557 | 12740 | 43244 | 73748, 104252, 134756, 165260, 195764 |
| 5725 | ADM31998 | 5725 | 36229 | 66733, 97237, 127741, 158245, 188749 | 12741 | AIM56568 | 12741 | 43245 | 73749, 104253, 134757, 165261, 195765 |
| 5726 | ADM32008 | 5726 | 36230 | 66734, 97238, 127742, 158246, 188750 | 12742 | AIM56579 | 12742 | 43246 | 73750, 104254, 134758, 165262, 195766 |
| 5727 | ADM32018 | 5727 | 36231 | 66735, 97239, 127743, 158247, 188751 | 12743 | AIM56590 | 12743 | 43247 | 73751, 104255, 134759, 165263, 195767 |
| 5728 | ADM32028 | 5728 | 36232 | 66736, 97240, 127744, 158248, 188752 | 12744 | AIM56601 | 12744 | 43248 | 73752, 104256, 134760, 165264, 195768 |
| 5729 | ADM32038 | 5729 | 36233 | 66737, 97241, 127745, 158249, 188753 | 12745 | AIM56612 | 12745 | 43249 | 73753, 104257, 134761, 165265, 195769 |
| 5730 | ADM32048 | 5730 | 36234 | 66738, 97242, 127746, 158250, 188754 | 12746 | AIM56623 | 12746 | 43250 | 73754, 104258, 134762, 165266, 195770 |
| 5731 | ADM32058 | 5731 | 36235 | 66739, 97243, 127747, 158251, 188755 | 12747 | AIM56634 | 12747 | 43251 | 73755, 104259, 134763, 165267, 195771 |
| 5732 | ADM32068 | 5732 | 36236 | 66740, 97244, 127748, 158252, 188756 | 12748 | AIM56645 | 12748 | 43252 | 73756, 104260, 134764, 165268, 195772 |
| 5733 | ADM32078 | 5733 | 36237 | 66741, 97245, 127749, 158253, 188757 | 12749 | AIM56656 | 12749 | 43253 | 73757, 104261, 134765, 165269, 195773 |
| 5734 | ADM32088 | 5734 | 36238 | 66742, 97246, 127750, 158254, 188758 | 12750 | AIM56667 | 12750 | 43254 | 73758, 104262, 134766, 165270, 195774 |
| 5735 | ADM32098 | 5735 | 36239 | 66743, 97247, 127751, 158255, 188759 | 12751 | AIM56678 | 12751 | 43255 | 73759, 104263, 134767, 165271, 195775 |

FIG. 1 continued

| | | | | | | | | | |
|---|---|---|---|---|---|---|---|---|---|
| 5736 | ADM32108 | 5736 | 36240 | 66744, 97248, 127752, 158256, 188760 | 12752 | AIM56689 | 12752 | 43256 | 73760, 104264, 134768, 165272, 195776 |
| 5737 | ADM32551 | 5737 | 36241 | 66745, 97249, 127753, 158257, 188761 | 12753 | AIM56700 | 12753 | 43257 | 73761, 104265, 134769, 165273, 195777 |
| 5738 | ADM32561 | 5738 | 36242 | 66746, 97250, 127754, 158258, 188762 | 12754 | AIM56711 | 12754 | 43258 | 73762, 104266, 134770, 165274, 195778 |
| 5739 | ADM32571 | 5739 | 36243 | 66747, 97251, 127755, 158259, 188763 | 12755 | AIM56722 | 12755 | 43259 | 73763, 104267, 134771, 165275, 195779 |
| 5740 | ADM32581 | 5740 | 36244 | 66748, 97252, 127756, 158260, 188764 | 12756 | AIM56733 | 12756 | 43260 | 73764, 104268, 134772, 165276, 195780 |
| 5741 | ADM32591 | 5741 | 36245 | 66749, 97253, 127757, 158261, 188765 | 12757 | AIM56744 | 12757 | 43261 | 73765, 104269, 134773, 165277, 195781 |
| 5742 | ADM32601 | 5742 | 36246 | 66750, 97254, 127758, 158262, 188766 | 12758 | AIM56755 | 12758 | 43262 | 73766, 104270, 134774, 165278, 195782 |
| 5743 | ADM32611 | 5743 | 36247 | 66751, 97255, 127759, 158263, 188767 | 12759 | AIM56766 | 12759 | 43263 | 73767, 104271, 134775, 165279, 195783 |
| 5744 | ADM32621 | 5744 | 36248 | 66752, 97256, 127760, 158264, 188768 | 12760 | AIM56777 | 12760 | 43264 | 73768, 104272, 134776, 165280, 195784 |
| 5745 | ADM32631 | 5745 | 36249 | 66753, 97257, 127761, 158265, 188769 | 12761 | AIM56788 | 12761 | 43265 | 73769, 104273, 134777, 165281, 195785 |
| 5746 | ADM32641 | 5746 | 36250 | 66754, 97258, 127762, 158266, 188770 | 12762 | AIM56799 | 12762 | 43266 | 73770, 104274, 134778, 165282, 195786 |
| 5747 | ADM32651 | 5747 | 36251 | 66755, 97259, 127763, 158267, 188771 | 12763 | AIM56810 | 12763 | 43267 | 73771, 104275, 134779, 165283, 195787 |
| 5748 | ADM32661 | 5748 | 36252 | 66756, 97260, 127764, 158268, 188772 | 12764 | AIM56821 | 12764 | 43268 | 73772, 104276, 134780, 165284, 195788 |
| 5749 | ADM32671 | 5749 | 36253 | 66757, 97261, 127765, 158269, 188773 | 12765 | AIN76383 | 12765 | 43269 | 73773, 104277, 134781, 165285, 195789 |
| 5750 | ADM32681 | 5750 | 36254 | 66758, 97262, 127766, 158270, 188774 | 12766 | AIP93103 | 12766 | 43270 | 73774, 104278, 134782, 165286, 195790 |
| 5751 | ADM32691 | 5751 | 36255 | 66759, 97263, 127767, 158271, 188775 | 12767 | AIP93115 | 12767 | 43271 | 73775, 104279, 134783, 165287, 195791 |
| 5752 | ADM32701 | 5752 | 36256 | 66760, 97264, 127768, 158272, 188776 | 12768 | AIR93971 | 12768 | 43272 | 73776, 104280, 134784, 165288, 195792 |
| 5753 | ADM32711 | 5753 | 36257 | 66761, 97265, 127769, 158273, 188777 | 12769 | AIR93982 | 12769 | 43273 | 73777, 104281, 134785, 165289, 195793 |

FIG. 1 continued

| | | | | | | | | | |
|---|---|---|---|---|---|---|---|---|---|
| 5754 | ADM32721 | 5754 | 36258 | 66762, 97266, 127770, 158274, 188778 | 12770 | AIR93993 | 12770 | 43274 | 73778, 104282, 134786, 165290, 195794 |
| 5755 | ADM32741 | 5755 | 36259 | 66763, 97267, 127771, 158275, 188779 | 12771 | AIR94000 | 12771 | 43275 | 73779, 104283, 134787, 165291, 195795 |
| 5756 | ADM32751 | 5756 | 36260 | 66764, 97268, 127772, 158276, 188780 | 12772 | AIR94116 | 12772 | 43276 | 73780, 104284, 134788, 165292, 195796 |
| 5757 | ADM32761 | 5757 | 36261 | 66765, 97269, 127773, 158277, 188781 | 12773 | AIT38333 | 12773 | 43277 | 73781, 104285, 134789, 165293, 195797 |
| 5758 | ADM32771 | 5758 | 36262 | 66766, 97270, 127774, 158278, 188782 | 12774 | AIT38344 | 12774 | 43278 | 73782, 104286, 134790, 165294, 195798 |
| 5759 | ADM32781 | 5759 | 36263 | 66767, 97271, 127775, 158279, 188783 | 12775 | AIT38360 | 12775 | 43279 | 73783, 104287, 134791, 165295, 195799 |
| 5760 | ADM32791 | 5760 | 36264 | 66768, 97272, 127776, 158280, 188784 | 12776 | AIT93147 | 12776 | 43280 | 73784, 104288, 134792, 165296, 195800 |
| 5761 | ADM32801 | 5761 | 36265 | 66769, 97273, 127777, 158281, 188785 | 12777 | AIU39700 | 12777 | 43281 | 73785, 104289, 134793, 165297, 195801 |
| 5762 | ADM32811 | 5762 | 36266 | 66770, 97274, 127778, 158282, 188786 | 12778 | AIU39702 | 12778 | 43282 | 73786, 104290, 134794, 165298, 195802 |
| 5763 | ADM32821 | 5763 | 36267 | 66771, 97275, 127779, 158283, 188787 | 12779 | AIU39704 | 12779 | 43283 | 73787, 104291, 134795, 165299, 195803 |
| 5764 | ADM32831 | 5764 | 36268 | 66772, 97276, 127780, 158284, 188788 | 12780 | AIU46609 | 12780 | 43284 | 73788, 104292, 134796, 165300, 195804 |
| 5765 | ADM32841 | 5765 | 36269 | 66773, 97277, 127781, 158285, 188789 | 12781 | AIU46714 | 12781 | 43285 | 73789, 104293, 134797, 165301, 195805 |
| 5766 | ADM32851 | 5766 | 36270 | 66774, 97278, 127782, 158286, 188790 | 12782 | AIV09219 | 12782 | 43286 | 73790, 104294, 134798, 165302, 195806 |
| 5767 | ADM32861 | 5767 | 36271 | 66775, 97279, 127783, 158287, 188791 | 12783 | AIW60689 | 12783 | 43287 | 73791, 104295, 134799, 165303, 195807 |
| 5768 | ADM32871 | 5768 | 36272 | 66776, 97280, 127784, 158288, 188792 | 12784 | AIW60690 | 12784 | 43288 | 73792, 104296, 134800, 165304, 195808 |
| 5769 | ADM32881 | 5769 | 36273 | 66777, 97281, 127785, 158289, 188793 | 12785 | AIW60691 | 12785 | 43289 | 73793, 104297, 134801, 165305, 195809 |
| 5770 | ADM32929 | 5770 | 36274 | 66778, 97282, 127786, 158290, 188794 | 12786 | AIW60692 | 12786 | 43290 | 73794, 104298, 134802, 165306, 195810 |
| 5771 | ADM32939 | 5771 | 36275 | 66779, 97283, 127787, 158291, 188795 | 12787 | AIW60693 | 12787 | 43291 | 73795, 104299, 134803, 165307, 195811 |

FIG. 1 continued

| | | | | | | | | | |
|---|---|---|---|---|---|---|---|---|---|
| 5772 | ADM32949 | 5772 | 36276 | 66780, 97284, 127788, 158292, 188796 | 12788 | AIW60694 | 12788 | 43292 | 73796, 104300, 134804, 165308, 195812 |
| 5773 | ADM32958 | 5773 | 36277 | 66781, 97285, 127789, 158293, 188797 | 12789 | AIW60695 | 12789 | 43293 | 73797, 104301, 134805, 165309, 195813 |
| 5774 | ADM32977 | 5774 | 36278 | 66782, 97286, 127790, 158294, 188798 | 12790 | AIW60696 | 12790 | 43294 | 73798, 104302, 134806, 165310, 195814 |
| 5775 | ADM32986 | 5775 | 36279 | 66783, 97287, 127791, 158295, 188799 | 12791 | AIW60697 | 12791 | 43295 | 73799, 104303, 134807, 165311, 195815 |
| 5776 | ADM32995 | 5776 | 36280 | 66784, 97288, 127792, 158296, 188800 | 12792 | AIW60698 | 12792 | 43296 | 73800, 104304, 134808, 165312, 195816 |
| 5777 | ADM33004 | 5777 | 36281 | 66785, 97289, 127793, 158297, 188801 | 12793 | AIW60699 | 12793 | 43297 | 73801, 104305, 134809, 165313, 195817 |
| 5778 | ADM33023 | 5778 | 36282 | 66786, 97290, 127794, 158298, 188802 | 12794 | AIW60700 | 12794 | 43298 | 73802, 104306, 134810, 165314, 195818 |
| 5779 | ADM33040 | 5779 | 36283 | 66787, 97291, 127795, 158299, 188803 | 12795 | AIW60701 | 12795 | 43299 | 73803, 104307, 134811, 165315, 195819 |
| 5780 | ADM33050 | 5780 | 36284 | 66788, 97292, 127796, 158300, 188804 | 12796 | AIW60702 | 12796 | 43300 | 73804, 104308, 134812, 165316, 195820 |
| 5781 | ADM33069 | 5781 | 36285 | 66789, 97293, 127797, 158301, 188805 | 12797 | AIZ07211 | 12797 | 43301 | 73805, 104309, 134813, 165317, 195821 |
| 5782 | ADM33079 | 5782 | 36286 | 66790, 97294, 127798, 158302, 188806 | 12798 | AIZ07212 | 12798 | 43302 | 73806, 104310, 134814, 165318, 195822 |
| 5783 | ADM33099 | 5783 | 36287 | 66791, 97295, 127799, 158303, 188807 | 12799 | AJD78175 | 12799 | 43303 | 73807, 104311, 134815, 165319, 195823 |
| 5784 | ADM33109 | 5784 | 36288 | 66792, 97296, 127800, 158304, 188808 | 12800 | AJD78187 | 12800 | 43304 | 73808, 104312, 134816, 165320, 195824 |
| 5785 | ADM33128 | 5785 | 36289 | 66793, 97297, 127801, 158305, 188809 | 12801 | AJD78199 | 12801 | 43305 | 73809, 104313, 134817, 165321, 195825 |
| 5786 | ADM33137 | 5786 | 36290 | 66794, 97298, 127802, 158306, 188810 | 12802 | AJD78211 | 12802 | 43306 | 73810, 104314, 134818, 165322, 195826 |
| 5787 | ADM33147 | 5787 | 36291 | 66795, 97299, 127803, 158307, 188811 | 12803 | AJI76401 | 12803 | 43307 | 73811, 104315, 134819, 165323, 195827 |
| 5788 | ADM33157 | 5788 | 36292 | 66796, 97300, 127804, 158308, 188812 | 12804 | AJI80137 | 12804 | 43308 | 73812, 104316, 134820, 165324, 195828 |
| 5789 | ADM33167 | 5789 | 36293 | 66797, 97301, 127805, 158309, 188813 | 12805 | AJI80149 | 12805 | 43309 | 73813, 104317, 134821, 165325, 195829 |

FIG. 1 continued

| | | | | | | | | | |
|---|---|---|---|---|---|---|---|---|---|
| 5790 | ADM33177 | 5790 | 36294 | 66798, 97302, 127806, 158310, 188814 | 12806 | AJI80161 | 12806 | 43310 | 73814, 104318, 134822, 165326, 195830 |
| 5791 | ADM33186 | 5791 | 36295 | 66799, 97303, 127807, 158311, 188815 | 12807 | AJI80172 | 12807 | 43311 | 73815, 104319, 134823, 165327, 195831 |
| 5792 | ADM33195 | 5792 | 36296 | 66800, 97304, 127808, 158312, 188816 | 12808 | AJI80196 | 12808 | 43312 | 73816, 104320, 134824, 165328, 195832 |
| 5793 | ADM33204 | 5793 | 36297 | 66801, 97305, 127809, 158313, 188817 | 12809 | AJI80208 | 12809 | 43313 | 73817, 104321, 134825, 165329, 195833 |
| 5794 | ADM33222 | 5794 | 36298 | 66802, 97306, 127810, 158314, 188818 | 12810 | AJI80220 | 12810 | 43314 | 73818, 104322, 134826, 165330, 195834 |
| 5795 | ADM33232 | 5795 | 36299 | 66803, 97307, 127811, 158315, 188819 | 12811 | AJI80232 | 12811 | 43315 | 73819, 104323, 134827, 165331, 195835 |
| 5796 | ADM33241 | 5796 | 36300 | 66804, 97308, 127812, 158316, 188820 | 12812 | AJI80244 | 12812 | 43316 | 73820, 104324, 134828, 165332, 195836 |
| 5797 | ADM33251 | 5797 | 36301 | 66805, 97309, 127813, 158317, 188821 | 12813 | AJI80256 | 12813 | 43317 | 73821, 104325, 134829, 165333, 195837 |
| 5798 | ADM33260 | 5798 | 36302 | 66806, 97310, 127814, 158318, 188822 | 12814 | AJI80268 | 12814 | 43318 | 73822, 104326, 134830, 165334, 195838 |
| 5799 | ADM33280 | 5799 | 36303 | 66807, 97311, 127815, 158319, 188823 | 12815 | AJI80280 | 12815 | 43319 | 73823, 104327, 134831, 165335, 195839 |
| 5800 | ADM33290 | 5800 | 36304 | 66808, 97312, 127816, 158320, 188824 | 12816 | AJI80292 | 12816 | 43320 | 73824, 104328, 134832, 165336, 195840 |
| 5801 | ADM33300 | 5801 | 36305 | 66809, 97313, 127817, 158321, 188825 | 12817 | AJI80303 | 12817 | 43321 | 73825, 104329, 134833, 165337, 195841 |
| 5802 | ADM33310 | 5802 | 36306 | 66810, 97314, 127818, 158322, 188826 | 12818 | AJI80315 | 12818 | 43322 | 73826, 104330, 134834, 165338, 195842 |
| 5803 | ADM33320 | 5803 | 36307 | 66811, 97315, 127819, 158323, 188827 | 12819 | AJI80326 | 12819 | 43323 | 73827, 104331, 134835, 165339, 195843 |
| 5804 | ADM33340 | 5804 | 36308 | 66812, 97316, 127820, 158324, 188828 | 12820 | AJI80337 | 12820 | 43324 | 73828, 104332, 134836, 165340, 195844 |
| 5805 | ADM33355 | 5805 | 36309 | 66813, 97317, 127821, 158325, 188829 | 12821 | AJI80348 | 12821 | 43325 | 73829, 104333, 134837, 165341, 195845 |
| 5806 | ADM33365 | 5806 | 36310 | 66814, 97318, 127822, 158326, 188830 | 12822 | AJI80360 | 12822 | 43326 | 73830, 104334, 134838, 165342, 195846 |
| 5807 | ADM33375 | 5807 | 36311 | 66815, 97319, 127823, 158327, 188831 | 12823 | AJI80372 | 12823 | 43327 | 73831, 104335, 134839, 165343, 195847 |

FIG. 1 continued

| | | | | | | | | | |
|---|---|---|---|---|---|---|---|---|---|
| 5808 | ADM33385 | 5808 | 36312 | 66816, 97320, 127824, 158328, 188832 | 12824 | AJI80384 | 12824 | 43328 | 73832, 104336, 134840, 165344, 195848 |
| 5809 | ADM33395 | 5809 | 36313 | 66817, 97321, 127825, 158329, 188833 | 12825 | AJI80395 | 12825 | 43329 | 73833, 104337, 134841, 165345, 195849 |
| 5810 | ADM33405 | 5810 | 36314 | 66818, 97322, 127826, 158330, 188834 | 12826 | AJI80406 | 12826 | 43330 | 73834, 104338, 134842, 165346, 195850 |
| 5811 | ADM33415 | 5811 | 36315 | 66819, 97323, 127827, 158331, 188835 | 12827 | AJI80417 | 12827 | 43331 | 73835, 104339, 134843, 165347, 195851 |
| 5812 | ADM33425 | 5812 | 36316 | 66820, 97324, 127828, 158332, 188836 | 12828 | AJI80428 | 12828 | 43332 | 73836, 104340, 134844, 165348, 195852 |
| 5813 | ADM34007 | 5813 | 36317 | 66821, 97325, 127829, 158333, 188837 | 12829 | AJI80439 | 12829 | 43333 | 73837, 104341, 134845, 165349, 195853 |
| 5814 | ADM52443 | 5814 | 36318 | 66822, 97326, 127830, 158334, 188838 | 12830 | AJI80462 | 12830 | 43334 | 73838, 104342, 134846, 165350, 195854 |
| 5815 | ADM52453 | 5815 | 36319 | 66823, 97327, 127831, 158335, 188839 | 12831 | AJI80474 | 12831 | 43335 | 73839, 104343, 134847, 165351, 195855 |
| 5816 | ADM52473 | 5816 | 36320 | 66824, 97328, 127832, 158336, 188840 | 12832 | AJI80485 | 12832 | 43336 | 73840, 104344, 134848, 165352, 195856 |
| 5817 | ADM52483 | 5817 | 36321 | 66825, 97329, 127833, 158337, 188841 | 12833 | AJI80496 | 12833 | 43337 | 73841, 104345, 134849, 165353, 195857 |
| 5818 | ADM52493 | 5818 | 36322 | 66826, 97330, 127834, 158338, 188842 | 12834 | AJI80507 | 12834 | 43338 | 73842, 104346, 134850, 165354, 195858 |
| 5819 | ADM52513 | 5819 | 36323 | 66827, 97331, 127835, 158339, 188843 | 12835 | AJI80518 | 12835 | 43339 | 73843, 104347, 134851, 165355, 195859 |
| 5820 | ADM52524 | 5820 | 36324 | 66828, 97332, 127836, 158340, 188844 | 12836 | AJJ98765 | 12836 | 43340 | 73844, 104348, 134852, 165356, 195860 |
| 5821 | ADM52534 | 5821 | 36325 | 66829, 97333, 127837, 158341, 188845 | 12837 | AJJ98777 | 12837 | 43341 | 73845, 104349, 134853, 165357, 195861 |
| 5822 | ADM52554 | 5822 | 36326 | 66830, 97334, 127838, 158342, 188846 | 12838 | AJJ98789 | 12838 | 43342 | 73846, 104350, 134854, 165358, 195862 |
| 5823 | ADM52564 | 5823 | 36327 | 66831, 97335, 127839, 158343, 188847 | 12839 | AJJ98801 | 12839 | 43343 | 73847, 104351, 134855, 165359, 195863 |
| 5824 | ADM52574 | 5824 | 36328 | 66832, 97336, 127840, 158344, 188848 | 12840 | AJJ98813 | 12840 | 43344 | 73848, 104352, 134856, 165360, 195864 |
| 5825 | ADM52584 | 5825 | 36329 | 66833, 97337, 127841, 158345, 188849 | 12841 | AJJ98825 | 12841 | 43345 | 73849, 104353, 134857, 165361, 195865 |

FIG. 1 continued

| | | | | | | | | | |
|---|---|---|---|---|---|---|---|---|---|
| 5826 | ADM52594 | 5826 | 36330 | 66834, 97338, 127842, 158346, 188850 | 12842 | AJJ98837 | 12842 | 43346 | 73850, 104354, 134858, 165362, 195866 |
| 5827 | ADM52604 | 5827 | 36331 | 66835, 97339, 127843, 158347, 188851 | 12843 | AJJ98849 | 12843 | 43347 | 73851, 104355, 134859, 165363, 195867 |
| 5828 | ADM52614 | 5828 | 36332 | 66836, 97340, 127844, 158348, 188852 | 12844 | AJJ98861 | 12844 | 43348 | 73852, 104356, 134860, 165364, 195868 |
| 5829 | ADM52624 | 5829 | 36333 | 66837, 97341, 127845, 158349, 188853 | 12845 | AJJ98873 | 12845 | 43349 | 73853, 104357, 134861, 165365, 195869 |
| 5830 | ADM52634 | 5830 | 36334 | 66838, 97342, 127846, 158350, 188854 | 12846 | AJJ98885 | 12846 | 43350 | 73854, 104358, 134862, 165366, 195870 |
| 5831 | ADM52644 | 5831 | 36335 | 66839, 97343, 127847, 158351, 188855 | 12847 | AJJ98897 | 12847 | 43351 | 73855, 104359, 134863, 165367, 195871 |
| 5832 | ADM52654 | 5832 | 36336 | 66840, 97344, 127848, 158352, 188856 | 12848 | AJJ98909 | 12848 | 43352 | 73856, 104360, 134864, 165368, 195872 |
| 5833 | ADM52664 | 5833 | 36337 | 66841, 97345, 127849, 158353, 188857 | 12849 | AJJ98921 | 12849 | 43353 | 73857, 104361, 134865, 165369, 195873 |
| 5834 | ADM52674 | 5834 | 36338 | 66842, 97346, 127850, 158354, 188858 | 12850 | AJJ98933 | 12850 | 43354 | 73858, 104362, 134866, 165370, 195874 |
| 5835 | ADM52684 | 5835 | 36339 | 66843, 97347, 127851, 158355, 188859 | 12851 | AJJ98945 | 12851 | 43355 | 73859, 104363, 134867, 165371, 195875 |
| 5836 | ADM52704 | 5836 | 36340 | 66844, 97348, 127852, 158356, 188860 | 12852 | AJJ98957 | 12852 | 43356 | 73860, 104364, 134868, 165372, 195876 |
| 5837 | ADM52714 | 5837 | 36341 | 66845, 97349, 127853, 158357, 188861 | 12853 | AJJ98969 | 12853 | 43357 | 73861, 104365, 134869, 165373, 195877 |
| 5838 | ADM86399 | 5838 | 36342 | 66846, 97350, 127854, 158358, 188862 | 12854 | AJJ98981 | 12854 | 43358 | 73862, 104366, 134870, 165374, 195878 |
| 5839 | ADM86409 | 5839 | 36343 | 66847, 97351, 127855, 158359, 188863 | 12855 | AJJ98993 | 12855 | 43359 | 73863, 104367, 134871, 165375, 195879 |
| 5840 | ADM86419 | 5840 | 36344 | 66848, 97352, 127856, 158360, 188864 | 12856 | AJJ99005 | 12856 | 43360 | 73864, 104368, 134872, 165376, 195880 |
| 5841 | ADM86440 | 5841 | 36345 | 66849, 97353, 127857, 158361, 188865 | 12857 | AJJ99017 | 12857 | 43361 | 73865, 104369, 134873, 165377, 195881 |
| 5842 | ADM86450 | 5842 | 36346 | 66850, 97354, 127858, 158362, 188866 | 12858 | AJJ99029 | 12858 | 43362 | 73866, 104370, 134874, 165378, 195882 |
| 5843 | ADM95450 | 5843 | 36347 | 66851, 97355, 127859, 158363, 188867 | 12859 | AJJ99041 | 12859 | 43363 | 73867, 104371, 134875, 165379, 195883 |

FIG. 1 continued

| | | | | | | | | | |
|---|---|---|---|---|---|---|---|---|---|
| 5844 | ADM95745 | 5844 | 36348 | 66852, 97356, 127860, 158364, 188868 | 12860 | AJJ99053 | 12860 | 43364 | 73868, 104372, 134876, 165380, 195884 |
| 5845 | ADM95746 | 5845 | 36349 | 66853, 97357, 127861, 158365, 188869 | 12861 | AJJ99065 | 12861 | 43365 | 73869, 104373, 134877, 165381, 195885 |
| 5846 | ADM95747 | 5846 | 36350 | 66854, 97358, 127862, 158366, 188870 | 12862 | AJJ99089 | 12862 | 43366 | 73870, 104374, 134878, 165382, 195886 |
| 5847 | ADM95749 | 5847 | 36351 | 66855, 97359, 127863, 158367, 188871 | 12863 | AJJ99101 | 12863 | 43367 | 73871, 104375, 134879, 165383, 195887 |
| 5848 | ADM95750 | 5848 | 36352 | 66856, 97360, 127864, 158368, 188872 | 12864 | AJJ99113 | 12864 | 43368 | 73872, 104376, 134880, 165384, 195888 |
| 5849 | ADM95751 | 5849 | 36353 | 66857, 97361, 127865, 158369, 188873 | 12865 | AJJ99125 | 12865 | 43369 | 73873, 104377, 134881, 165385, 195889 |
| 5850 | ADM95752 | 5850 | 36354 | 66858, 97362, 127866, 158370, 188874 | 12866 | AJJ99137 | 12866 | 43370 | 73874, 104378, 134882, 165386, 195890 |
| 5851 | ADM95753 | 5851 | 36355 | 66859, 97363, 127867, 158371, 188875 | 12867 | AJJ99149 | 12867 | 43371 | 73875, 104379, 134883, 165387, 195891 |
| 5852 | ADM95754 | 5852 | 36356 | 66860, 97364, 127868, 158372, 188876 | 12868 | AJJ99161 | 12868 | 43372 | 73876, 104380, 134884, 165388, 195892 |
| 5853 | ADM95755 | 5853 | 36357 | 66861, 97365, 127869, 158373, 188877 | 12869 | AJJ99173 | 12869 | 43373 | 73877, 104381, 134885, 165389, 195893 |
| 5854 | ADM95757 | 5854 | 36358 | 66862, 97366, 127870, 158374, 188878 | 12870 | AJJ99185 | 12870 | 43374 | 73878, 104382, 134886, 165390, 195894 |
| 5855 | ADM95758 | 5855 | 36359 | 66863, 97367, 127871, 158375, 188879 | 12871 | AJJ99197 | 12871 | 43375 | 73879, 104383, 134887, 165391, 195895 |
| 5856 | ADM95759 | 5856 | 36360 | 66864, 97368, 127872, 158376, 188880 | 12872 | AJJ99209 | 12872 | 43376 | 73880, 104384, 134888, 165392, 195896 |
| 5857 | ADM95760 | 5857 | 36361 | 66865, 97369, 127873, 158377, 188881 | 12873 | AJJ99221 | 12873 | 43377 | 73881, 104385, 134889, 165393, 195897 |
| 5858 | ADM95761 | 5858 | 36362 | 66866, 97370, 127874, 158378, 188882 | 12874 | AJJ99233 | 12874 | 43378 | 73882, 104386, 134890, 165394, 195898 |
| 5859 | ADM95763 | 5859 | 36363 | 66867, 97371, 127875, 158379, 188883 | 12875 | AJJ99244 | 12875 | 43379 | 73883, 104387, 134891, 165395, 195899 |
| 5860 | ADM95764 | 5860 | 36364 | 66868, 97372, 127876, 158380, 188884 | 12876 | AJJ99255 | 12876 | 43380 | 73884, 104388, 134892, 165396, 195900 |
| 5861 | ADM95765 | 5861 | 36365 | 66869, 97373, 127877, 158381, 188885 | 12877 | AJJ99267 | 12877 | 43381 | 73885, 104389, 134893, 165397, 195901 |

FIG. 1 continued

| | | | | | | | | | |
|---|---|---|---|---|---|---|---|---|---|
| 5862 | ADM95767 | 5862 | 36366 | 66870, 97374, 127878, 158382, 188886 | 12878 | AJJ99278 | 12878 | 43382 | 73886, 104390, 134894, 165398, 195902 |
| 5863 | ADM95768 | 5863 | 36367 | 66871, 97375, 127879, 158383, 188887 | 12879 | AJJ99289 | 12879 | 43383 | 73887, 104391, 134895, 165399, 195903 |
| 5864 | ADM95769 | 5864 | 36368 | 66872, 97376, 127880, 158384, 188888 | 12880 | AJJ99301 | 12880 | 43384 | 73888, 104392, 134896, 165400, 195904 |
| 5865 | ADM95771 | 5865 | 36369 | 66873, 97377, 127881, 158385, 188889 | 12881 | AJJ99324 | 12881 | 43385 | 73889, 104393, 134897, 165401, 195905 |
| 5866 | ADM95772 | 5866 | 36370 | 66874, 97378, 127882, 158386, 188890 | 12882 | AJJ99335 | 12882 | 43386 | 73890, 104394, 134898, 165402, 195906 |
| 5867 | ADM95774 | 5867 | 36371 | 66875, 97379, 127883, 158387, 188891 | 12883 | AJJ99357 | 12883 | 43387 | 73891, 104395, 134899, 165403, 195907 |
| 5868 | ADM95775 | 5868 | 36372 | 66876, 97380, 127884, 158388, 188892 | 12884 | AJJ99368 | 12884 | 43388 | 73892, 104396, 134900, 165404, 195908 |
| 5869 | ADM95776 | 5869 | 36373 | 66877, 97381, 127885, 158389, 188893 | 12885 | AJJ99379 | 12885 | 43389 | 73893, 104397, 134901, 165405, 195909 |
| 5870 | ADM95778 | 5870 | 36374 | 66878, 97382, 127886, 158390, 188894 | 12886 | AJJ99390 | 12886 | 43390 | 73894, 104398, 134902, 165406, 195910 |
| 5871 | ADM95779 | 5871 | 36375 | 66879, 97383, 127887, 158391, 188895 | 12887 | AJJ99401 | 12887 | 43391 | 73895, 104399, 134903, 165407, 195911 |
| 5872 | ADM95780 | 5872 | 36376 | 66880, 97384, 127888, 158392, 188896 | 12888 | AJJ99413 | 12888 | 43392 | 73896, 104400, 134904, 165408, 195912 |
| 5873 | ADM95783 | 5873 | 36377 | 66881, 97385, 127889, 158393, 188897 | 12889 | AJJ99425 | 12889 | 43393 | 73897, 104401, 134905, 165409, 195913 |
| 5874 | ADM95784 | 5874 | 36378 | 66882, 97386, 127890, 158394, 188898 | 12890 | AJJ99437 | 12890 | 43394 | 73898, 104402, 134906, 165410, 195914 |
| 5875 | ADM95785 | 5875 | 36379 | 66883, 97387, 127891, 158395, 188899 | 12891 | AJJ99449 | 12891 | 43395 | 73899, 104403, 134907, 165411, 195915 |
| 5876 | ADM95786 | 5876 | 36380 | 66884, 97388, 127892, 158396, 188900 | 12892 | AJJ99461 | 12892 | 43396 | 73900, 104404, 134908, 165412, 195916 |
| 5877 | ADM95788 | 5877 | 36381 | 66885, 97389, 127893, 158397, 188901 | 12893 | AJJ99483 | 12893 | 43397 | 73901, 104405, 134909, 165413, 195917 |
| 5878 | ADM95789 | 5878 | 36382 | 66886, 97390, 127894, 158398, 188902 | 12894 | AJJ99494 | 12894 | 43398 | 73902, 104406, 134910, 165414, 195918 |
| 5879 | ADM95790 | 5879 | 36383 | 66887, 97391, 127895, 158399, 188903 | 12895 | AJJ99505 | 12895 | 43399 | 73903, 104407, 134911, 165415, 195919 |

FIG. 1 continued

| | | | | | | | | | |
|---|---|---|---|---|---|---|---|---|---|
| 5880 | ADM95791 | 5880 | 36384 | 66888, 97392, 127896, 158400, 188904 | 12896 | AJJ99516 | 12896 | 43400 | 73904, 104408, 134912, 165416, 195920 |
| 5881 | ADM95792 | 5881 | 36385 | 66889, 97393, 127897, 158401, 188905 | 12897 | AJJ99527 | 12897 | 43401 | 73905, 104409, 134913, 165417, 195921 |
| 5882 | ADM95793 | 5882 | 36386 | 66890, 97394, 127898, 158402, 188906 | 12898 | AJJ99538 | 12898 | 43402 | 73906, 104410, 134914, 165418, 195922 |
| 5883 | ADM95794 | 5883 | 36387 | 66891, 97395, 127899, 158403, 188907 | 12899 | AJJ99549 | 12899 | 43403 | 73907, 104411, 134915, 165419, 195923 |
| 5884 | ADM95795 | 5884 | 36388 | 66892, 97396, 127900, 158404, 188908 | 12900 | AJJ99560 | 12900 | 43404 | 73908, 104412, 134916, 165420, 195924 |
| 5885 | ADM95798 | 5885 | 36389 | 66893, 97397, 127901, 158405, 188909 | 12901 | AJJ99571 | 12901 | 43405 | 73909, 104413, 134917, 165421, 195925 |
| 5886 | ADM95799 | 5886 | 36390 | 66894, 97398, 127902, 158406, 188910 | 12902 | AJJ99582 | 12902 | 43406 | 73910, 104414, 134918, 165422, 195926 |
| 5887 | ADM95800 | 5887 | 36391 | 66895, 97399, 127903, 158407, 188911 | 12903 | AJJ99593 | 12903 | 43407 | 73911, 104415, 134919, 165423, 195927 |
| 5888 | ADM95801 | 5888 | 36392 | 66896, 97400, 127904, 158408, 188912 | 12904 | AJJ99604 | 12904 | 43408 | 73912, 104416, 134920, 165424, 195928 |
| 5889 | ADM95802 | 5889 | 36393 | 66897, 97401, 127905, 158409, 188913 | 12905 | AJJ99616 | 12905 | 43409 | 73913, 104417, 134921, 165425, 195929 |
| 5890 | ADM95803 | 5890 | 36394 | 66898, 97402, 127906, 158410, 188914 | 12906 | AJJ99628 | 12906 | 43410 | 73914, 104418, 134922, 165426, 195930 |
| 5891 | ADM95804 | 5891 | 36395 | 66899, 97403, 127907, 158411, 188915 | 12907 | AJJ99640 | 12907 | 43411 | 73915, 104419, 134923, 165427, 195931 |
| 5892 | ADM95805 | 5892 | 36396 | 66900, 97404, 127908, 158412, 188916 | 12908 | AJJ99652 | 12908 | 43412 | 73916, 104420, 134924, 165428, 195932 |
| 5893 | ADM95808 | 5893 | 36397 | 66901, 97405, 127909, 158413, 188917 | 12909 | AJJ99664 | 12909 | 43413 | 73917, 104421, 134925, 165429, 195933 |
| 5894 | ADM95809 | 5894 | 36398 | 66902, 97406, 127910, 158414, 188918 | 12910 | AJJ99675 | 12910 | 43414 | 73918, 104422, 134926, 165430, 195934 |
| 5895 | ADM95810 | 5895 | 36399 | 66903, 97407, 127911, 158415, 188919 | 12911 | AJJ99686 | 12911 | 43415 | 73919, 104423, 134927, 165431, 195935 |
| 5896 | ADM95812 | 5896 | 36400 | 66904, 97408, 127912, 158416, 188920 | 12912 | AJJ99697 | 12912 | 43416 | 73920, 104424, 134928, 165432, 195936 |
| 5897 | ADM95816 | 5897 | 36401 | 66905, 97409, 127913, 158417, 188921 | 12913 | AJJ99708 | 12913 | 43417 | 73921, 104425, 134929, 165433, 195937 |

FIG. 1 continued

| | | | | | | | | | |
|---|---|---|---|---|---|---|---|---|---|
| 5898 | ADM95819 | 5898 | 36402 | 66906, 97410, 127914, 158418, 188922 | 12914 | AJJ99719 | 12914 | 43418 | 73922, 104426, 134930, 165434, 195938 |
| 5899 | ADM95820 | 5899 | 36403 | 66907, 97411, 127915, 158419, 188923 | 12915 | AJJ99730 | 12915 | 43419 | 73923, 104427, 134931, 165435, 195939 |
| 5900 | ADM95821 | 5900 | 36404 | 66908, 97412, 127916, 158420, 188924 | 12916 | AJJ99741 | 12916 | 43420 | 73924, 104428, 134932, 165436, 195940 |
| 5901 | ADM95822 | 5901 | 36405 | 66909, 97413, 127917, 158421, 188925 | 12917 | AJJ99752 | 12917 | 43421 | 73925, 104429, 134933, 165437, 195941 |
| 5902 | ADM95823 | 5902 | 36406 | 66910, 97414, 127918, 158422, 188926 | 12918 | AJJ99763 | 12918 | 43422 | 73926, 104430, 134934, 165438, 195942 |
| 5903 | ADM95824 | 5903 | 36407 | 66911, 97415, 127919, 158423, 188927 | 12919 | AJJ99775 | 12919 | 43423 | 73927, 104431, 134935, 165439, 195943 |
| 5904 | ADM95825 | 5904 | 36408 | 66912, 97416, 127920, 158424, 188928 | 12920 | AJJ99786 | 12920 | 43424 | 73928, 104432, 134936, 165440, 195944 |
| 5905 | ADM95826 | 5905 | 36409 | 66913, 97417, 127921, 158425, 188929 | 12921 | AJJ99798 | 12921 | 43425 | 73929, 104433, 134937, 165441, 195945 |
| 5906 | ADM95827 | 5906 | 36410 | 66914, 97418, 127922, 158426, 188930 | 12922 | AJJ99810 | 12922 | 43426 | 73930, 104434, 134938, 165442, 195946 |
| 5907 | ADM95828 | 5907 | 36411 | 66915, 97419, 127923, 158427, 188931 | 12923 | AJJ99822 | 12923 | 43427 | 73931, 104435, 134939, 165443, 195947 |
| 5908 | ADM95829 | 5908 | 36412 | 66916, 97420, 127924, 158428, 188932 | 12924 | AJJ99833 | 12924 | 43428 | 73932, 104436, 134940, 165444, 195948 |
| 5909 | ADM95831 | 5909 | 36413 | 66917, 97421, 127925, 158429, 188933 | 12925 | AJJ99844 | 12925 | 43429 | 73933, 104437, 134941, 165445, 195949 |
| 5910 | ADM95832 | 5910 | 36414 | 66918, 97422, 127926, 158430, 188934 | 12926 | AJJ99855 | 12926 | 43430 | 73934, 104438, 134942, 165446, 195950 |
| 5911 | ADM95833 | 5911 | 36415 | 66919, 97423, 127927, 158431, 188935 | 12927 | AJJ99866 | 12927 | 43431 | 73935, 104439, 134943, 165447, 195951 |
| 5912 | ADM95834 | 5912 | 36416 | 66920, 97424, 127928, 158432, 188936 | 12928 | AJJ99877 | 12928 | 43432 | 73936, 104440, 134944, 165448, 195952 |
| 5913 | ADM95836 | 5913 | 36417 | 66921, 97425, 127929, 158433, 188937 | 12929 | AJJ99888 | 12929 | 43433 | 73937, 104441, 134945, 165449, 195953 |
| 5914 | ADM95837 | 5914 | 36418 | 66922, 97426, 127930, 158434, 188938 | 12930 | AJJ99899 | 12930 | 43434 | 73938, 104442, 134946, 165450, 195954 |
| 5915 | ADM95838 | 5915 | 36419 | 66923, 97427, 127931, 158435, 188939 | 12931 | AJJ99910 | 12931 | 43435 | 73939, 104443, 134947, 165451, 195955 |

FIG. 1 continued

| | | | | | | | | | |
|---|---|---|---|---|---|---|---|---|---|
| 5916 | ADM95839 | 5916 | 36420 | 66924, 97428, 127932, 158436, 188940 | 12932 | AJJ99921 | 12932 | 43436 | 73940, 104444, 134948, 165452, 195956 |
| 5917 | ADM95840 | 5917 | 36421 | 66925, 97429, 127933, 158437, 188941 | 12933 | AJJ99932 | 12933 | 43437 | 73941, 104445, 134949, 165453, 195957 |
| 5918 | ADM95842 | 5918 | 36422 | 66926, 97430, 127934, 158438, 188942 | 12934 | AJJ99943 | 12934 | 43438 | 73942, 104446, 134950, 165454, 195958 |
| 5919 | ADM95843 | 5919 | 36423 | 66927, 97431, 127935, 158439, 188943 | 12935 | AJJ99954 | 12935 | 43439 | 73943, 104447, 134951, 165455, 195959 |
| 5920 | ADM95844 | 5920 | 36424 | 66928, 97432, 127936, 158440, 188944 | 12936 | AJJ99965 | 12936 | 43440 | 73944, 104448, 134952, 165456, 195960 |
| 5921 | ADM95845 | 5921 | 36425 | 66929, 97433, 127937, 158441, 188945 | 12937 | AJJ99989 | 12937 | 43441 | 73945, 104449, 134953, 165457, 195961 |
| 5922 | ADM95846 | 5922 | 36426 | 66930, 97434, 127938, 158442, 188946 | 12938 | AJK00001 | 12938 | 43442 | 73946, 104450, 134954, 165458, 195962 |
| 5923 | ADM95847 | 5923 | 36427 | 66931, 97435, 127939, 158443, 188947 | 12939 | AJK00012 | 12939 | 43443 | 73947, 104451, 134955, 165459, 195963 |
| 5924 | ADM95848 | 5924 | 36428 | 66932, 97436, 127940, 158444, 188948 | 12940 | AJK00023 | 12940 | 43444 | 73948, 104452, 134956, 165460, 195964 |
| 5925 | ADM95849 | 5925 | 36429 | 66933, 97437, 127941, 158445, 188949 | 12941 | AJK00034 | 12941 | 43445 | 73949, 104453, 134957, 165461, 195965 |
| 5926 | ADM95850 | 5926 | 36430 | 66934, 97438, 127942, 158446, 188950 | 12942 | AJK00045 | 12942 | 43446 | 73950, 104454, 134958, 165462, 195966 |
| 5927 | ADM95851 | 5927 | 36431 | 66935, 97439, 127943, 158447, 188951 | 12943 | AJK00056 | 12943 | 43447 | 73951, 104455, 134959, 165463, 195967 |
| 5928 | ADM95852 | 5928 | 36432 | 66936, 97440, 127944, 158448, 188952 | 12944 | AJK00067 | 12944 | 43448 | 73952, 104456, 134960, 165464, 195968 |
| 5929 | ADM95854 | 5929 | 36433 | 66937, 97441, 127945, 158449, 188953 | 12945 | AJK00079 | 12945 | 43449 | 73953, 104457, 134961, 165465, 195969 |
| 5930 | ADM95855 | 5930 | 36434 | 66938, 97442, 127946, 158450, 188954 | 12946 | AJK00091 | 12946 | 43450 | 73954, 104458, 134962, 165466, 195970 |
| 5931 | ADM95857 | 5931 | 36435 | 66939, 97443, 127947, 158451, 188955 | 12947 | AJK00103 | 12947 | 43451 | 73955, 104459, 134963, 165467, 195971 |
| 5932 | ADM95858 | 5932 | 36436 | 66940, 97444, 127948, 158452, 188956 | 12948 | AJK00114 | 12948 | 43452 | 73956, 104460, 134964, 165468, 195972 |
| 5933 | ADM95859 | 5933 | 36437 | 66941, 97445, 127949, 158453, 188957 | 12949 | AJK00125 | 12949 | 43453 | 73957, 104461, 134965, 165469, 195973 |

FIG. 1 continued

| | | | | | | | | | |
|---|---|---|---|---|---|---|---|---|---|
| 5934 | ADM95860 | 5934 | 36438 | 66942, 97446, 127950, 158454, 188958 | 12950 | AJK00136 | 12950 | 43454 | 73958, 104462, 134966, 165470, 195974 |
| 5935 | ADM95862 | 5935 | 36439 | 66943, 97447, 127951, 158455, 188959 | 12951 | AJK00166 | 12951 | 43455 | 73959, 104463, 134967, 165471, 195975 |
| 5936 | ADM95864 | 5936 | 36440 | 66944, 97448, 127952, 158456, 188960 | 12952 | AJK00177 | 12952 | 43456 | 73960, 104464, 134968, 165472, 195976 |
| 5937 | ADM95865 | 5937 | 36441 | 66945, 97449, 127953, 158457, 188961 | 12953 | AJK00188 | 12953 | 43457 | 73961, 104465, 134969, 165473, 195977 |
| 5938 | ADM95866 | 5938 | 36442 | 66946, 97450, 127954, 158458, 188962 | 12954 | AJK00207 | 12954 | 43458 | 73962, 104466, 134970, 165474, 195978 |
| 5939 | ADN06300 | 5939 | 36443 | 66947, 97451, 127955, 158459, 188963 | 12955 | AJK00218 | 12955 | 43459 | 73963, 104467, 134971, 165475, 195979 |
| 5940 | ADN06311 | 5940 | 36444 | 66948, 97452, 127956, 158460, 188964 | 12956 | AJK00239 | 12956 | 43460 | 73964, 104468, 134972, 165476, 195980 |
| 5941 | ADN06322 | 5941 | 36445 | 66949, 97453, 127957, 158461, 188965 | 12957 | AJS18468 | 12957 | 43461 | 73965, 104469, 134973, 165477, 195981 |
| 5942 | ADN06344 | 5942 | 36446 | 66950, 97454, 127958, 158462, 188966 | 12958 | AJS18479 | 12958 | 43462 | 73966, 104470, 134974, 165478, 195982 |
| 5943 | ADN06366 | 5943 | 36447 | 66951, 97455, 127959, 158463, 188967 | 12959 | AJY79339 | 12959 | 43463 | 73967, 104471, 134975, 165479, 195983 |
| 5944 | ADN26165 | 5944 | 36448 | 66952, 97456, 127960, 158464, 188968 | 12960 | AJY79341 | 12960 | 43464 | 73968, 104472, 134976, 165480, 195984 |
| 5945 | ADN26175 | 5945 | 36449 | 66953, 97457, 127961, 158465, 188969 | 12961 | AJY79342 | 12961 | 43465 | 73969, 104473, 134977, 165481, 195985 |
| 5946 | ADN78194 | 5946 | 36450 | 66954, 97458, 127962, 158466, 188970 | 12962 | AJY79343 | 12962 | 43466 | 73970, 104474, 134978, 165482, 195986 |
| 5947 | ADN78195 | 5947 | 36451 | 66955, 97459, 127963, 158467, 188971 | 12963 | AJY79345 | 12963 | 43467 | 73971, 104475, 134979, 165483, 195987 |
| 5948 | ADN78212 | 5948 | 36452 | 66956, 97460, 127964, 158468, 188972 | 12964 | AKA54643 | 12964 | 43468 | 73972, 104476, 134980, 165484, 195988 |
| 5949 | ADN78221 | 5949 | 36453 | 66957, 97461, 127965, 158469, 188973 | 12965 | AKA54650 | 12965 | 43469 | 73973, 104477, 134981, 165485, 195989 |
| 5950 | ADN89050 | 5950 | 36454 | 66958, 97462, 127966, 158470, 188974 | 12966 | AKA54651 | 12966 | 43470 | 73974, 104478, 134982, 165486, 195990 |
| 5951 | ADN89061 | 5951 | 36455 | 66959, 97463, 127967, 158471, 188975 | 12967 | AKA59351 | 12967 | 43471 | 73975, 104479, 134983, 165487, 195991 |

FIG. 1 continued

| | | | | | | | | | |
|---|---|---|---|---|---|---|---|---|---|
| 5952 | ADN89072 | 5952 | 36456 | 66960, 97464, 127968, 158472, 188976 | 12968 | AKA59353 | 12968 | 43472 | 73976, 104480, 134984, 165488, 195992 |
| 5953 | ADN89083 | 5953 | 36457 | 66961, 97465, 127969, 158473, 188977 | 12969 | AKA59355 | 12969 | 43473 | 73977, 104481, 134985, 165489, 195993 |
| 5954 | ADN89094 | 5954 | 36458 | 66962, 97466, 127970, 158474, 188978 | 12970 | AKE37137 | 12970 | 43474 | 73978, 104482, 134986, 165490, 195994 |
| 5955 | ADN89116 | 5955 | 36459 | 66963, 97467, 127971, 158475, 188979 | 12971 | AKS48035 | 12971 | 43475 | 73979, 104483, 134987, 165491, 195995 |
| 5956 | ADN89127 | 5956 | 36460 | 66964, 97468, 127972, 158476, 188980 | 12972 | ALA08472 | 12972 | 43476 | 73980, 104484, 134988, 165492, 195996 |
| 5957 | ADN89149 | 5957 | 36461 | 66965, 97469, 127973, 158477, 188981 | 12973 | ALA08475 | 12973 | 43477 | 73981, 104485, 134989, 165493, 195997 |
| 5958 | ADN89171 | 5958 | 36462 | 66966, 97470, 127974, 158478, 188982 | 12974 | ALA08478 | 12974 | 43478 | 73982, 104486, 134990, 165494, 195998 |
| 5959 | ADN89182 | 5959 | 36463 | 66967, 97471, 127975, 158479, 188983 | 12975 | ALA08479 | 12975 | 43479 | 73983, 104487, 134991, 165495, 195999 |
| 5960 | ADN89193 | 5960 | 36464 | 66968, 97472, 127976, 158480, 188984 | 12976 | ALA08481 | 12976 | 43480 | 73984, 104488, 134992, 165496, 196000 |
| 5961 | ADN89204 | 5961 | 36465 | 66969, 97473, 127977, 158481, 188985 | 12977 | ALA08482 | 12977 | 43481 | 73985, 104489, 134993, 165497, 196001 |
| 5962 | ADN89215 | 5962 | 36466 | 66970, 97474, 127978, 158482, 188986 | 12978 | ALA08483 | 12978 | 43482 | 73986, 104490, 134994, 165498, 196002 |
| 5963 | ADN89226 | 5963 | 36467 | 66971, 97475, 127979, 158483, 188987 | 12979 | ALA08484 | 12979 | 43483 | 73987, 104491, 134995, 165499, 196003 |
| 5964 | ADN89237 | 5964 | 36468 | 66972, 97476, 127980, 158484, 188988 | 12980 | ALA08488 | 12980 | 43484 | 73988, 104492, 134996, 165500, 196004 |
| 5965 | ADN89248 | 5965 | 36469 | 66973, 97477, 127981, 158485, 188989 | 12981 | ALA08490 | 12981 | 43485 | 73989, 104493, 134997, 165501, 196005 |
| 5966 | ADN89259 | 5966 | 36470 | 66974, 97478, 127982, 158486, 188990 | 12982 | ALA08491 | 12982 | 43486 | 73990, 104494, 134998, 165502, 196006 |
| 5967 | ADN89281 | 5967 | 36471 | 66975, 97479, 127983, 158487, 188991 | 12983 | ALA08492 | 12983 | 43487 | 73991, 104495, 134999, 165503, 196007 |
| 5968 | ADN89292 | 5968 | 36472 | 66976, 97480, 127984, 158488, 188992 | 12984 | ALA08493 | 12984 | 43488 | 73992, 104496, 135000, 165504, 196008 |
| 5969 | ADN89303 | 5969 | 36473 | 66977, 97481, 127985, 158489, 188993 | 12985 | ALA08494 | 12985 | 43489 | 73993, 104497, 135001, 165505, 196009 |

FIG. 1 continued

| | | | | | | | | | |
|---|---|---|---|---|---|---|---|---|---|
| 5970 | ADN89314 | 5970 | 36474 | 66978, 97482, 127986, 158490, 188994 | 12986 | ALA08495 | 12986 | 43490 | 73994, 104498, 135002, 165506, 196010 |
| 5971 | ADN89325 | 5971 | 36475 | 66979, 97483, 127987, 158491, 188995 | 12987 | ALA08496 | 12987 | 43491 | 73995, 104499, 135003, 165507, 196011 |
| 5972 | ADN89336 | 5972 | 36476 | 66980, 97484, 127988, 158492, 188996 | 12988 | ALA08497 | 12988 | 43492 | 73996, 104500, 135004, 165508, 196012 |
| 5973 | ADN89347 | 5973 | 36477 | 66981, 97485, 127989, 158493, 188997 | 12989 | ALA08498 | 12989 | 43493 | 73997, 104501, 135005, 165509, 196013 |
| 5974 | ADN89358 | 5974 | 36478 | 66982, 97486, 127990, 158494, 188998 | 12990 | ALA08499 | 12990 | 43494 | 73998, 104502, 135006, 165510, 196014 |
| 5975 | ADN89369 | 5975 | 36479 | 66983, 97487, 127991, 158495, 188999 | 12991 | ALA08501 | 12991 | 43495 | 73999, 104503, 135007, 165511, 196015 |
| 5976 | ADN89380 | 5976 | 36480 | 66984, 97488, 127992, 158496, 189000 | 12992 | ALA08502 | 12992 | 43496 | 74000, 104504, 135008, 165512, 196016 |
| 5977 | ADN89391 | 5977 | 36481 | 66985, 97489, 127993, 158497, 189001 | 12993 | ALA08503 | 12993 | 43497 | 74001, 104505, 135009, 165513, 196017 |
| 5978 | ADN89402 | 5978 | 36482 | 66986, 97490, 127994, 158498, 189002 | 12994 | ALA08504 | 12994 | 43498 | 74002, 104506, 135010, 165514, 196018 |
| 5979 | ADN89413 | 5979 | 36483 | 66987, 97491, 127995, 158499, 189003 | 12995 | ALA08505 | 12995 | 43499 | 74003, 104507, 135011, 165515, 196019 |
| 5980 | ADN89424 | 5980 | 36484 | 66988, 97492, 127996, 158500, 189004 | 12996 | ALA08506 | 12996 | 43500 | 74004, 104508, 135012, 165516, 196020 |
| 5981 | ADN89435 | 5981 | 36485 | 66989, 97493, 127997, 158501, 189005 | 12997 | ALA08507 | 12997 | 43501 | 74005, 104509, 135013, 165517, 196021 |
| 5982 | ADN89446 | 5982 | 36486 | 66990, 97494, 127998, 158502, 189006 | 12998 | ALA08508 | 12998 | 43502 | 74006, 104510, 135014, 165518, 196022 |
| 5983 | ADN89457 | 5983 | 36487 | 66991, 97495, 127999, 158503, 189007 | 12999 | ALA08509 | 12999 | 43503 | 74007, 104511, 135015, 165519, 196023 |
| 5984 | ADN89468 | 5984 | 36488 | 66992, 97496, 128000, 158504, 189008 | 13000 | ALA08510 | 13000 | 43504 | 74008, 104512, 135016, 165520, 196024 |
| 5985 | ADN89479 | 5985 | 36489 | 66993, 97497, 128001, 158505, 189009 | 13001 | ALA08511 | 13001 | 43505 | 74009, 104513, 135017, 165521, 196025 |
| 5986 | ADN89490 | 5986 | 36490 | 66994, 97498, 128002, 158506, 189010 | 13002 | ALA08512 | 13002 | 43506 | 74010, 104514, 135018, 165522, 196026 |
| 5987 | ADN89501 | 5987 | 36491 | 66995, 97499, 128003, 158507, 189011 | 13003 | ALA08514 | 13003 | 43507 | 74011, 104515, 135019, 165523, 196027 |

FIG. 1 continued

| | | | | | | | | | |
|---|---|---|---|---|---|---|---|---|---|
| 5988 | ADN89512 | 5988 | 36492 | 66996, 97500, 128004, 158508, 189012 | 13004 | ALA08515 | 13004 | 43508 | 74012, 104516, 135020, 165524, 196028 |
| 5989 | ADN89523 | 5989 | 36493 | 66997, 97501, 128005, 158509, 189013 | 13005 | ALA08516 | 13005 | 43509 | 74013, 104517, 135021, 165525, 196029 |
| 5990 | ADN89534 | 5990 | 36494 | 66998, 97502, 128006, 158510, 189014 | 13006 | ALA08517 | 13006 | 43510 | 74014, 104518, 135022, 165526, 196030 |
| 5991 | ADN89545 | 5991 | 36495 | 66999, 97503, 128007, 158511, 189015 | 13007 | ALA08519 | 13007 | 43511 | 74015, 104519, 135023, 165527, 196031 |
| 5992 | ADN89556 | 5992 | 36496 | 67000, 97504, 128008, 158512, 189016 | 13008 | ALA08520 | 13008 | 43512 | 74016, 104520, 135024, 165528, 196032 |
| 5993 | ADN89567 | 5993 | 36497 | 67001, 97505, 128009, 158513, 189017 | 13009 | ALA08522 | 13009 | 43513 | 74017, 104521, 135025, 165529, 196033 |
| 5994 | ADN89578 | 5994 | 36498 | 67002, 97506, 128010, 158514, 189018 | 13010 | ALA08523 | 13010 | 43514 | 74018, 104522, 135026, 165530, 196034 |
| 5995 | ADN89589 | 5995 | 36499 | 67003, 97507, 128011, 158515, 189019 | 13011 | ALA08524 | 13011 | 43515 | 74019, 104523, 135027, 165531, 196035 |
| 5996 | ADN89600 | 5996 | 36500 | 67004, 97508, 128012, 158516, 189020 | 13012 | ALA08525 | 13012 | 43516 | 74020, 104524, 135028, 165532, 196036 |
| 5997 | ADN89611 | 5997 | 36501 | 67005, 97509, 128013, 158517, 189021 | 13013 | ALA08526 | 13013 | 43517 | 74021, 104525, 135029, 165533, 196037 |
| 5998 | ADN89622 | 5998 | 36502 | 67006, 97510, 128014, 158518, 189022 | 13014 | ALA08527 | 13014 | 43518 | 74022, 104526, 135030, 165534, 196038 |
| 5999 | ADN89633 | 5999 | 36503 | 67007, 97511, 128015, 158519, 189023 | 13015 | ALA08528 | 13015 | 43519 | 74023, 104527, 135031, 165535, 196039 |
| 6000 | ADN89644 | 6000 | 36504 | 67008, 97512, 128016, 158520, 189024 | 13016 | ALA08529 | 13016 | 43520 | 74024, 104528, 135032, 165536, 196040 |
| 6001 | ADN89655 | 6001 | 36505 | 67009, 97513, 128017, 158521, 189025 | 13017 | ALA08530 | 13017 | 43521 | 74025, 104529, 135033, 165537, 196041 |
| 6002 | ADN89666 | 6002 | 36506 | 67010, 97514, 128018, 158522, 189026 | 13018 | ALA08531 | 13018 | 43522 | 74026, 104530, 135034, 165538, 196042 |
| 6003 | ADN89677 | 6003 | 36507 | 67011, 97515, 128019, 158523, 189027 | 13019 | ALA08532 | 13019 | 43523 | 74027, 104531, 135035, 165539, 196043 |
| 6004 | ADN89688 | 6004 | 36508 | 67012, 97516, 128020, 158524, 189028 | 13020 | ALA08533 | 13020 | 43524 | 74028, 104532, 135036, 165540, 196044 |
| 6005 | ADN89699 | 6005 | 36509 | 67013, 97517, 128021, 158525, 189029 | 13021 | ALA08534 | 13021 | 43525 | 74029, 104533, 135037, 165541, 196045 |

FIG. 1 continued

| | | | | | | | | | |
|---|---|---|---|---|---|---|---|---|---|
| 6006 | ADN89710 | 6006 | 36510 | 67014, 97518, 128022, 158526, 189030 | 13022 | ALA08535 | 13022 | 43526 | 74030, 104534, 135038, 165542, 196046 |
| 6007 | ADN89721 | 6007 | 36511 | 67015, 97519, 128023, 158527, 189031 | 13023 | ALA08536 | 13023 | 43527 | 74031, 104535, 135039, 165543, 196047 |
| 6008 | ADN89732 | 6008 | 36512 | 67016, 97520, 128024, 158528, 189032 | 13024 | ALA08537 | 13024 | 43528 | 74032, 104536, 135040, 165544, 196048 |
| 6009 | ADN89743 | 6009 | 36513 | 67017, 97521, 128025, 158529, 189033 | 13025 | ALA08538 | 13025 | 43529 | 74033, 104537, 135041, 165545, 196049 |
| 6010 | ADN89765 | 6010 | 36514 | 67018, 97522, 128026, 158530, 189034 | 13026 | ALA08539 | 13026 | 43530 | 74034, 104538, 135042, 165546, 196050 |
| 6011 | ADN89776 | 6011 | 36515 | 67019, 97523, 128027, 158531, 189035 | 13027 | ALA08540 | 13027 | 43531 | 74035, 104539, 135043, 165547, 196051 |
| 6012 | ADN89787 | 6012 | 36516 | 67020, 97524, 128028, 158532, 189036 | 13028 | ALA08541 | 13028 | 43532 | 74036, 104540, 135044, 165548, 196052 |
| 6013 | ADN89798 | 6013 | 36517 | 67021, 97525, 128029, 158533, 189037 | 13029 | ALA08542 | 13029 | 43533 | 74037, 104541, 135045, 165549, 196053 |
| 6014 | ADN89809 | 6014 | 36518 | 67022, 97526, 128030, 158534, 189038 | 13030 | ALA08543 | 13030 | 43534 | 74038, 104542, 135046, 165550, 196054 |
| 6015 | ADN89820 | 6015 | 36519 | 67023, 97527, 128031, 158535, 189039 | 13031 | ALA08545 | 13031 | 43535 | 74039, 104543, 135047, 165551, 196055 |
| 6016 | ADN89831 | 6016 | 36520 | 67024, 97528, 128032, 158536, 189040 | 13032 | ALA08546 | 13032 | 43536 | 74040, 104544, 135048, 165552, 196056 |
| 6017 | ADN89842 | 6017 | 36521 | 67025, 97529, 128033, 158537, 189041 | 13033 | ALA08548 | 13033 | 43537 | 74041, 104545, 135049, 165553, 196057 |
| 6018 | ADN89864 | 6018 | 36522 | 67026, 97530, 128034, 158538, 189042 | 13034 | ALA08549 | 13034 | 43538 | 74042, 104546, 135050, 165554, 196058 |
| 6019 | ADN89875 | 6019 | 36523 | 67027, 97531, 128035, 158539, 189043 | 13035 | ALA08550 | 13035 | 43539 | 74043, 104547, 135051, 165555, 196059 |
| 6020 | ADN89886 | 6020 | 36524 | 67028, 97532, 128036, 158540, 189044 | 13036 | ALA08551 | 13036 | 43540 | 74044, 104548, 135052, 165556, 196060 |
| 6021 | ADN89897 | 6021 | 36525 | 67029, 97533, 128037, 158541, 189045 | 13037 | ALA08552 | 13037 | 43541 | 74045, 104549, 135053, 165557, 196061 |
| 6022 | ADN89908 | 6022 | 36526 | 67030, 97534, 128038, 158542, 189046 | 13038 | ALA08553 | 13038 | 43542 | 74046, 104550, 135054, 165558, 196062 |
| 6023 | ADN89919 | 6023 | 36527 | 67031, 97535, 128039, 158543, 189047 | 13039 | ALA08554 | 13039 | 43543 | 74047, 104551, 135055, 165559, 196063 |

FIG. 1 continued

| | | | | | | | | | |
|---|---|---|---|---|---|---|---|---|---|
| 6024 | ADN89930 | 6024 | 36528 | 67032, 97536, 128040, 158544, 189048 | 13040 | ALAD8555 | 13040 | 43544 | 74048, 104552, 135056, 165560, 196064 |
| 6025 | ADN89941 | 6025 | 36529 | 67033, 97537, 128041, 158545, 189049 | 13041 | ALAD8556 | 13041 | 43545 | 74049, 104553, 135057, 165561, 196065 |
| 6026 | ADN89952 | 6026 | 36530 | 67034, 97538, 128042, 158546, 189050 | 13042 | ALAD8557 | 13042 | 43546 | 74050, 104554, 135058, 165562, 196066 |
| 6027 | ADN89963 | 6027 | 36531 | 67035, 97539, 128043, 158547, 189051 | 13043 | ALAD8558 | 13043 | 43547 | 74051, 104555, 135059, 165563, 196067 |
| 6028 | ADN89974 | 6028 | 36532 | 67036, 97540, 128044, 158548, 189052 | 13044 | ALAD8559 | 13044 | 43548 | 74052, 104556, 135060, 165564, 196068 |
| 6029 | ADN89985 | 6029 | 36533 | 67037, 97541, 128045, 158549, 189053 | 13045 | ALAD8560 | 13045 | 43549 | 74053, 104557, 135061, 165565, 196069 |
| 6030 | ADN89996 | 6030 | 36534 | 67038, 97542, 128046, 158550, 189054 | 13046 | ALAD8561 | 13046 | 43550 | 74054, 104558, 135062, 165566, 196070 |
| 6031 | ADN90007 | 6031 | 36535 | 67039, 97543, 128047, 158551, 189055 | 13047 | ALAD8563 | 13047 | 43551 | 74055, 104559, 135063, 165567, 196071 |
| 6032 | ADN90018 | 6032 | 36536 | 67040, 97544, 128048, 158552, 189056 | 13048 | ALAD8571 | 13048 | 43552 | 74056, 104560, 135064, 165568, 196072 |
| 6033 | ADN90040 | 6033 | 36537 | 67041, 97545, 128049, 158553, 189057 | 13049 | ALAD8572 | 13049 | 43553 | 74057, 104561, 135065, 165569, 196073 |
| 6034 | ADN90051 | 6034 | 36538 | 67042, 97546, 128050, 158554, 189058 | 13050 | ALAD8573 | 13050 | 43554 | 74058, 104562, 135066, 165570, 196074 |
| 6035 | ADN90062 | 6035 | 36539 | 67043, 97547, 128051, 158555, 189059 | 13051 | ALAD8574 | 13051 | 43555 | 74059, 104563, 135067, 165571, 196075 |
| 6036 | ADN90073 | 6036 | 36540 | 67044, 97548, 128052, 158556, 189060 | 13052 | ALAD8575 | 13052 | 43556 | 74060, 104564, 135068, 165572, 196076 |
| 6037 | ADN90084 | 6037 | 36541 | 67045, 97549, 128053, 158557, 189061 | 13053 | ALAD8576 | 13053 | 43557 | 74061, 104565, 135069, 165573, 196077 |
| 6038 | ADN90095 | 6038 | 36542 | 67046, 97550, 128054, 158558, 189062 | 13054 | ALAD8577 | 13054 | 43558 | 74062, 104566, 135070, 165574, 196078 |
| 6039 | ADN90106 | 6039 | 36543 | 67047, 97551, 128055, 158559, 189063 | 13055 | ALAD8579 | 13055 | 43559 | 74063, 104567, 135071, 165575, 196079 |
| 6040 | ADN90117 | 6040 | 36544 | 67048, 97552, 128056, 158560, 189064 | 13056 | ALAD8580 | 13056 | 43560 | 74064, 104568, 135072, 165576, 196080 |
| 6041 | ADN90128 | 6041 | 36545 | 67049, 97553, 128057, 158561, 189065 | 13057 | ALAD8582 | 13057 | 43561 | 74065, 104569, 135073, 165577, 196081 |

FIG. 1 continued

| | | | | | | | | | |
|---|---|---|---|---|---|---|---|---|---|
| 6042 | ADN90139 | 6042 | 36546 | 67050, 97554, 128058, 158562, 189066 | 13058 | ALA08583 | 13058 | 43562 | 74066, 104570, 135074, 165578, 196082 |
| 6043 | ADN90150 | 6043 | 36547 | 67051, 97555, 128059, 158563, 189067 | 13059 | ALA08584 | 13059 | 43563 | 74067, 104571, 135075, 165579, 196083 |
| 6044 | ADN90161 | 6044 | 36548 | 67052, 97556, 128060, 158564, 189068 | 13060 | ALA08585 | 13060 | 43564 | 74068, 104572, 135076, 165580, 196084 |
| 6045 | ADN90172 | 6045 | 36549 | 67053, 97557, 128061, 158565, 189069 | 13061 | ALA08586 | 13061 | 43565 | 74069, 104573, 135077, 165581, 196085 |
| 6046 | ADN90183 | 6046 | 36550 | 67054, 97558, 128062, 158566, 189070 | 13062 | ALA08587 | 13062 | 43566 | 74070, 104574, 135078, 165582, 196086 |
| 6047 | ADN90194 | 6047 | 36551 | 67055, 97559, 128063, 158567, 189071 | 13063 | ALA08588 | 13063 | 43567 | 74071, 104575, 135079, 165583, 196087 |
| 6048 | ADN90205 | 6048 | 36552 | 67056, 97560, 128064, 158568, 189072 | 13064 | ALA08589 | 13064 | 43568 | 74072, 104576, 135080, 165584, 196088 |
| 6049 | ADN90216 | 6049 | 36553 | 67057, 97561, 128065, 158569, 189073 | 13065 | ALA08590 | 13065 | 43569 | 74073, 104577, 135081, 165585, 196089 |
| 6050 | ADN92467 | 6050 | 36554 | 67058, 97562, 128066, 158570, 189074 | 13066 | ALA08591 | 13066 | 43570 | 74074, 104578, 135082, 165586, 196090 |
| 6051 | ADN92478 | 6051 | 36555 | 67059, 97563, 128067, 158571, 189075 | 13067 | ALA08592 | 13067 | 43571 | 74075, 104579, 135083, 165587, 196091 |
| 6052 | ADN92489 | 6052 | 36556 | 67060, 97564, 128068, 158572, 189076 | 13068 | ALA08594 | 13068 | 43572 | 74076, 104580, 135084, 165588, 196092 |
| 6053 | ADN92500 | 6053 | 36557 | 67061, 97565, 128069, 158573, 189077 | 13069 | ALA08595 | 13069 | 43573 | 74077, 104581, 135085, 165589, 196093 |
| 6054 | ADN92510 | 6054 | 36558 | 67062, 97566, 128070, 158574, 189078 | 13070 | ALA08596 | 13070 | 43574 | 74078, 104582, 135086, 165590, 196094 |
| 6055 | ADN92520 | 6055 | 36559 | 67063, 97567, 128071, 158575, 189079 | 13071 | ALA08597 | 13071 | 43575 | 74079, 104583, 135087, 165591, 196095 |
| 6056 | ADN92530 | 6056 | 36560 | 67064, 97568, 128072, 158576, 189080 | 13072 | ALA08598 | 13072 | 43576 | 74080, 104584, 135088, 165592, 196096 |
| 6057 | ADN92540 | 6057 | 36561 | 67065, 97569, 128073, 158577, 189081 | 13073 | ALA08599 | 13073 | 43577 | 74081, 104585, 135089, 165593, 196097 |
| 6058 | ADN92550 | 6058 | 36562 | 67066, 97570, 128074, 158578, 189082 | 13074 | ALA08600 | 13074 | 43578 | 74082, 104586, 135090, 165594, 196098 |
| 6059 | ADN92560 | 6059 | 36563 | 67067, 97571, 128075, 158579, 189083 | 13075 | ALA08601 | 13075 | 43579 | 74083, 104587, 135091, 165595, 196099 |

FIG. 1 continued

| | | | | | | | | | |
|---|---|---|---|---|---|---|---|---|---|
| 6060 | AD000730 | 6060 | 36564 | 67068, 97572, 128076, 158580, 189084 | 13076 | ALA08602 | 13076 | 43580 | 74084, 104588, 135092, 165596, 196100 |
| 6061 | AD000740 | 6061 | 36565 | 67069, 97573, 128077, 158581, 189085 | 13077 | ALA08603 | 13077 | 43581 | 74085, 104589, 135093, 165597, 196101 |
| 6062 | AD000750 | 6062 | 36566 | 67070, 97574, 128078, 158582, 189086 | 13078 | ALA08605 | 13078 | 43582 | 74086, 104590, 135094, 165598, 196102 |
| 6063 | AD012143 | 6063 | 36567 | 67071, 97575, 128079, 158583, 189087 | 13079 | ALA08606 | 13079 | 43583 | 74087, 104591, 135095, 165599, 196103 |
| 6064 | AD012153 | 6064 | 36568 | 67072, 97576, 128080, 158584, 189088 | 13080 | ALA08607 | 13080 | 43584 | 74088, 104592, 135096, 165600, 196104 |
| 6065 | AD012163 | 6065 | 36569 | 67073, 97577, 128081, 158585, 189089 | 13081 | ALA08609 | 13081 | 43585 | 74089, 104593, 135097, 165601, 196105 |
| 6066 | AD012173 | 6066 | 36570 | 67074, 97578, 128082, 158586, 189090 | 13082 | ALA08610 | 13082 | 43586 | 74090, 104594, 135098, 165602, 196106 |
| 6067 | AD012183 | 6067 | 36571 | 67075, 97579, 128083, 158587, 189091 | 13083 | ALA08611 | 13083 | 43587 | 74091, 104595, 135099, 165603, 196107 |
| 6068 | AD012193 | 6068 | 36572 | 67076, 97580, 128084, 158588, 189092 | 13084 | ALA08612 | 13084 | 43588 | 74092, 104596, 135100, 165604, 196108 |
| 6069 | AD012203 | 6069 | 36573 | 67077, 97581, 128085, 158589, 189093 | 13085 | ALA08614 | 13085 | 43589 | 74093, 104597, 135101, 165605, 196109 |
| 6070 | AD012213 | 6070 | 36574 | 67078, 97582, 128086, 158590, 189094 | 13086 | ALA08615 | 13086 | 43590 | 74094, 104598, 135102, 165606, 196110 |
| 6071 | AD012223 | 6071 | 36575 | 67079, 97583, 128087, 158591, 189095 | 13087 | ALA08616 | 13087 | 43591 | 74095, 104599, 135103, 165607, 196111 |
| 6072 | AD012233 | 6072 | 36576 | 67080, 97584, 128088, 158592, 189096 | 13088 | ALA08617 | 13088 | 43592 | 74096, 104600, 135104, 165608, 196112 |
| 6073 | AD012243 | 6073 | 36577 | 67081, 97585, 128089, 158593, 189097 | 13089 | ALA08619 | 13089 | 43593 | 74097, 104601, 135105, 165609, 196113 |
| 6074 | AD012253 | 6074 | 36578 | 67082, 97586, 128090, 158594, 189098 | 13090 | ALA08620 | 13090 | 43594 | 74098, 104602, 135106, 165610, 196114 |
| 6075 | AD012263 | 6075 | 36579 | 67083, 97587, 128091, 158595, 189099 | 13091 | ALA08621 | 13091 | 43595 | 74099, 104603, 135107, 165611, 196115 |
| 6076 | AD012273 | 6076 | 36580 | 67084, 97588, 128092, 158596, 189100 | 13092 | ALA08622 | 13092 | 43596 | 74100, 104604, 135108, 165612, 196116 |
| 6077 | AD012283 | 6077 | 36581 | 67085, 97589, 128093, 158597, 189101 | 13093 | ALA08623 | 13093 | 43597 | 74101, 104605, 135109, 165613, 196117 |

FIG. 1 continued

| | | | | | | | | | |
|---|---|---|---|---|---|---|---|---|---|
| 6078 | AD012293 | 6078 | 36582 | 67086, 97590, 128094, 158598, 189102 | 13094 | ALA08624 | 13094 | 43598 | 74102, 104606, 135110, 165614, 196118 |
| 6079 | AD012303 | 6079 | 36583 | 67087, 97591, 128095, 158599, 189103 | 13095 | ALA08625 | 13095 | 43599 | 74103, 104607, 135111, 165615, 196119 |
| 6080 | AD012313 | 6080 | 36584 | 67088, 97592, 128096, 158600, 189104 | 13096 | ALA08626 | 13096 | 43600 | 74104, 104608, 135112, 165616, 196120 |
| 6081 | AD012323 | 6081 | 36585 | 67089, 97593, 128097, 158601, 189105 | 13097 | ALA08627 | 13097 | 43601 | 74105, 104609, 135113, 165617, 196121 |
| 6082 | AD012333 | 6082 | 36586 | 67090, 97594, 128098, 158602, 189106 | 13098 | ALA08629 | 13098 | 43602 | 74106, 104610, 135114, 165618, 196122 |
| 6083 | AD012343 | 6083 | 36587 | 67091, 97595, 128099, 158603, 189107 | 13099 | ALA08630 | 13099 | 43603 | 74107, 104611, 135115, 165619, 196123 |
| 6084 | AD012353 | 6084 | 36588 | 67092, 97596, 128100, 158604, 189108 | 13100 | ALA08631 | 13100 | 43604 | 74108, 104612, 135116, 165620, 196124 |
| 6085 | AD012363 | 6085 | 36589 | 67093, 97597, 128101, 158605, 189109 | 13101 | ALA08632 | 13101 | 43605 | 74109, 104613, 135117, 165621, 196125 |
| 6086 | AD012373 | 6086 | 36590 | 67094, 97598, 128102, 158606, 189110 | 13102 | ALA08634 | 13102 | 43606 | 74110, 104614, 135118, 165622, 196126 |
| 6087 | AD012383 | 6087 | 36591 | 67095, 97599, 128103, 158607, 189111 | 13103 | ALA08635 | 13103 | 43607 | 74111, 104615, 135119, 165623, 196127 |
| 6088 | AD012403 | 6088 | 36592 | 67096, 97600, 128104, 158608, 189112 | 13104 | ALA08636 | 13104 | 43608 | 74112, 104616, 135120, 165624, 196128 |
| 6089 | AD012413 | 6089 | 36593 | 67097, 97601, 128105, 158609, 189113 | 13105 | ALA08637 | 13105 | 43609 | 74113, 104617, 135121, 165625, 196129 |
| 6090 | AD012423 | 6090 | 36594 | 67098, 97602, 128106, 158610, 189114 | 13106 | ALA08638 | 13106 | 43610 | 74114, 104618, 135122, 165626, 196130 |
| 6091 | AD012433 | 6091 | 36595 | 67099, 97603, 128107, 158611, 189115 | 13107 | ALA08639 | 13107 | 43611 | 74115, 104619, 135123, 165627, 196131 |
| 6092 | AD012443 | 6092 | 36596 | 67100, 97604, 128108, 158612, 189116 | 13108 | ALA08640 | 13108 | 43612 | 74116, 104620, 135124, 165628, 196132 |
| 6093 | AD012453 | 6093 | 36597 | 67101, 97605, 128109, 158613, 189117 | 13109 | ALA08641 | 13109 | 43613 | 74117, 104621, 135125, 165629, 196133 |
| 6094 | AD012463 | 6094 | 36598 | 67102, 97606, 128110, 158614, 189118 | 13110 | ALA08642 | 13110 | 43614 | 74118, 104622, 135126, 165630, 196134 |
| 6095 | AD012473 | 6095 | 36599 | 67103, 97607, 128111, 158615, 189119 | 13111 | ALA08643 | 13111 | 43615 | 74119, 104623, 135127, 165631, 196135 |

FIG. 1 continued

| | | | | | | | | | |
|---|---|---|---|---|---|---|---|---|---|
| 6096 | ADO12493 | 6096 | 36600 | 67104, 97608, 128112, 158616, 189120 | 13112 | ALA08644 | 13112 | 43616 | 74120, 104624, 135128, 165632, 196136 |
| 6097 | ADO12503 | 6097 | 36601 | 67105, 97609, 128113, 158617, 189121 | 13113 | ALA08645 | 13113 | 43617 | 74121, 104625, 135129, 165633, 196137 |
| 6098 | ADO12513 | 6098 | 36602 | 67106, 97610, 128114, 158618, 189122 | 13114 | ALA08646 | 13114 | 43618 | 74122, 104626, 135130, 165634, 196138 |
| 6099 | ADO12523 | 6099 | 36603 | 67107, 97611, 128115, 158619, 189123 | 13115 | ALA08647 | 13115 | 43619 | 74123, 104627, 135131, 165635, 196139 |
| 6100 | ADO12533 | 6100 | 36604 | 67108, 97612, 128116, 158620, 189124 | 13116 | ALA08648 | 13116 | 43620 | 74124, 104628, 135132, 165636, 196140 |
| 6101 | ADO12543 | 6101 | 36605 | 67109, 97613, 128117, 158621, 189125 | 13117 | ALA08650 | 13117 | 43621 | 74125, 104629, 135133, 165637, 196141 |
| 6102 | ADO12553 | 6102 | 36606 | 67110, 97614, 128118, 158622, 189126 | 13118 | ALA08652 | 13118 | 43622 | 74126, 104630, 135134, 165638, 196142 |
| 6103 | ADO12563 | 6103 | 36607 | 67111, 97615, 128119, 158623, 189127 | 13119 | ALA08653 | 13119 | 43623 | 74127, 104631, 135135, 165639, 196143 |
| 6104 | ADO12573 | 6104 | 36608 | 67112, 97616, 128120, 158624, 189128 | 13120 | ALA08654 | 13120 | 43624 | 74128, 104632, 135136, 165640, 196144 |
| 6105 | ADO12593 | 6105 | 36609 | 67113, 97617, 128121, 158625, 189129 | 13121 | ALA08655 | 13121 | 43625 | 74129, 104633, 135137, 165641, 196145 |
| 6106 | ADO12603 | 6106 | 36610 | 67114, 97618, 128122, 158626, 189130 | 13122 | ALA08656 | 13122 | 43626 | 74130, 104634, 135138, 165642, 196146 |
| 6107 | ADO12613 | 6107 | 36611 | 67115, 97619, 128123, 158627, 189131 | 13123 | ALA08657 | 13123 | 43627 | 74131, 104635, 135139, 165643, 196147 |
| 6108 | ADO12623 | 6108 | 36612 | 67116, 97620, 128124, 158628, 189132 | 13124 | ALA08658 | 13124 | 43628 | 74132, 104636, 135140, 165644, 196148 |
| 6109 | ADO14349 | 6109 | 36613 | 67117, 97621, 128125, 158629, 189133 | 13125 | ALA08659 | 13125 | 43629 | 74133, 104637, 135141, 165645, 196149 |
| 6110 | ADO14351 | 6110 | 36614 | 67118, 97622, 128126, 158630, 189134 | 13126 | ALA08660 | 13126 | 43630 | 74134, 104638, 135142, 165646, 196150 |
| 6111 | ADO14353 | 6111 | 36615 | 67119, 97623, 128127, 158631, 189135 | 13127 | ALA08662 | 13127 | 43631 | 74135, 104639, 135143, 165647, 196151 |
| 6112 | ADO14354 | 6112 | 36616 | 67120, 97624, 128128, 158632, 189136 | 13128 | ALA08663 | 13128 | 43632 | 74136, 104640, 135144, 165648, 196152 |
| 6113 | ADO14356 | 6113 | 36617 | 67121, 97625, 128129, 158633, 189137 | 13129 | ALA08665 | 13129 | 43633 | 74137, 104641, 135145, 165649, 196153 |

FIG. 1 continued

| | | | | | | | | | |
|---|---|---|---|---|---|---|---|---|---|
| 6114 | AD014357 | 6114 | 36618 | 67122, 97626, 128130, 158634, 189138 | 13130 | ALA08666 | 13130 | 43634 | 74138, 104642, 135146, 165650, 196154 |
| 6115 | AD014359 | 6115 | 36619 | 67123, 97627, 128131, 158635, 189139 | 13131 | ALA08667 | 13131 | 43635 | 74139, 104643, 135147, 165651, 196155 |
| 6116 | AD014361 | 6116 | 36620 | 67124, 97628, 128132, 158636, 189140 | 13132 | ALA08668 | 13132 | 43636 | 74140, 104644, 135148, 165652, 196156 |
| 6117 | AD014362 | 6117 | 36621 | 67125, 97629, 128133, 158637, 189141 | 13133 | ALA08669 | 13133 | 43637 | 74141, 104645, 135149, 165653, 196157 |
| 6118 | AD021015 | 6118 | 36622 | 67126, 97630, 128134, 158638, 189142 | 13134 | ALA08670 | 13134 | 43638 | 74142, 104646, 135150, 165654, 196158 |
| 6119 | AD021026 | 6119 | 36623 | 67127, 97631, 128135, 158639, 189143 | 13135 | ALA08671 | 13135 | 43639 | 74143, 104647, 135151, 165655, 196159 |
| 6120 | AD021037 | 6120 | 36624 | 67128, 97632, 128136, 158640, 189144 | 13136 | ALA08672 | 13136 | 43640 | 74144, 104648, 135152, 165656, 196160 |
| 6121 | AD021048 | 6121 | 36625 | 67129, 97633, 128137, 158641, 189145 | 13137 | ALA08673 | 13137 | 43641 | 74145, 104649, 135153, 165657, 196161 |
| 6122 | AD025092 | 6122 | 36626 | 67130, 97634, 128138, 158642, 189146 | 13138 | ALA08674 | 13138 | 43642 | 74146, 104650, 135154, 165658, 196162 |
| 6123 | AD025112 | 6123 | 36627 | 67131, 97635, 128139, 158643, 189147 | 13139 | ALA08675 | 13139 | 43643 | 74147, 104651, 135155, 165659, 196163 |
| 6124 | AD025122 | 6124 | 36628 | 67132, 97636, 128140, 158644, 189148 | 13140 | ALA08676 | 13140 | 43644 | 74148, 104652, 135156, 165660, 196164 |
| 6125 | AD025132 | 6125 | 36629 | 67133, 97637, 128141, 158645, 189149 | 13141 | ALA08677 | 13141 | 43645 | 74149, 104653, 135157, 165661, 196165 |
| 6126 | AD025142 | 6126 | 36630 | 67134, 97638, 128142, 158646, 189150 | 13142 | ALA08678 | 13142 | 43646 | 74150, 104654, 135158, 165662, 196166 |
| 6127 | AD025152 | 6127 | 36631 | 67135, 97639, 128143, 158647, 189151 | 13143 | ALA08679 | 13143 | 43647 | 74151, 104655, 135159, 165663, 196167 |
| 6128 | AD025162 | 6128 | 36632 | 67136, 97640, 128144, 158648, 189152 | 13144 | ALA08680 | 13144 | 43648 | 74152, 104656, 135160, 165664, 196168 |
| 6129 | AD025172 | 6129 | 36633 | 67137, 97641, 128145, 158649, 189153 | 13145 | ALA08681 | 13145 | 43649 | 74153, 104657, 135161, 165665, 196169 |
| 6130 | AD025182 | 6130 | 36634 | 67138, 97642, 128146, 158650, 189154 | 13146 | ALA08682 | 13146 | 43650 | 74154, 104658, 135162, 165666, 196170 |
| 6131 | AD025192 | 6131 | 36635 | 67139, 97643, 128147, 158651, 189155 | 13147 | ALA08683 | 13147 | 43651 | 74155, 104659, 135163, 165667, 196171 |

FIG. 1 continued

| | | | | | | | | | |
|---|---|---|---|---|---|---|---|---|---|
| 6132 | AD025202 | 6132 | 36636 | 67140, 97644, 128148, 158652, 189156 | 13148 | ALA08684 | 13148 | 43652 | 74156, 104660, 135164, 165668, 196172 |
| 6133 | AD025212 | 6133 | 36637 | 67141, 97645, 128149, 158653, 189157 | 13149 | ALA08686 | 13149 | 43653 | 74157, 104661, 135165, 165669, 196173 |
| 6134 | AD025222 | 6134 | 36638 | 67142, 97646, 128150, 158654, 189158 | 13150 | ALA08687 | 13150 | 43654 | 74158, 104662, 135166, 165670, 196174 |
| 6135 | AD025232 | 6135 | 36639 | 67143, 97647, 128151, 158655, 189159 | 13151 | ALA08688 | 13151 | 43655 | 74159, 104663, 135167, 165671, 196175 |
| 6136 | AD025242 | 6136 | 36640 | 67144, 97648, 128152, 158656, 189160 | 13152 | ALE31612 | 13152 | 43656 | 74160, 104664, 135168, 165672, 196176 |
| 6137 | AD025252 | 6137 | 36641 | 67145, 97649, 128153, 158657, 189161 | 13153 | ALE31613 | 13153 | 43657 | 74161, 104665, 135169, 165673, 196177 |
| 6138 | AD025262 | 6138 | 36642 | 67146, 97650, 128154, 158658, 189162 | 13154 | ALE31614 | 13154 | 43658 | 74162, 104666, 135170, 165674, 196178 |
| 6139 | AD025272 | 6139 | 36643 | 67147, 97651, 128155, 158659, 189163 | 13155 | ALE31615 | 13155 | 43659 | 74163, 104667, 135171, 165675, 196179 |
| 6140 | AD025282 | 6140 | 36644 | 67148, 97652, 128156, 158660, 189164 | 13156 | ALE31616 | 13156 | 43660 | 74164, 104668, 135172, 165676, 196180 |
| 6141 | AD027622 | 6141 | 36645 | 67149, 97653, 128157, 158661, 189165 | 13157 | ALE31617 | 13157 | 43661 | 74165, 104669, 135173, 165677, 196181 |
| 6142 | AD029887 | 6142 | 36646 | 67150, 97654, 128158, 158662, 189166 | 13158 | ALE31618 | 13158 | 43662 | 74166, 104670, 135174, 165678, 196182 |
| 6143 | AD029888 | 6143 | 36647 | 67151, 97655, 128159, 158663, 189167 | 13159 | ALE31619 | 13159 | 43663 | 74167, 104671, 135175, 165679, 196183 |
| 6144 | AD029889 | 6144 | 36648 | 67152, 97656, 128160, 158664, 189168 | 13160 | ALE31620 | 13160 | 43664 | 74168, 104672, 135176, 165680, 196184 |
| 6145 | AD029890 | 6145 | 36649 | 67153, 97657, 128161, 158665, 189169 | 13161 | ALE31622 | 13161 | 43665 | 74169, 104673, 135177, 165681, 196185 |
| 6146 | AD029891 | 6146 | 36650 | 67154, 97658, 128162, 158666, 189170 | 13162 | ALE31623 | 13162 | 43666 | 74170, 104674, 135178, 165682, 196186 |
| 6147 | AD029892 | 6147 | 36651 | 67155, 97659, 128163, 158667, 189171 | 13163 | ALE31625 | 13163 | 43667 | 74171, 104675, 135179, 165683, 196187 |
| 6148 | AD029893 | 6148 | 36652 | 67156, 97660, 128164, 158668, 189172 | 13164 | ALE31626 | 13164 | 43668 | 74172, 104676, 135180, 165684, 196188 |
| 6149 | AD029894 | 6149 | 36653 | 67157, 97661, 128165, 158669, 189173 | 13165 | ALE31627 | 13165 | 43669 | 74173, 104677, 135181, 165685, 196189 |

FIG. 1 continued

| | | | | | | | | | |
|---|---|---|---|---|---|---|---|---|---|
| 6150 | AD029895 | 6150 | 36654 | 67158, 97662, 128166, 158670, 189174 | 13166 | ALE31628 | 13166 | 43670 | 74174, 104678, 135182, 165686, 196190 |
| 6151 | AD029897 | 6151 | 36655 | 67159, 97663, 128167, 158671, 189175 | 13167 | ALE31629 | 13167 | 43671 | 74175, 104679, 135183, 165687, 196191 |
| 6152 | AD029898 | 6152 | 36656 | 67160, 97664, 128168, 158672, 189176 | 13168 | ALE31632 | 13168 | 43672 | 74176, 104680, 135184, 165688, 196192 |
| 6153 | AD029899 | 6153 | 36657 | 67161, 97665, 128169, 158673, 189177 | 13169 | ALE31634 | 13169 | 43673 | 74177, 104681, 135185, 165689, 196193 |
| 6154 | AD029900 | 6154 | 36658 | 67162, 97666, 128170, 158674, 189178 | 13170 | ALE31635 | 13170 | 43674 | 74178, 104682, 135186, 165690, 196194 |
| 6155 | AD029901 | 6155 | 36659 | 67163, 97667, 128171, 158675, 189179 | 13171 | ALE31636 | 13171 | 43675 | 74179, 104683, 135187, 165691, 196195 |
| 6156 | AD029902 | 6156 | 36660 | 67164, 97668, 128172, 158676, 189180 | 13172 | ALE31638 | 13172 | 43676 | 74180, 104684, 135188, 165692, 196196 |
| 6157 | AD029903 | 6157 | 36661 | 67165, 97669, 128173, 158677, 189181 | 13173 | ALE31639 | 13173 | 43677 | 74181, 104685, 135189, 165693, 196197 |
| 6158 | AD029904 | 6158 | 36662 | 67166, 97670, 128174, 158678, 189182 | 13174 | ALE31640 | 13174 | 43678 | 74182, 104686, 135190, 165694, 196198 |
| 6159 | AD029905 | 6159 | 36663 | 67167, 97671, 128175, 158679, 189183 | 13175 | ALE31641 | 13175 | 43679 | 74183, 104687, 135191, 165695, 196199 |
| 6160 | AD029906 | 6160 | 36664 | 67168, 97672, 128176, 158680, 189184 | 13176 | ALE31642 | 13176 | 43680 | 74184, 104688, 135192, 165696, 196200 |
| 6161 | AD029907 | 6161 | 36665 | 67169, 97673, 128177, 158681, 189185 | 13177 | ALE31643 | 13177 | 43681 | 74185, 104689, 135193, 165697, 196201 |
| 6162 | AD029908 | 6162 | 36666 | 67170, 97674, 128178, 158682, 189186 | 13178 | ALE31644 | 13178 | 43682 | 74186, 104690, 135194, 165698, 196202 |
| 6163 | AD029909 | 6163 | 36667 | 67171, 97675, 128179, 158683, 189187 | 13179 | ALE31645 | 13179 | 43683 | 74187, 104691, 135195, 165699, 196203 |
| 6164 | AD029910 | 6164 | 36668 | 67172, 97676, 128180, 158684, 189188 | 13180 | ALE31646 | 13180 | 43684 | 74188, 104692, 135196, 165700, 196204 |
| 6165 | AD030407 | 6165 | 36669 | 67173, 97677, 128181, 158685, 189189 | 13181 | ALE31647 | 13181 | 43685 | 74189, 104693, 135197, 165701, 196205 |
| 6166 | AD030417 | 6166 | 36670 | 67174, 97678, 128182, 158686, 189190 | 13182 | ALE31648 | 13182 | 43686 | 74190, 104694, 135198, 165702, 196206 |
| 6167 | AD033202 | 6167 | 36671 | 67175, 97679, 128183, 158687, 189191 | 13183 | ALE31649 | 13183 | 43687 | 74191, 104695, 135199, 165703, 196207 |

FIG. 1 continued

| | | | | | | | | | |
|---|---|---|---|---|---|---|---|---|---|
| 6168 | AD033240 | 6168 | 36672 | 67176, 97680, 128184, 158688, 189192 | 13184 | ALE31650 | 13184 | 43688 | 74192, 104696, 135200, 165704, 196208 |
| 6169 | AD033247 | 6169 | 36673 | 67177, 97681, 128185, 158689, 189193 | 13185 | ALE31652 | 13185 | 43689 | 74193, 104697, 135201, 165705, 196209 |
| 6170 | AD033254 | 6170 | 36674 | 67178, 97682, 128186, 158690, 189194 | 13186 | ALE31653 | 13186 | 43690 | 74194, 104698, 135202, 165706, 196210 |
| 6171 | AD033261 | 6171 | 36675 | 67179, 97683, 128187, 158691, 189195 | 13187 | ALE31654 | 13187 | 43691 | 74195, 104699, 135203, 165707, 196211 |
| 6172 | AD033269 | 6172 | 36676 | 67180, 97684, 128188, 158692, 189196 | 13188 | ALE31655 | 13188 | 43692 | 74196, 104700, 135204, 165708, 196212 |
| 6173 | AD033277 | 6173 | 36677 | 67181, 97685, 128189, 158693, 189197 | 13189 | ALE31656 | 13189 | 43693 | 74197, 104701, 135205, 165709, 196213 |
| 6174 | AD033285 | 6174 | 36678 | 67182, 97686, 128190, 158694, 189198 | 13190 | ALE31657 | 13190 | 43694 | 74198, 104702, 135206, 165710, 196214 |
| 6175 | AD033293 | 6175 | 36679 | 67183, 97687, 128191, 158695, 189199 | 13191 | ALE31658 | 13191 | 43695 | 74199, 104703, 135207, 165711, 196215 |
| 6176 | AD033307 | 6176 | 36680 | 67184, 97688, 128192, 158696, 189200 | 13192 | ALE31659 | 13192 | 43696 | 74200, 104704, 135208, 165712, 196216 |
| 6177 | AD033313 | 6177 | 36681 | 67185, 97689, 128193, 158697, 189201 | 13193 | ALE31660 | 13193 | 43697 | 74201, 104705, 135209, 165713, 196217 |
| 6178 | AD033329 | 6178 | 36682 | 67186, 97690, 128194, 158698, 189202 | 13194 | ALE31661 | 13194 | 43698 | 74202, 104706, 135210, 165714, 196218 |
| 6179 | AD033337 | 6179 | 36683 | 67187, 97691, 128195, 158699, 189203 | 13195 | ALE31662 | 13195 | 43699 | 74203, 104707, 135211, 165715, 196219 |
| 6180 | AD033345 | 6180 | 36684 | 67188, 97692, 128196, 158700, 189204 | 13196 | ALE31663 | 13196 | 43700 | 74204, 104708, 135212, 165716, 196220 |
| 6181 | AD033352 | 6181 | 36685 | 67189, 97693, 128197, 158701, 189205 | 13197 | ALE31666 | 13197 | 43701 | 74205, 104709, 135213, 165717, 196221 |
| 6182 | AD033360 | 6182 | 36686 | 67190, 97694, 128198, 158702, 189206 | 13198 | ALE31667 | 13198 | 43702 | 74206, 104710, 135214, 165718, 196222 |
| 6183 | AD033368 | 6183 | 36687 | 67191, 97695, 128199, 158703, 189207 | 13199 | ALE31668 | 13199 | 43703 | 74207, 104711, 135215, 165719, 196223 |
| 6184 | AD033376 | 6184 | 36688 | 67192, 97696, 128200, 158704, 189208 | 13200 | ALE31669 | 13200 | 43704 | 74208, 104712, 135216, 165720, 196224 |
| 6185 | AD033384 | 6185 | 36689 | 67193, 97697, 128201, 158705, 189209 | 13201 | ALE31670 | 13201 | 43705 | 74209, 104713, 135217, 165721, 196225 |

FIG. 1 continued

| | | | | | | | | | |
|---|---|---|---|---|---|---|---|---|---|
| 6186 | ADO33391 | 6186 | 36690 | 67194, 97698, 128202, 158706, 189210 | 13202 | ALE31671 | 13202 | 43706 | 74210, 104714, 135218, 165722, 196226 |
| 6187 | ADO79917 | 6187 | 36691 | 67195, 97699, 128203, 158707, 189211 | 13203 | ALE31672 | 13203 | 43707 | 74211, 104715, 135219, 165723, 196227 |
| 6188 | ADO79923 | 6188 | 36692 | 67196, 97700, 128204, 158708, 189212 | 13204 | ALE31673 | 13204 | 43708 | 74212, 104716, 135220, 165724, 196228 |
| 6189 | ADO79924 | 6189 | 36693 | 67197, 97701, 128205, 158709, 189213 | 13205 | ALE31674 | 13205 | 43709 | 74213, 104717, 135221, 165725, 196229 |
| 6190 | ADO79925 | 6190 | 36694 | 67198, 97702, 128206, 158710, 189214 | 13206 | ALE31675 | 13206 | 43710 | 74214, 104718, 135222, 165726, 196230 |
| 6191 | ADO79926 | 6191 | 36695 | 67199, 97703, 128207, 158711, 189215 | 13207 | ALE31676 | 13207 | 43711 | 74215, 104719, 135223, 165727, 196231 |
| 6192 | ADO79927 | 6192 | 36696 | 67200, 97704, 128208, 158712, 189216 | 13208 | ALE31677 | 13208 | 43712 | 74216, 104720, 135224, 165728, 196232 |
| 6193 | ADO79928 | 6193 | 36697 | 67201, 97705, 128209, 158713, 189217 | 13209 | ALE31678 | 13209 | 43713 | 74217, 104721, 135225, 165729, 196233 |
| 6194 | ADO79929 | 6194 | 36698 | 67202, 97706, 128210, 158714, 189218 | 13210 | ALE31679 | 13210 | 43714 | 74218, 104722, 135226, 165730, 196234 |
| 6195 | ADO79930 | 6195 | 36699 | 67203, 97707, 128211, 158715, 189219 | 13211 | ALE31680 | 13211 | 43715 | 74219, 104723, 135227, 165731, 196235 |
| 6196 | ADO84715 | 6196 | 36700 | 67204, 97708, 128212, 158716, 189220 | 13212 | ALE31681 | 13212 | 43716 | 74220, 104724, 135228, 165732, 196236 |
| 6197 | ADP95341 | 6197 | 36701 | 67205, 97709, 128213, 158717, 189221 | 13213 | ALE31682 | 13213 | 43717 | 74221, 104725, 135229, 165733, 196237 |
| 6198 | ADP95351 | 6198 | 36702 | 67206, 97710, 128214, 158718, 189222 | 13214 | ALE31683 | 13214 | 43718 | 74222, 104726, 135230, 165734, 196238 |
| 6199 | ADP95361 | 6199 | 36703 | 67207, 97711, 128215, 158719, 189223 | 13215 | ALE31684 | 13215 | 43719 | 74223, 104727, 135231, 165735, 196239 |
| 6200 | ADP95371 | 6200 | 36704 | 67208, 97712, 128216, 158720, 189224 | 13216 | ALE31685 | 13216 | 43720 | 74224, 104728, 135232, 165736, 196240 |
| 6201 | ADP95381 | 6201 | 36705 | 67209, 97713, 128217, 158721, 189225 | 13217 | ALE31686 | 13217 | 43721 | 74225, 104729, 135233, 165737, 196241 |
| 6202 | ADP95391 | 6202 | 36706 | 67210, 97714, 128218, 158722, 189226 | 13218 | ALE31687 | 13218 | 43722 | 74226, 104730, 135234, 165738, 196242 |
| 6203 | ADQ28007 | 6203 | 36707 | 67211, 97715, 128219, 158723, 189227 | 13219 | ALE31688 | 13219 | 43723 | 74227, 104731, 135235, 165739, 196243 |

FIG. 1 continued

| | | | | | | | | | |
|---|---|---|---|---|---|---|---|---|---|
| 6204 | ADQ28008 | 6204 | 36708 | 67212, 97716, 128220, 158724, 189228 | 13220 | ALE31689 | 13220 | 43724 | 74228, 104732, 135236, 165740, 196244 |
| 6205 | ADQ28009 | 6205 | 36709 | 67213, 97717, 128221, 158725, 189229 | 13221 | ALE31690 | 13221 | 43725 | 74229, 104733, 135237, 165741, 196245 |
| 6206 | ADQ28010 | 6206 | 36710 | 67214, 97718, 128222, 158726, 189230 | 13222 | ALE31691 | 13222 | 43726 | 74230, 104734, 135238, 165742, 196246 |
| 6207 | ADQ28011 | 6207 | 36711 | 67215, 97719, 128223, 158727, 189231 | 13223 | ALE31692 | 13223 | 43727 | 74231, 104735, 135239, 165743, 196247 |
| 6208 | ADQ28012 | 6208 | 36712 | 67216, 97720, 128224, 158728, 189232 | 13224 | ALE31693 | 13224 | 43728 | 74232, 104736, 135240, 165744, 196248 |
| 6209 | ADQ28013 | 6209 | 36713 | 67217, 97721, 128225, 158729, 189233 | 13225 | ALE31694 | 13225 | 43729 | 74233, 104737, 135241, 165745, 196249 |
| 6210 | ADQ28014 | 6210 | 36714 | 67218, 97722, 128226, 158730, 189234 | 13226 | ALE31695 | 13226 | 43730 | 74234, 104738, 135242, 165746, 196250 |
| 6211 | ADQ28015 | 6211 | 36715 | 67219, 97723, 128227, 158731, 189235 | 13227 | ALE31696 | 13227 | 43731 | 74235, 104739, 135243, 165747, 196251 |
| 6212 | ADQ28016 | 6212 | 36716 | 67220, 97724, 128228, 158732, 189236 | 13228 | ALE31697 | 13228 | 43732 | 74236, 104740, 135244, 165748, 196252 |
| 6213 | ADQ28017 | 6213 | 36717 | 67221, 97725, 128229, 158733, 189237 | 13229 | ALE31698 | 13229 | 43733 | 74237, 104741, 135245, 165749, 196253 |
| 6214 | ADQ28018 | 6214 | 36718 | 67222, 97726, 128230, 158734, 189238 | 13230 | ALE31699 | 13230 | 43734 | 74238, 104742, 135246, 165750, 196254 |
| 6215 | ADQ28019 | 6215 | 36719 | 67223, 97727, 128231, 158735, 189239 | 13231 | ALE31700 | 13231 | 43735 | 74239, 104743, 135247, 165751, 196255 |
| 6216 | ADQ28020 | 6216 | 36720 | 67224, 97728, 128232, 158736, 189240 | 13232 | ALE31701 | 13232 | 43736 | 74240, 104744, 135248, 165752, 196256 |
| 6217 | ADQ28021 | 6217 | 36721 | 67225, 97729, 128233, 158737, 189241 | 13233 | ALE31702 | 13233 | 43737 | 74241, 104745, 135249, 165753, 196257 |
| 6218 | ADQ28022 | 6218 | 36722 | 67226, 97730, 128234, 158738, 189242 | 13234 | ALE31703 | 13234 | 43738 | 74242, 104746, 135250, 165754, 196258 |
| 6219 | ADQ28023 | 6219 | 36723 | 67227, 97731, 128235, 158739, 189243 | 13235 | ALE31704 | 13235 | 43739 | 74243, 104747, 135251, 165755, 196259 |
| 6220 | ADQ28024 | 6220 | 36724 | 67228, 97732, 128236, 158740, 189244 | 13236 | ALE31705 | 13236 | 43740 | 74244, 104748, 135252, 165756, 196260 |
| 6221 | ADQ28025 | 6221 | 36725 | 67229, 97733, 128237, 158741, 189245 | 13237 | ALE31706 | 13237 | 43741 | 74245, 104749, 135253, 165757, 196261 |

FIG. 1 continued

| | | | | | | | | | |
|---|---|---|---|---|---|---|---|---|---|
| 6222 | ADQ28028 | 6222 | 36726 | 67230, 97734, 128238, 158742, 189246 | 13238 | ALE31707 | 13238 | 43742 | 74246, 104750, 135254, 165758, 196262 |
| 6223 | ADQ28029 | 6223 | 36727 | 67231, 97735, 128239, 158743, 189247 | 13239 | ALE31708 | 13239 | 43743 | 74247, 104751, 135255, 165759, 196263 |
| 6224 | ADQ28030 | 6224 | 36728 | 67232, 97736, 128240, 158744, 189248 | 13240 | ALE31709 | 13240 | 43744 | 74248, 104752, 135256, 165760, 196264 |
| 6225 | ADQ28031 | 6225 | 36729 | 67233, 97737, 128241, 158745, 189249 | 13241 | ALE31710 | 13241 | 43745 | 74249, 104753, 135257, 165761, 196265 |
| 6226 | ADQ28032 | 6226 | 36730 | 67234, 97738, 128242, 158746, 189250 | 13242 | ALE31711 | 13242 | 43746 | 74250, 104754, 135258, 165762, 196266 |
| 6227 | ADQ28034 | 6227 | 36731 | 67235, 97739, 128243, 158747, 189251 | 13243 | ALE31712 | 13243 | 43747 | 74251, 104755, 135259, 165763, 196267 |
| 6228 | ADQ28035 | 6228 | 36732 | 67236, 97740, 128244, 158748, 189252 | 13244 | ALE31713 | 13244 | 43748 | 74252, 104756, 135260, 165764, 196268 |
| 6229 | ADQ28036 | 6229 | 36733 | 67237, 97741, 128245, 158749, 189253 | 13245 | ALE31714 | 13245 | 43749 | 74253, 104757, 135261, 165765, 196269 |
| 6230 | ADQ28037 | 6230 | 36734 | 67238, 97742, 128246, 158750, 189254 | 13246 | ALE31715 | 13246 | 43750 | 74254, 104758, 135262, 165766, 196270 |
| 6231 | ADQ28038 | 6231 | 36735 | 67239, 97743, 128247, 158751, 189255 | 13247 | ALE31716 | 13247 | 43751 | 74255, 104759, 135263, 165767, 196271 |
| 6232 | ADQ28039 | 6232 | 36736 | 67240, 97744, 128248, 158752, 189256 | 13248 | ALE31717 | 13248 | 43752 | 74256, 104760, 135264, 165768, 196272 |
| 6233 | ADQ28040 | 6233 | 36737 | 67241, 97745, 128249, 158753, 189257 | 13249 | ALE31718 | 13249 | 43753 | 74257, 104761, 135265, 165769, 196273 |
| 6234 | ADQ28041 | 6234 | 36738 | 67242, 97746, 128250, 158754, 189258 | 13250 | ALE31719 | 13250 | 43754 | 74258, 104762, 135266, 165770, 196274 |
| 6235 | ADQ28043 | 6235 | 36739 | 67243, 97747, 128251, 158755, 189259 | 13251 | ALE31720 | 13251 | 43755 | 74259, 104763, 135267, 165771, 196275 |
| 6236 | ADQ28044 | 6236 | 36740 | 67244, 97748, 128252, 158756, 189260 | 13252 | ALE31721 | 13252 | 43756 | 74260, 104764, 135268, 165772, 196276 |
| 6237 | ADQ28045 | 6237 | 36741 | 67245, 97749, 128253, 158757, 189261 | 13253 | ALE31722 | 13253 | 43757 | 74261, 104765, 135269, 165773, 196277 |
| 6238 | ADQ28047 | 6238 | 36742 | 67246, 97750, 128254, 158758, 189262 | 13254 | ALE31723 | 13254 | 43758 | 74262, 104766, 135270, 165774, 196278 |
| 6239 | ADQ28048 | 6239 | 36743 | 67247, 97751, 128255, 158759, 189263 | 13255 | ALE31724 | 13255 | 43759 | 74263, 104767, 135271, 165775, 196279 |

FIG. 1 continued

| | | | | | | | | | |
|---|---|---|---|---|---|---|---|---|---|
| 6240 | ADQ28049 | 6240 | 36744 | 67248, 97752, 128256, 158760, 189264 | 13256 | ALE31725 | 13256 | 43760 | 74264, 104768, 135272, 165776, 196280 |
| 6241 | ADQ28050 | 6241 | 36745 | 67249, 97753, 128257, 158761, 189265 | 13257 | ALE31726 | 13257 | 43761 | 74265, 104769, 135273, 165777, 196281 |
| 6242 | ADQ28051 | 6242 | 36746 | 67250, 97754, 128258, 158762, 189266 | 13258 | ALE31727 | 13258 | 43762 | 74266, 104770, 135274, 165778, 196282 |
| 6243 | ADQ28053 | 6243 | 36747 | 67251, 97755, 128259, 158763, 189267 | 13259 | ALE31728 | 13259 | 43763 | 74267, 104771, 135275, 165779, 196283 |
| 6244 | ADQ28055 | 6244 | 36748 | 67252, 97756, 128260, 158764, 189268 | 13260 | ALE31729 | 13260 | 43764 | 74268, 104772, 135276, 165780, 196284 |
| 6245 | ADQ28056 | 6245 | 36749 | 67253, 97757, 128261, 158765, 189269 | 13261 | ALE31730 | 13261 | 43765 | 74269, 104773, 135277, 165781, 196285 |
| 6246 | ADQ28057 | 6246 | 36750 | 67254, 97758, 128262, 158766, 189270 | 13262 | ALE31731 | 13262 | 43766 | 74270, 104774, 135278, 165782, 196286 |
| 6247 | ADQ28058 | 6247 | 36751 | 67255, 97759, 128263, 158767, 189271 | 13263 | ALE31732 | 13263 | 43767 | 74271, 104775, 135279, 165783, 196287 |
| 6248 | ADQ28059 | 6248 | 36752 | 67256, 97760, 128264, 158768, 189272 | 13264 | ALE31733 | 13264 | 43768 | 74272, 104776, 135280, 165784, 196288 |
| 6249 | ADQ28060 | 6249 | 36753 | 67257, 97761, 128265, 158769, 189273 | 13265 | ALE31734 | 13265 | 43769 | 74273, 104777, 135281, 165785, 196289 |
| 6250 | ADQ28061 | 6250 | 36754 | 67258, 97762, 128266, 158770, 189274 | 13266 | ALE31735 | 13266 | 43770 | 74274, 104778, 135282, 165786, 196290 |
| 6251 | ADQ28063 | 6251 | 36755 | 67259, 97763, 128267, 158771, 189275 | 13267 | ALE31736 | 13267 | 43771 | 74275, 104779, 135283, 165787, 196291 |
| 6252 | ADQ28064 | 6252 | 36756 | 67260, 97764, 128268, 158772, 189276 | 13268 | ALE31737 | 13268 | 43772 | 74276, 104780, 135284, 165788, 196292 |
| 6253 | ADQ28065 | 6253 | 36757 | 67261, 97765, 128269, 158773, 189277 | 13269 | ALE31738 | 13269 | 43773 | 74277, 104781, 135285, 165789, 196293 |
| 6254 | ADQ28066 | 6254 | 36758 | 67262, 97766, 128270, 158774, 189278 | 13270 | ALE31739 | 13270 | 43774 | 74278, 104782, 135286, 165790, 196294 |
| 6255 | ADQ28067 | 6255 | 36759 | 67263, 97767, 128271, 158775, 189279 | 13271 | ALE31741 | 13271 | 43775 | 74279, 104783, 135287, 165791, 196295 |
| 6256 | ADQ28068 | 6256 | 36760 | 67264, 97768, 128272, 158776, 189280 | 13272 | ALE31742 | 13272 | 43776 | 74280, 104784, 135288, 165792, 196296 |
| 6257 | ADQ28069 | 6257 | 36761 | 67265, 97769, 128273, 158777, 189281 | 13273 | ALE31743 | 13273 | 43777 | 74281, 104785, 135289, 165793, 196297 |

FIG. 1 continued

| | | | | | | | | | |
|---|---|---|---|---|---|---|---|---|---|
| 6258 | ADQ28070 | 6258 | 36762 | 67266, 97770, 128274, 158778, 189282 | 13274 | ALE31744 | 13274 | 43778 | 74282, 104786, 135290, 165794, 196298 |
| 6259 | ADQ28071 | 6259 | 36763 | 67267, 97771, 128275, 158779, 189283 | 13275 | ALE31745 | 13275 | 43779 | 74283, 104787, 135291, 165795, 196299 |
| 6260 | ADR32361 | 6260 | 36764 | 67268, 97772, 128276, 158780, 189284 | 13276 | ALE31747 | 13276 | 43780 | 74284, 104788, 135292, 165796, 196300 |
| 6261 | ADT78887 | 6261 | 36765 | 67269, 97773, 128277, 158781, 189285 | 13277 | ALE31748 | 13277 | 43781 | 74285, 104789, 135293, 165797, 196301 |
| 6262 | ADT78908 | 6262 | 36766 | 67270, 97774, 128278, 158782, 189286 | 13278 | ALE31749 | 13278 | 43782 | 74286, 104790, 135294, 165798, 196302 |
| 6263 | ADT78929 | 6263 | 36767 | 67271, 97775, 128279, 158783, 189287 | 13279 | ALE31750 | 13279 | 43783 | 74287, 104791, 135295, 165799, 196303 |
| 6264 | ADT78936 | 6264 | 36768 | 67272, 97776, 128280, 158784, 189288 | 13280 | ALE31751 | 13280 | 43784 | 74288, 104792, 135296, 165800, 196304 |
| 6265 | ADT78961 | 6265 | 36769 | 67273, 97777, 128281, 158785, 189289 | 13281 | ALE31752 | 13281 | 43785 | 74289, 104793, 135297, 165801, 196305 |
| 6266 | ADT78971 | 6266 | 36770 | 67274, 97778, 128282, 158786, 189290 | 13282 | ALE31753 | 13282 | 43786 | 74290, 104794, 135298, 165802, 196306 |
| 6267 | ADT79010 | 6267 | 36771 | 67275, 97779, 128283, 158787, 189291 | 13283 | ALE31754 | 13283 | 43787 | 74291, 104795, 135299, 165803, 196307 |
| 6268 | ADT79030 | 6268 | 36772 | 67276, 97780, 128284, 158788, 189292 | 13284 | ALE31755 | 13284 | 43788 | 74292, 104796, 135300, 165804, 196308 |
| 6269 | ADT79050 | 6269 | 36773 | 67277, 97781, 128285, 158789, 189293 | 13285 | ALE31756 | 13285 | 43789 | 74293, 104797, 135301, 165805, 196309 |
| 6270 | ADT79108 | 6270 | 36774 | 67278, 97782, 128286, 158790, 189294 | 13286 | ALE31757 | 13286 | 43790 | 74294, 104798, 135302, 165806, 196310 |
| 6271 | ADT79119 | 6271 | 36775 | 67279, 97783, 128287, 158791, 189295 | 13287 | ALE31758 | 13287 | 43791 | 74295, 104799, 135303, 165807, 196311 |
| 6272 | ADT79129 | 6272 | 36776 | 67280, 97784, 128288, 158792, 189296 | 13288 | ALE31759 | 13288 | 43792 | 74296, 104800, 135304, 165808, 196312 |
| 6273 | ADT79232 | 6273 | 36777 | 67281, 97785, 128289, 158793, 189297 | 13289 | ALE31760 | 13289 | 43793 | 74297, 104801, 135305, 165809, 196313 |
| 6274 | ADT79242 | 6274 | 36778 | 67282, 97786, 128290, 158794, 189298 | 13290 | ALE31761 | 13290 | 43794 | 74298, 104802, 135306, 165810, 196314 |
| 6275 | ADT91182 | 6275 | 36779 | 67283, 97787, 128291, 158795, 189299 | 13291 | ALE31762 | 13291 | 43795 | 74299, 104803, 135307, 165811, 196315 |

FIG. 1 continued

| | | | | | | | | | |
|---|---|---|---|---|---|---|---|---|---|
| 6276 | ADU20561 | 6276 | 36780 | 67284, 97788, 128292, 158796, 189300 | 13292 | ALE31763 | 13292 | 43796 | 74300, 104804, 135308, 165812, 196316 |
| 6277 | ADU20562 | 6277 | 36781 | 67285, 97789, 128293, 158797, 189301 | 13293 | ALE31764 | 13293 | 43797 | 74301, 104805, 135309, 165813, 196317 |
| 6278 | ADU25478 | 6278 | 36782 | 67286, 97790, 128294, 158798, 189302 | 13294 | ALE31765 | 13294 | 43798 | 74302, 104806, 135310, 165814, 196318 |
| 6279 | ADU59558 | 6279 | 36783 | 67287, 97791, 128295, 158799, 189303 | 13295 | ALE31774 | 13295 | 43799 | 74303, 104807, 135311, 165815, 196319 |
| 6280 | ADU59579 | 6280 | 36784 | 67288, 97792, 128296, 158800, 189304 | 13296 | ALE31775 | 13296 | 43800 | 74304, 104808, 135312, 165816, 196320 |
| 6281 | ADU59590 | 6281 | 36785 | 67289, 97793, 128297, 158801, 189305 | 13297 | ALE31776 | 13297 | 43801 | 74305, 104809, 135313, 165817, 196321 |
| 6282 | ADU59601 | 6282 | 36786 | 67290, 97794, 128298, 158802, 189306 | 13298 | ALE31777 | 13298 | 43802 | 74306, 104810, 135314, 165818, 196322 |
| 6283 | ADU59612 | 6283 | 36787 | 67291, 97795, 128299, 158803, 189307 | 13299 | ALE31778 | 13299 | 43803 | 74307, 104811, 135315, 165819, 196323 |
| 6284 | ADU59768 | 6284 | 36788 | 67292, 97796, 128300, 158804, 189308 | 13300 | ALE31779 | 13300 | 43804 | 74308, 104812, 135316, 165820, 196324 |
| 6285 | ADU59769 | 6285 | 36789 | 67293, 97797, 128301, 158805, 189309 | 13301 | ALE31780 | 13301 | 43805 | 74309, 104813, 135317, 165821, 196325 |
| 6286 | ADU59771 | 6286 | 36790 | 67294, 97798, 128302, 158806, 189310 | 13302 | ALE31781 | 13302 | 43806 | 74310, 104814, 135318, 165822, 196326 |
| 6287 | ADU59772 | 6287 | 36791 | 67295, 97799, 128303, 158807, 189311 | 13303 | ALE31782 | 13303 | 43807 | 74311, 104815, 135319, 165823, 196327 |
| 6288 | ADU59774 | 6288 | 36792 | 67296, 97800, 128304, 158808, 189312 | 13304 | ALE31783 | 13304 | 43808 | 74312, 104816, 135320, 165824, 196328 |
| 6289 | ADU59906 | 6289 | 36793 | 67297, 97801, 128305, 158809, 189313 | 13305 | ALE31784 | 13305 | 43809 | 74313, 104817, 135321, 165825, 196329 |
| 6290 | ADU59916 | 6290 | 36794 | 67298, 97802, 128306, 158810, 189314 | 13306 | ALE31785 | 13306 | 43810 | 74314, 104818, 135322, 165826, 196330 |
| 6291 | ADU76756 | 6291 | 36795 | 67299, 97803, 128307, 158811, 189315 | 13307 | ALE31786 | 13307 | 43811 | 74315, 104819, 135323, 165827, 196331 |
| 6292 | ADU76757 | 6292 | 36796 | 67300, 97804, 128308, 158812, 189316 | 13308 | ALE31787 | 13308 | 43812 | 74316, 104820, 135324, 165828, 196332 |
| 6293 | ADU76758 | 6293 | 36797 | 67301, 97805, 128309, 158813, 189317 | 13309 | ALE31788 | 13309 | 43813 | 74317, 104821, 135325, 165829, 196333 |

FIG. 1 continued

| | | | | | | | | | |
|---|---|---|---|---|---|---|---|---|---|
| 6294 | ADU76759 | 6294 | 36798 | 67302, 97806, 128310, 158814, 189318 | 13310 | ALE31789 | 13310 | 43814 | 74318, 104822, 135326, 165830, 196334 |
| 6295 | ADU76761 | 6295 | 36799 | 67303, 97807, 128311, 158815, 189319 | 13311 | ALE31790 | 13311 | 43815 | 74319, 104823, 135327, 165831, 196335 |
| 6296 | ADU76762 | 6296 | 36800 | 67304, 97808, 128312, 158816, 189320 | 13312 | ALE31791 | 13312 | 43816 | 74320, 104824, 135328, 165832, 196336 |
| 6297 | ADU76764 | 6297 | 36801 | 67305, 97809, 128313, 158817, 189321 | 13313 | ALE31792 | 13313 | 43817 | 74321, 104825, 135329, 165833, 196337 |
| 6298 | ADU76765 | 6298 | 36802 | 67306, 97810, 128314, 158818, 189322 | 13314 | ALE31793 | 13314 | 43818 | 74322, 104826, 135330, 165834, 196338 |
| 6299 | ADU76766 | 6299 | 36803 | 67307, 97811, 128315, 158819, 189323 | 13315 | ALE31794 | 13315 | 43819 | 74323, 104827, 135331, 165835, 196339 |
| 6300 | ADU76767 | 6300 | 36804 | 67308, 97812, 128316, 158820, 189324 | 13316 | ALE31795 | 13316 | 43820 | 74324, 104828, 135332, 165836, 196340 |
| 6301 | ADU76768 | 6301 | 36805 | 67309, 97813, 128317, 158821, 189325 | 13317 | ALE31796 | 13317 | 43821 | 74325, 104829, 135333, 165837, 196341 |
| 6302 | ADU76769 | 6302 | 36806 | 67310, 97814, 128318, 158822, 189326 | 13318 | ALE31797 | 13318 | 43822 | 74326, 104830, 135334, 165838, 196342 |
| 6303 | ADU76770 | 6303 | 36807 | 67311, 97815, 128319, 158823, 189327 | 13319 | ALE31798 | 13319 | 43823 | 74327, 104831, 135335, 165839, 196343 |
| 6304 | ADU76771 | 6304 | 36808 | 67312, 97816, 128320, 158824, 189328 | 13320 | ALE31799 | 13320 | 43824 | 74328, 104832, 135336, 165840, 196344 |
| 6305 | ADU76772 | 6305 | 36809 | 67313, 97817, 128321, 158825, 189329 | 13321 | ALE31800 | 13321 | 43825 | 74329, 104833, 135337, 165841, 196345 |
| 6306 | ADU76774 | 6306 | 36810 | 67314, 97818, 128322, 158826, 189330 | 13322 | ALE31801 | 13322 | 43826 | 74330, 104834, 135338, 165842, 196346 |
| 6307 | ADU76775 | 6307 | 36811 | 67315, 97819, 128323, 158827, 189331 | 13323 | ALE31802 | 13323 | 43827 | 74331, 104835, 135339, 165843, 196347 |
| 6308 | ADU76776 | 6308 | 36812 | 67316, 97820, 128324, 158828, 189332 | 13324 | ALE31803 | 13324 | 43828 | 74332, 104836, 135340, 165844, 196348 |
| 6309 | ADU76777 | 6309 | 36813 | 67317, 97821, 128325, 158829, 189333 | 13325 | ALE31805 | 13325 | 43829 | 74333, 104837, 135341, 165845, 196349 |
| 6310 | ADU76778 | 6310 | 36814 | 67318, 97822, 128326, 158830, 189334 | 13326 | ALE31806 | 13326 | 43830 | 74334, 104838, 135342, 165846, 196350 |
| 6311 | ADU76779 | 6311 | 36815 | 67319, 97823, 128327, 158831, 189335 | 13327 | ALE31807 | 13327 | 43831 | 74335, 104839, 135343, 165847, 196351 |

FIG. 1 continued

| | | | | | | | | | |
|---|---|---|---|---|---|---|---|---|---|
| 6312 | ADU76780 | 6312 | 36816 | 67320, 97824, 128328, 158832, 189336 | 13328 | ALE31808 | 13328 | 43832 | 74336, 104840, 135344, 165848, 196352 |
| 6313 | ADU76781 | 6313 | 36817 | 67321, 97825, 128329, 158833, 189337 | 13329 | ALE31810 | 13329 | 43833 | 74337, 104841, 135345, 165849, 196353 |
| 6314 | ADU76782 | 6314 | 36818 | 67322, 97826, 128330, 158834, 189338 | 13330 | ALE31812 | 13330 | 43834 | 74338, 104842, 135346, 165850, 196354 |
| 6315 | ADU76784 | 6315 | 36819 | 67323, 97827, 128331, 158835, 189339 | 13331 | ALE31814 | 13331 | 43835 | 74339, 104843, 135347, 165851, 196355 |
| 6316 | ADU76785 | 6316 | 36820 | 67324, 97828, 128332, 158836, 189340 | 13332 | ALE31815 | 13332 | 43836 | 74340, 104844, 135348, 165852, 196356 |
| 6317 | ADU76786 | 6317 | 36821 | 67325, 97829, 128333, 158837, 189341 | 13333 | ALE31818 | 13333 | 43837 | 74341, 104845, 135349, 165853, 196357 |
| 6318 | ADU76787 | 6318 | 36822 | 67326, 97830, 128334, 158838, 189342 | 13334 | ALE31819 | 13334 | 43838 | 74342, 104846, 135350, 165854, 196358 |
| 6319 | ADU76788 | 6319 | 36823 | 67327, 97831, 128335, 158839, 189343 | 13335 | ALE31820 | 13335 | 43839 | 74343, 104847, 135351, 165855, 196359 |
| 6320 | ADU76789 | 6320 | 36824 | 67328, 97832, 128336, 158840, 189344 | 13336 | ALE31821 | 13336 | 43840 | 74344, 104848, 135352, 165856, 196360 |
| 6321 | ADU76790 | 6321 | 36825 | 67329, 97833, 128337, 158841, 189345 | 13337 | ALE31822 | 13337 | 43841 | 74345, 104849, 135353, 165857, 196361 |
| 6322 | ADU76791 | 6322 | 36826 | 67330, 97834, 128338, 158842, 189346 | 13338 | ALE31823 | 13338 | 43842 | 74346, 104850, 135354, 165858, 196362 |
| 6323 | ADU76792 | 6323 | 36827 | 67331, 97835, 128339, 158843, 189347 | 13339 | ALE31824 | 13339 | 43843 | 74347, 104851, 135355, 165859, 196363 |
| 6324 | ADU76793 | 6324 | 36828 | 67332, 97836, 128340, 158844, 189348 | 13340 | ALE31825 | 13340 | 43844 | 74348, 104852, 135356, 165860, 196364 |
| 6325 | ADU85911 | 6325 | 36829 | 67333, 97837, 128341, 158845, 189349 | 13341 | ALE31826 | 13341 | 43845 | 74349, 104853, 135357, 165861, 196365 |
| 6326 | ADV17283 | 6326 | 36830 | 67334, 97838, 128342, 158846, 189350 | 13342 | ALE31827 | 13342 | 43846 | 74350, 104854, 135358, 165862, 196366 |
| 6327 | ADV17293 | 6327 | 36831 | 67335, 97839, 128343, 158847, 189351 | 13343 | ALE31828 | 13343 | 43847 | 74351, 104855, 135359, 165863, 196367 |
| 6328 | ADV17303 | 6328 | 36832 | 67336, 97840, 128344, 158848, 189352 | 13344 | ALE31829 | 13344 | 43848 | 74352, 104856, 135360, 165864, 196368 |
| 6329 | ADV17313 | 6329 | 36833 | 67337, 97841, 128345, 158849, 189353 | 13345 | ALE31830 | 13345 | 43849 | 74353, 104857, 135361, 165865, 196369 |

FIG. 1 continued

| | | | | | | | | | |
|---|---|---|---|---|---|---|---|---|---|
| 6330 | ADV17323 | 6330 | 36834 | 67338, 97842, 128346, 158850, 189354 | 13346 | ALE31832 | 13346 | 43850 | 74354, 104858, 135362, 165866, 196370 |
| 6331 | ADV17333 | 6331 | 36835 | 67339, 97843, 128347, 158851, 189355 | 13347 | ALE31833 | 13347 | 43851 | 74355, 104859, 135363, 165867, 196371 |
| 6332 | ADV19019 | 6332 | 36836 | 67340, 97844, 128348, 158852, 189356 | 13348 | ALE31834 | 13348 | 43852 | 74356, 104860, 135364, 165868, 196372 |
| 6333 | ADV41677 | 6333 | 36837 | 67341, 97845, 128349, 158853, 189357 | 13349 | ALE31835 | 13349 | 43853 | 74357, 104861, 135365, 165869, 196373 |
| 6334 | ADV58939 | 6334 | 36838 | 67342, 97846, 128350, 158854, 189358 | 13350 | ALE31836 | 13350 | 43854 | 74358, 104862, 135366, 165870, 196374 |
| 6335 | ADV69074 | 6335 | 36839 | 67343, 97847, 128351, 158855, 189359 | 13351 | ALE31837 | 13351 | 43855 | 74359, 104863, 135367, 165871, 196375 |
| 6336 | ADV69075 | 6336 | 36840 | 67344, 97848, 128352, 158856, 189360 | 13352 | ALE31838 | 13352 | 43856 | 74360, 104864, 135368, 165872, 196376 |
| 6337 | ADV69077 | 6337 | 36841 | 67345, 97849, 128353, 158857, 189361 | 13353 | ALE31839 | 13353 | 43857 | 74361, 104865, 135369, 165873, 196377 |
| 6338 | ADV69078 | 6338 | 36842 | 67346, 97850, 128354, 158858, 189362 | 13354 | ALE31840 | 13354 | 43858 | 74362, 104866, 135370, 165874, 196378 |
| 6339 | ADV69079 | 6339 | 36843 | 67347, 97851, 128355, 158859, 189363 | 13355 | ALE31842 | 13355 | 43859 | 74363, 104867, 135371, 165875, 196379 |
| 6340 | ADV69080 | 6340 | 36844 | 67348, 97852, 128356, 158860, 189364 | 13356 | ALE31843 | 13356 | 43860 | 74364, 104868, 135372, 165876, 196380 |
| 6341 | ADV69081 | 6341 | 36845 | 67349, 97853, 128357, 158861, 189365 | 13357 | ALE31844 | 13357 | 43861 | 74365, 104869, 135373, 165877, 196381 |
| 6342 | ADV69083 | 6342 | 36846 | 67350, 97854, 128358, 158862, 189366 | 13358 | ALE31846 | 13358 | 43862 | 74366, 104870, 135374, 165878, 196382 |
| 6343 | ADV69084 | 6343 | 36847 | 67351, 97855, 128359, 158863, 189367 | 13359 | ALE31847 | 13359 | 43863 | 74367, 104871, 135375, 165879, 196383 |
| 6344 | ADV69085 | 6344 | 36848 | 67352, 97856, 128360, 158864, 189368 | 13360 | ALE31848 | 13360 | 43864 | 74368, 104872, 135376, 165880, 196384 |
| 6345 | ADV69086 | 6345 | 36849 | 67353, 97857, 128361, 158865, 189369 | 13361 | ALE31850 | 13361 | 43865 | 74369, 104873, 135377, 165881, 196385 |
| 6346 | ADV69087 | 6346 | 36850 | 67354, 97858, 128362, 158866, 189370 | 13362 | ALE31851 | 13362 | 43866 | 74370, 104874, 135378, 165882, 196386 |
| 6347 | ADV69088 | 6347 | 36851 | 67355, 97859, 128363, 158867, 189371 | 13363 | ALE31852 | 13363 | 43867 | 74371, 104875, 135379, 165883, 196387 |

FIG. 1 continued

| | | | | | | | | | |
|---|---|---|---|---|---|---|---|---|---|
| 6348 | ADV69089 | 6348 | 36852 | 67356, 97860, 128364, 158868, 189372 | 13364 | ALE31853 | 13364 | 43868 | 74372, 104876, 135380, 165884, 196388 |
| 6349 | ADV69090 | 6349 | 36853 | 67357, 97861, 128365, 158869, 189373 | 13365 | ALE31854 | 13365 | 43869 | 74373, 104877, 135381, 165885, 196389 |
| 6350 | ADV69091 | 6350 | 36854 | 67358, 97862, 128366, 158870, 189374 | 13366 | ALE31855 | 13366 | 43870 | 74374, 104878, 135382, 165886, 196390 |
| 6351 | ADV69092 | 6351 | 36855 | 67359, 97863, 128367, 158871, 189375 | 13367 | ALE31856 | 13367 | 43871 | 74375, 104879, 135383, 165887, 196391 |
| 6352 | ADV69093 | 6352 | 36856 | 67360, 97864, 128368, 158872, 189376 | 13368 | ALE31857 | 13368 | 43872 | 74376, 104880, 135384, 165888, 196392 |
| 6353 | ADV69094 | 6353 | 36857 | 67361, 97865, 128369, 158873, 189377 | 13369 | ALE31858 | 13369 | 43873 | 74377, 104881, 135385, 165889, 196393 |
| 6354 | ADV69095 | 6354 | 36858 | 67362, 97866, 128370, 158874, 189378 | 13370 | ALE31859 | 13370 | 43874 | 74378, 104882, 135386, 165890, 196394 |
| 6355 | ADV69096 | 6355 | 36859 | 67363, 97867, 128371, 158875, 189379 | 13371 | ALE31860 | 13371 | 43875 | 74379, 104883, 135387, 165891, 196395 |
| 6356 | ADV69097 | 6356 | 36860 | 67364, 97868, 128372, 158876, 189380 | 13372 | ALE31861 | 13372 | 43876 | 74380, 104884, 135388, 165892, 196396 |
| 6357 | ADV69098 | 6357 | 36861 | 67365, 97869, 128373, 158877, 189381 | 13373 | ALE31862 | 13373 | 43877 | 74381, 104885, 135389, 165893, 196397 |
| 6358 | ADV69099 | 6358 | 36862 | 67366, 97870, 128374, 158878, 189382 | 13374 | ALE31863 | 13374 | 43878 | 74382, 104886, 135390, 165894, 196398 |
| 6359 | ADV69100 | 6359 | 36863 | 67367, 97871, 128375, 158879, 189383 | 13375 | ALE31865 | 13375 | 43879 | 74383, 104887, 135391, 165895, 196399 |
| 6360 | ADV69101 | 6360 | 36864 | 67368, 97872, 128376, 158880, 189384 | 13376 | ALE31866 | 13376 | 43880 | 74384, 104888, 135392, 165896, 196400 |
| 6361 | ADV69102 | 6361 | 36865 | 67369, 97873, 128377, 158881, 189385 | 13377 | ALE31867 | 13377 | 43881 | 74385, 104889, 135393, 165897, 196401 |
| 6362 | ADV69103 | 6362 | 36866 | 67370, 97874, 128378, 158882, 189386 | 13378 | ALE31868 | 13378 | 43882 | 74386, 104890, 135394, 165898, 196402 |
| 6363 | ADV69104 | 6363 | 36867 | 67371, 97875, 128379, 158883, 189387 | 13379 | ALE31869 | 13379 | 43883 | 74387, 104891, 135395, 165899, 196403 |
| 6364 | ADV69105 | 6364 | 36868 | 67372, 97876, 128380, 158884, 189388 | 13380 | ALE31870 | 13380 | 43884 | 74388, 104892, 135396, 165900, 196404 |
| 6365 | ADV69106 | 6365 | 36869 | 67373, 97877, 128381, 158885, 189389 | 13381 | ALE31871 | 13381 | 43885 | 74389, 104893, 135397, 165901, 196405 |

FIG. 1 continued

| | | | | | | | | | |
|---|---|---|---|---|---|---|---|---|---|
| 6366 | ADV69107 | 6366 | 36870 | 67374, 97878, 128382, 158886, 189390 | 13382 | ALE31872 | 13382 | 43886 | 74390, 104894, 135398, 165902, 196406 |
| 6367 | ADV69108 | 6367 | 36871 | 67375, 97879, 128383, 158887, 189391 | 13383 | ALE31873 | 13383 | 43887 | 74391, 104895, 135399, 165903, 196407 |
| 6368 | ADV69109 | 6368 | 36872 | 67376, 97880, 128384, 158888, 189392 | 13384 | ALE31874 | 13384 | 43888 | 74392, 104896, 135400, 165904, 196408 |
| 6369 | ADV76579 | 6369 | 36873 | 67377, 97881, 128385, 158889, 189393 | 13385 | ALE31875 | 13385 | 43889 | 74393, 104897, 135401, 165905, 196409 |
| 6370 | ADV76587 | 6370 | 36874 | 67378, 97882, 128386, 158890, 189394 | 13386 | ALE31876 | 13386 | 43890 | 74394, 104898, 135402, 165906, 196410 |
| 6371 | ADV76598 | 6371 | 36875 | 67379, 97883, 128387, 158891, 189395 | 13387 | ALE31877 | 13387 | 43891 | 74395, 104899, 135403, 165907, 196411 |
| 6372 | ADV76609 | 6372 | 36876 | 67380, 97884, 128388, 158892, 189396 | 13388 | ALE31878 | 13388 | 43892 | 74396, 104900, 135404, 165908, 196412 |
| 6373 | ADV76620 | 6373 | 36877 | 67381, 97885, 128389, 158893, 189397 | 13389 | ALE31879 | 13389 | 43893 | 74397, 104901, 135405, 165909, 196413 |
| 6374 | ADV76631 | 6374 | 36878 | 67382, 97886, 128390, 158894, 189398 | 13390 | ALE31880 | 13390 | 43894 | 74398, 104902, 135406, 165910, 196414 |
| 6375 | ADV76642 | 6375 | 36879 | 67383, 97887, 128391, 158895, 189399 | 13391 | ALE31881 | 13391 | 43895 | 74399, 104903, 135407, 165911, 196415 |
| 6376 | ADV76664 | 6376 | 36880 | 67384, 97888, 128392, 158896, 189400 | 13392 | ALE31882 | 13392 | 43896 | 74400, 104904, 135408, 165912, 196416 |
| 6377 | ADV76673 | 6377 | 36881 | 67385, 97889, 128393, 158897, 189401 | 13393 | ALE31888 | 13393 | 43897 | 74401, 104905, 135409, 165913, 196417 |
| 6378 | ADV76682 | 6378 | 36882 | 67386, 97890, 128394, 158898, 189402 | 13394 | ALE31889 | 13394 | 43898 | 74402, 104906, 135410, 165914, 196418 |
| 6379 | ADV76694 | 6379 | 36883 | 67387, 97891, 128395, 158899, 189403 | 13395 | ALE31890 | 13395 | 43899 | 74403, 104907, 135411, 165915, 196419 |
| 6380 | ADV76705 | 6380 | 36884 | 67388, 97892, 128396, 158900, 189404 | 13396 | ALE31891 | 13396 | 43900 | 74404, 104908, 135412, 165916, 196420 |
| 6381 | ADV76716 | 6381 | 36885 | 67389, 97893, 128397, 158901, 189405 | 13397 | ALE31892 | 13397 | 43901 | 74405, 104909, 135413, 165917, 196421 |
| 6382 | ADV76727 | 6382 | 36886 | 67390, 97894, 128398, 158902, 189406 | 13398 | ALE31893 | 13398 | 43902 | 74406, 104910, 135414, 165918, 196422 |
| 6383 | ADV91009 | 6383 | 36887 | 67391, 97895, 128399, 158903, 189407 | 13399 | ALE31894 | 13399 | 43903 | 74407, 104911, 135415, 165919, 196423 |

FIG. 1 continued

| | | | | | | | | | |
|---|---|---|---|---|---|---|---|---|---|
| 6384 | ADV91010 | 6384 | 36888 | 67392, 97896, 128400, 158904, 189408 | 13400 | ALE31895 | 13400 | 43904 | 74408, 104912, 135416, 165920, 196424 |
| 6385 | ADW01407 | 6385 | 36889 | 67393, 97897, 128401, 158905, 189409 | 13401 | ALE31896 | 13401 | 43905 | 74409, 104913, 135417, 165921, 196425 |
| 6386 | ADW09101 | 6386 | 36890 | 67394, 97898, 128402, 158906, 189410 | 13402 | ALE31897 | 13402 | 43906 | 74410, 104914, 135418, 165922, 196426 |
| 6387 | ADW09111 | 6387 | 36891 | 67395, 97899, 128403, 158907, 189411 | 13403 | ALE31898 | 13403 | 43907 | 74411, 104915, 135419, 165923, 196427 |
| 6388 | ADW09120 | 6388 | 36892 | 67396, 97900, 128404, 158908, 189412 | 13404 | ALE31899 | 13404 | 43908 | 74412, 104916, 135420, 165924, 196428 |
| 6389 | ADW09131 | 6389 | 36893 | 67397, 97901, 128405, 158909, 189413 | 13405 | ALE31901 | 13405 | 43909 | 74413, 104917, 135421, 165925, 196429 |
| 6390 | ADW09153 | 6390 | 36894 | 67398, 97902, 128406, 158910, 189414 | 13406 | ALE31902 | 13406 | 43910 | 74414, 104918, 135422, 165926, 196430 |
| 6391 | ADW09164 | 6391 | 36895 | 67399, 97903, 128407, 158911, 189415 | 13407 | ALE31903 | 13407 | 43911 | 74415, 104919, 135423, 165927, 196431 |
| 6392 | ADW09186 | 6392 | 36896 | 67400, 97904, 128408, 158912, 189416 | 13408 | ALE31904 | 13408 | 43912 | 74416, 104920, 135424, 165928, 196432 |
| 6393 | ADW09197 | 6393 | 36897 | 67401, 97905, 128409, 158913, 189417 | 13409 | ALE31905 | 13409 | 43913 | 74417, 104921, 135425, 165929, 196433 |
| 6394 | ADW09208 | 6394 | 36898 | 67402, 97906, 128410, 158914, 189418 | 13410 | ALE31906 | 13410 | 43914 | 74418, 104922, 135426, 165930, 196434 |
| 6395 | ADW09219 | 6395 | 36899 | 67403, 97907, 128411, 158915, 189419 | 13411 | ALE31907 | 13411 | 43915 | 74419, 104923, 135427, 165931, 196435 |
| 6396 | ADW09230 | 6396 | 36900 | 67404, 97908, 128412, 158916, 189420 | 13412 | ALE31908 | 13412 | 43916 | 74420, 104924, 135428, 165932, 196436 |
| 6397 | ADW09241 | 6397 | 36901 | 67405, 97909, 128413, 158917, 189421 | 13413 | ALE31909 | 13413 | 43917 | 74421, 104925, 135429, 165933, 196437 |
| 6398 | ADW09252 | 6398 | 36902 | 67406, 97910, 128414, 158918, 189422 | 13414 | ALE31910 | 13414 | 43918 | 74422, 104926, 135430, 165934, 196438 |
| 6399 | ADW09274 | 6399 | 36903 | 67407, 97911, 128415, 158919, 189423 | 13415 | ALE31912 | 13415 | 43919 | 74423, 104927, 135431, 165935, 196439 |
| 6400 | ADW09285 | 6400 | 36904 | 67408, 97912, 128416, 158920, 189424 | 13416 | ALE31913 | 13416 | 43920 | 74424, 104928, 135432, 165936, 196440 |
| 6401 | ADW09296 | 6401 | 36905 | 67409, 97913, 128417, 158921, 189425 | 13417 | ALE31914 | 13417 | 43921 | 74425, 104929, 135433, 165937, 196441 |

FIG. 1 continued

| | | | | | | | | | |
|---|---|---|---|---|---|---|---|---|---|
| 6402 | ADW09307 | 6402 | 36906 | 67410, 97914, 128418, 158922, 189426 | 13418 | ALE31915 | 13418 | 43922 | 74426, 104930, 135434, 165938, 196442 |
| 6403 | ADW09327 | 6403 | 36907 | 67411, 97915, 128419, 158923, 189427 | 13419 | ALE31916 | 13419 | 43923 | 74427, 104931, 135435, 165939, 196443 |
| 6404 | ADW10483 | 6404 | 36908 | 67412, 97916, 128420, 158924, 189428 | 13420 | ALE31917 | 13420 | 43924 | 74428, 104932, 135436, 165940, 196444 |
| 6405 | ADW10494 | 6405 | 36909 | 67413, 97917, 128421, 158925, 189429 | 13421 | ALE31918 | 13421 | 43925 | 74429, 104933, 135437, 165941, 196445 |
| 6406 | ADW10505 | 6406 | 36910 | 67414, 97918, 128422, 158926, 189430 | 13422 | ALE31920 | 13422 | 43926 | 74430, 104934, 135438, 165942, 196446 |
| 6407 | ADW10516 | 6407 | 36911 | 67415, 97919, 128423, 158927, 189431 | 13423 | ALE31921 | 13423 | 43927 | 74431, 104935, 135439, 165943, 196447 |
| 6408 | ADW10527 | 6408 | 36912 | 67416, 97920, 128424, 158928, 189432 | 13424 | ALE31922 | 13424 | 43928 | 74432, 104936, 135440, 165944, 196448 |
| 6409 | ADW10538 | 6409 | 36913 | 67417, 97921, 128425, 158929, 189433 | 13425 | ALE31923 | 13425 | 43929 | 74433, 104937, 135441, 165945, 196449 |
| 6410 | ADW10549 | 6410 | 36914 | 67418, 97922, 128426, 158930, 189434 | 13426 | ALE31924 | 13426 | 43930 | 74434, 104938, 135442, 165946, 196450 |
| 6411 | ADW10560 | 6411 | 36915 | 67419, 97923, 128427, 158931, 189435 | 13427 | ALE31925 | 13427 | 43931 | 74435, 104939, 135443, 165947, 196451 |
| 6412 | ADW10571 | 6412 | 36916 | 67420, 97924, 128428, 158932, 189436 | 13428 | ALE31926 | 13428 | 43932 | 74436, 104940, 135444, 165948, 196452 |
| 6413 | ADW10582 | 6413 | 36917 | 67421, 97925, 128429, 158933, 189437 | 13429 | ALE31927 | 13429 | 43933 | 74437, 104941, 135445, 165949, 196453 |
| 6414 | ADW10593 | 6414 | 36918 | 67422, 97926, 128430, 158934, 189438 | 13430 | ALE31928 | 13430 | 43934 | 74438, 104942, 135446, 165950, 196454 |
| 6415 | ADW10604 | 6415 | 36919 | 67423, 97927, 128431, 158935, 189439 | 13431 | ALE31930 | 13431 | 43935 | 74439, 104943, 135447, 165951, 196455 |
| 6416 | ADW10615 | 6416 | 36920 | 67424, 97928, 128432, 158936, 189440 | 13432 | ALE31931 | 13432 | 43936 | 74440, 104944, 135448, 165952, 196456 |
| 6417 | ADW10626 | 6417 | 36921 | 67425, 97929, 128433, 158937, 189441 | 13433 | ALE31932 | 13433 | 43937 | 74441, 104945, 135449, 165953, 196457 |
| 6418 | ADW10721 | 6418 | 36922 | 67426, 97930, 128434, 158938, 189442 | 13434 | ALE31933 | 13434 | 43938 | 74442, 104946, 135450, 165954, 196458 |
| 6419 | ADW10743 | 6419 | 36923 | 67427, 97931, 128435, 158939, 189443 | 13435 | ALE31934 | 13435 | 43939 | 74443, 104947, 135451, 165955, 196459 |

FIG. 1 continued

| | | | | | | | | | |
|---|---|---|---|---|---|---|---|---|---|
| 6420 | ADW10754 | 6420 | 36924 | 67428, 97932, 128436, 158940, 189444 | 13436 | ALE31935 | 13436 | 43940 | 74444, 104948, 135452, 165956, 196460 |
| 6421 | ADW10765 | 6421 | 36925 | 67429, 97933, 128437, 158941, 189445 | 13437 | ALE31936 | 13437 | 43941 | 74445, 104949, 135453, 165957, 196461 |
| 6422 | ADW10776 | 6422 | 36926 | 67430, 97934, 128438, 158942, 189446 | 13438 | ALE31937 | 13438 | 43942 | 74446, 104950, 135454, 165958, 196462 |
| 6423 | ADW10787 | 6423 | 36927 | 67431, 97935, 128439, 158943, 189447 | 13439 | ALE31938 | 13439 | 43943 | 74447, 104951, 135455, 165959, 196463 |
| 6424 | ADW10798 | 6424 | 36928 | 67432, 97936, 128440, 158944, 189448 | 13440 | ALE31939 | 13440 | 43944 | 74448, 104952, 135456, 165960, 196464 |
| 6425 | ADW10809 | 6425 | 36929 | 67433, 97937, 128441, 158945, 189449 | 13441 | ALE31941 | 13441 | 43945 | 74449, 104953, 135457, 165961, 196465 |
| 6426 | ADW10820 | 6426 | 36930 | 67434, 97938, 128442, 158946, 189450 | 13442 | ALE31943 | 13442 | 43946 | 74450, 104954, 135458, 165962, 196466 |
| 6427 | ADW10831 | 6427 | 36931 | 67435, 97939, 128443, 158947, 189451 | 13443 | ALE31944 | 13443 | 43947 | 74451, 104955, 135459, 165963, 196467 |
| 6428 | ADW10842 | 6428 | 36932 | 67436, 97940, 128444, 158948, 189452 | 13444 | ALE31945 | 13444 | 43948 | 74452, 104956, 135460, 165964, 196468 |
| 6429 | ADW10853 | 6429 | 36933 | 67437, 97941, 128445, 158949, 189453 | 13445 | ALE31946 | 13445 | 43949 | 74453, 104957, 135461, 165965, 196469 |
| 6430 | ADW10864 | 6430 | 36934 | 67438, 97942, 128446, 158950, 189454 | 13446 | ALE31947 | 13446 | 43950 | 74454, 104958, 135462, 165966, 196470 |
| 6431 | ADW10875 | 6431 | 36935 | 67439, 97943, 128447, 158951, 189455 | 13447 | ALE31948 | 13447 | 43951 | 74455, 104959, 135463, 165967, 196471 |
| 6432 | ADW10886 | 6432 | 36936 | 67440, 97944, 128448, 158952, 189456 | 13448 | ALE31949 | 13448 | 43952 | 74456, 104960, 135464, 165968, 196472 |
| 6433 | ADW10897 | 6433 | 36937 | 67441, 97945, 128449, 158953, 189457 | 13449 | ALE31950 | 13449 | 43953 | 74457, 104961, 135465, 165969, 196473 |
| 6434 | ADW23115 | 6434 | 36938 | 67442, 97946, 128450, 158954, 189458 | 13450 | ALE31951 | 13450 | 43954 | 74458, 104962, 135466, 165970, 196474 |
| 6435 | ADW54481 | 6435 | 36939 | 67443, 97947, 128451, 158955, 189459 | 13451 | ALE31952 | 13451 | 43955 | 74459, 104963, 135467, 165971, 196475 |
| 6436 | ADW54512 | 6436 | 36940 | 67444, 97948, 128452, 158956, 189460 | 13452 | ALE31953 | 13452 | 43956 | 74460, 104964, 135468, 165972, 196476 |
| 6437 | ADW54527 | 6437 | 36941 | 67445, 97949, 128453, 158957, 189461 | 13453 | ALE31954 | 13453 | 43957 | 74461, 104965, 135469, 165973, 196477 |

FIG. 1 continued

| | | | | | | | | | |
|---|---|---|---|---|---|---|---|---|---|
| 6438 | ADW65825 | 6438 | 36942 | 67446, 97950, 128454, 158958, 189462 | 13454 | ALE31955 | 13454 | 43958 | 74462, 104966, 135470, 165974, 196478 |
| 6439 | ADW82135 | 6439 | 36943 | 67447, 97951, 128455, 158959, 189463 | 13455 | ALE31956 | 13455 | 43959 | 74463, 104967, 135471, 165975, 196479 |
| 6440 | ADW82155 | 6440 | 36944 | 67448, 97952, 128456, 158960, 189464 | 13456 | ALE31957 | 13456 | 43960 | 74464, 104968, 135472, 165976, 196480 |
| 6441 | ADW82166 | 6441 | 36945 | 67449, 97953, 128457, 158961, 189465 | 13457 | ALE31958 | 13457 | 43961 | 74465, 104969, 135473, 165977, 196481 |
| 6442 | ADW82177 | 6442 | 36946 | 67450, 97954, 128458, 158962, 189466 | 13458 | ALE31959 | 13458 | 43962 | 74466, 104970, 135474, 165978, 196482 |
| 6443 | ADW82188 | 6443 | 36947 | 67451, 97955, 128459, 158963, 189467 | 13459 | ALE31960 | 13459 | 43963 | 74467, 104971, 135475, 165979, 196483 |
| 6444 | ADW82198 | 6444 | 36948 | 67452, 97956, 128460, 158964, 189468 | 13460 | ALE31961 | 13460 | 43964 | 74468, 104972, 135476, 165980, 196484 |
| 6445 | ADW82208 | 6445 | 36949 | 67453, 97957, 128461, 158965, 189469 | 13461 | ALE31962 | 13461 | 43965 | 74469, 104973, 135477, 165981, 196485 |
| 6446 | ADW82218 | 6446 | 36950 | 67454, 97958, 128462, 158966, 189470 | 13462 | ALE31963 | 13462 | 43966 | 74470, 104974, 135478, 165982, 196486 |
| 6447 | ADW82228 | 6447 | 36951 | 67455, 97959, 128463, 158967, 189471 | 13463 | ALE31964 | 13463 | 43967 | 74471, 104975, 135479, 165983, 196487 |
| 6448 | ADW82238 | 6448 | 36952 | 67456, 97960, 128464, 158968, 189472 | 13464 | ALE31965 | 13464 | 43968 | 74472, 104976, 135480, 165984, 196488 |
| 6449 | ADW82248 | 6449 | 36953 | 67457, 97961, 128465, 158969, 189473 | 13465 | ALE31966 | 13465 | 43969 | 74473, 104977, 135481, 165985, 196489 |
| 6450 | ADW82258 | 6450 | 36954 | 67458, 97962, 128466, 158970, 189474 | 13466 | ALE31967 | 13466 | 43970 | 74474, 104978, 135482, 165986, 196490 |
| 6451 | ADW82268 | 6451 | 36955 | 67459, 97963, 128467, 158971, 189475 | 13467 | ALE31968 | 13467 | 43971 | 74475, 104979, 135483, 165987, 196491 |
| 6452 | ADW93760 | 6452 | 36956 | 67460, 97964, 128468, 158972, 189476 | 13468 | ALE31969 | 13468 | 43972 | 74476, 104980, 135484, 165988, 196492 |
| 6453 | ADW95319 | 6453 | 36957 | 67461, 97965, 128469, 158973, 189477 | 13469 | ALE31970 | 13469 | 43973 | 74477, 104981, 135485, 165989, 196493 |
| 6454 | ADW95332 | 6454 | 36958 | 67462, 97966, 128470, 158974, 189478 | 13470 | ALE31971 | 13470 | 43974 | 74478, 104982, 135486, 165990, 196494 |
| 6455 | ADX21078 | 6455 | 36959 | 67463, 97967, 128471, 158975, 189479 | 13471 | ALE31972 | 13471 | 43975 | 74479, 104983, 135487, 165991, 196495 |

FIG. 1 continued

| | | | | | | | | | |
|---|---|---|---|---|---|---|---|---|---|
| 6456 | ADX21088 | 6456 | 36960 | 67464, 97968, 128472, 158976, 189480 | 13472 | ALE31973 | 13472 | 43976 | 74480, 104984, 135488, 165992, 196496 |
| 6457 | ADX21098 | 6457 | 36961 | 67465, 97969, 128473, 158977, 189481 | 13473 | ALE31974 | 13473 | 43977 | 74481, 104985, 135489, 165993, 196497 |
| 6458 | ADX36109 | 6458 | 36962 | 67466, 97970, 128474, 158978, 189482 | 13474 | ALE31975 | 13474 | 43978 | 74482, 104986, 135490, 165994, 196498 |
| 6459 | ADX96278 | 6459 | 36963 | 67467, 97971, 128475, 158979, 189483 | 13475 | ALE31976 | 13475 | 43979 | 74483, 104987, 135491, 165995, 196499 |
| 6460 | ADX96288 | 6460 | 36964 | 67468, 97972, 128476, 158980, 189484 | 13476 | ALE31977 | 13476 | 43980 | 74484, 104988, 135492, 165996, 196500 |
| 6461 | ADX96298 | 6461 | 36965 | 67469, 97973, 128477, 158981, 189485 | 13477 | ALE31978 | 13477 | 43981 | 74485, 104989, 135493, 165997, 196501 |
| 6462 | ADX96308 | 6462 | 36966 | 67470, 97974, 128478, 158982, 189486 | 13478 | ALE31979 | 13478 | 43982 | 74486, 104990, 135494, 165998, 196502 |
| 6463 | ADX96318 | 6463 | 36967 | 67471, 97975, 128479, 158983, 189487 | 13479 | ALE31980 | 13479 | 43983 | 74487, 104991, 135495, 165999, 196503 |
| 6464 | ADX96328 | 6464 | 36968 | 67472, 97976, 128480, 158984, 189488 | 13480 | ALE31981 | 13480 | 43984 | 74488, 104992, 135496, 166000, 196504 |
| 6465 | ADX96347 | 6465 | 36969 | 67473, 97977, 128481, 158985, 189489 | 13481 | ALE31995 | 13481 | 43985 | 74489, 104993, 135497, 166001, 196505 |
| 6466 | ADX96357 | 6466 | 36970 | 67474, 97978, 128482, 158986, 189490 | 13482 | ALE31996 | 13482 | 43986 | 74490, 104994, 135498, 166002, 196506 |
| 6467 | ADX96367 | 6467 | 36971 | 67475, 97979, 128483, 158987, 189491 | 13483 | ALE31997 | 13483 | 43987 | 74491, 104995, 135499, 166003, 196507 |
| 6468 | ADX96378 | 6468 | 36972 | 67476, 97980, 128484, 158988, 189492 | 13484 | ALE31998 | 13484 | 43988 | 74492, 104996, 135500, 166004, 196508 |
| 6469 | ADX96398 | 6469 | 36973 | 67477, 97981, 128485, 158989, 189493 | 13485 | ALE31999 | 13485 | 43989 | 74493, 104997, 135501, 166005, 196509 |
| 6470 | ADX96408 | 6470 | 36974 | 67478, 97982, 128486, 158990, 189494 | 13486 | ALE32000 | 13486 | 43990 | 74494, 104998, 135502, 166006, 196510 |
| 6471 | ADX96427 | 6471 | 36975 | 67479, 97983, 128487, 158991, 189495 | 13487 | ALE32001 | 13487 | 43991 | 74495, 104999, 135503, 166007, 196511 |
| 6472 | ADX96437 | 6472 | 36976 | 67480, 97984, 128488, 158992, 189496 | 13488 | ALE32002 | 13488 | 43992 | 74496, 105000, 135504, 166008, 196512 |
| 6473 | ADX96447 | 6473 | 36977 | 67481, 97985, 128489, 158993, 189497 | 13489 | ALE32003 | 13489 | 43993 | 74497, 105001, 135505, 166009, 196513 |

FIG. 1 continued

| | | | | | | | | | |
|---|---|---|---|---|---|---|---|---|---|
| 6474 | ADX96497 | 6474 | 36978 | 67482, 97986, 128490, 158994, 189498 | 13490 | ALE32004 | 13490 | 43994 | 74498, 105002, 135506, 166010, 196514 |
| 6475 | ADX96507 | 6475 | 36979 | 67483, 97987, 128491, 158995, 189499 | 13491 | ALE32005 | 13491 | 43995 | 74499, 105003, 135507, 166011, 196515 |
| 6476 | ADX96517 | 6476 | 36980 | 67484, 97988, 128492, 158996, 189500 | 13492 | ALE32006 | 13492 | 43996 | 74500, 105004, 135508, 166012, 196516 |
| 6477 | ADX96527 | 6477 | 36981 | 67485, 97989, 128493, 158997, 189501 | 13493 | ALE32007 | 13493 | 43997 | 74501, 105005, 135509, 166013, 196517 |
| 6478 | ADX96537 | 6478 | 36982 | 67486, 97990, 128494, 158998, 189502 | 13494 | ALE32008 | 13494 | 43998 | 74502, 105006, 135510, 166014, 196518 |
| 6479 | ADX96547 | 6479 | 36983 | 67487, 97991, 128495, 158999, 189503 | 13495 | ALE32009 | 13495 | 43999 | 74503, 105007, 135511, 166015, 196519 |
| 6480 | ADX96557 | 6480 | 36984 | 67488, 97992, 128496, 159000, 189504 | 13496 | ALE32010 | 13496 | 44000 | 74504, 105008, 135512, 166016, 196520 |
| 6481 | ADX96587 | 6481 | 36985 | 67489, 97993, 128497, 159001, 189505 | 13497 | ALE32011 | 13497 | 44001 | 74505, 105009, 135513, 166017, 196521 |
| 6482 | ADX96597 | 6482 | 36986 | 67490, 97994, 128498, 159002, 189506 | 13498 | ALE32012 | 13498 | 44002 | 74506, 105010, 135514, 166018, 196522 |
| 6483 | ADX96607 | 6483 | 36987 | 67491, 97995, 128499, 159003, 189507 | 13499 | ALE32013 | 13499 | 44003 | 74507, 105011, 135515, 166019, 196523 |
| 6484 | ADX96627 | 6484 | 36988 | 67492, 97996, 128500, 159004, 189508 | 13500 | ALE32014 | 13500 | 44004 | 74508, 105012, 135516, 166020, 196524 |
| 6485 | ADX96637 | 6485 | 36989 | 67493, 97997, 128501, 159005, 189509 | 13501 | ALE32015 | 13501 | 44005 | 74509, 105013, 135517, 166021, 196525 |
| 6486 | ADX96647 | 6486 | 36990 | 67494, 97998, 128502, 159006, 189510 | 13502 | ALE32016 | 13502 | 44006 | 74510, 105014, 135518, 166022, 196526 |
| 6487 | ADX96657 | 6487 | 36991 | 67495, 97999, 128503, 159007, 189511 | 13503 | ALE32017 | 13503 | 44007 | 74511, 105015, 135519, 166023, 196527 |
| 6488 | ADX96667 | 6488 | 36992 | 67496, 98000, 128504, 159008, 189512 | 13504 | ALE32018 | 13504 | 44008 | 74512, 105016, 135520, 166024, 196528 |
| 6489 | ADX96677 | 6489 | 36993 | 67497, 98001, 128505, 159009, 189513 | 13505 | ALE32020 | 13505 | 44009 | 74513, 105017, 135521, 166025, 196529 |
| 6490 | ADX96687 | 6490 | 36994 | 67498, 98002, 128506, 159010, 189514 | 13506 | ALE32021 | 13506 | 44010 | 74514, 105018, 135522, 166026, 196530 |
| 6491 | ADX96697 | 6491 | 36995 | 67499, 98003, 128507, 159011, 189515 | 13507 | ALE32022 | 13507 | 44011 | 74515, 105019, 135523, 166027, 196531 |

FIG. 1 continued

| | | | | | | | | | |
|---|---|---|---|---|---|---|---|---|---|
| 6492 | ADX96707 | 6492 | 36996 | 67500, 98004, 128508, 159012, 189516 | 13508 | ALE32023 | 13508 | 44012 | 74516, 105020, 135524, 166028, 196532 |
| 6493 | ADX96727 | 6493 | 36997 | 67501, 98005, 128509, 159013, 189517 | 13509 | ALE32024 | 13509 | 44013 | 74517, 105021, 135525, 166029, 196533 |
| 6494 | ADX96737 | 6494 | 36998 | 67502, 98006, 128510, 159014, 189518 | 13510 | ALE32025 | 13510 | 44014 | 74518, 105022, 135526, 166030, 196534 |
| 6495 | ADX96747 | 6495 | 36999 | 67503, 98007, 128511, 159015, 189519 | 13511 | ALE32026 | 13511 | 44015 | 74519, 105023, 135527, 166031, 196535 |
| 6496 | ADX96757 | 6496 | 37000 | 67504, 98008, 128512, 159016, 189520 | 13512 | ALE32027 | 13512 | 44016 | 74520, 105024, 135528, 166032, 196536 |
| 6497 | ADX96767 | 6497 | 37001 | 67505, 98009, 128513, 159017, 189521 | 13513 | ALE32028 | 13513 | 44017 | 74521, 105025, 135529, 166033, 196537 |
| 6498 | ADX96777 | 6498 | 37002 | 67506, 98010, 128514, 159018, 189522 | 13514 | ALE32029 | 13514 | 44018 | 74522, 105026, 135530, 166034, 196538 |
| 6499 | ADX96787 | 6499 | 37003 | 67507, 98011, 128515, 159019, 189523 | 13515 | ALE32030 | 13515 | 44019 | 74523, 105027, 135531, 166035, 196539 |
| 6500 | ADX96797 | 6500 | 37004 | 67508, 98012, 128516, 159020, 189524 | 13516 | ALE32031 | 13516 | 44020 | 74524, 105028, 135532, 166036, 196540 |
| 6501 | ADX96807 | 6501 | 37005 | 67509, 98013, 128517, 159021, 189525 | 13517 | ALE32032 | 13517 | 44021 | 74525, 105029, 135533, 166037, 196541 |
| 6502 | ADX96817 | 6502 | 37006 | 67510, 98014, 128518, 159022, 189526 | 13518 | ALE32033 | 13518 | 44022 | 74526, 105030, 135534, 166038, 196542 |
| 6503 | ADX96837 | 6503 | 37007 | 67511, 98015, 128519, 159023, 189527 | 13519 | ALE32034 | 13519 | 44023 | 74527, 105031, 135535, 166039, 196543 |
| 6504 | ADX96847 | 6504 | 37008 | 67512, 98016, 128520, 159024, 189528 | 13520 | ALE32035 | 13520 | 44024 | 74528, 105032, 135536, 166040, 196544 |
| 6505 | ADX96857 | 6505 | 37009 | 67513, 98017, 128521, 159025, 189529 | 13521 | ALE32036 | 13521 | 44025 | 74529, 105033, 135537, 166041, 196545 |
| 6506 | ADX96867 | 6506 | 37010 | 67514, 98018, 128522, 159026, 189530 | 13522 | ALE32037 | 13522 | 44026 | 74530, 105034, 135538, 166042, 196546 |
| 6507 | ADX96877 | 6507 | 37011 | 67515, 98019, 128523, 159027, 189531 | 13523 | ALE32038 | 13523 | 44027 | 74531, 105035, 135539, 166043, 196547 |
| 6508 | ADX96897 | 6508 | 37012 | 67516, 98020, 128524, 159028, 189532 | 13524 | ALE32039 | 13524 | 44028 | 74532, 105036, 135540, 166044, 196548 |
| 6509 | ADX96907 | 6509 | 37013 | 67517, 98021, 128525, 159029, 189533 | 13525 | ALE32040 | 13525 | 44029 | 74533, 105037, 135541, 166045, 196549 |

FIG. 1 continued

| | | | | | | | | | |
|---|---|---|---|---|---|---|---|---|---|
| 6510 | ADX96927 | 6510 | 37014 | 67518, 98022, 128526, 159030, 189534 | 13526 | ALE32041 | 13526 | 44030 | 74534, 105038, 135542, 166046, 196550 |
| 6511 | ADX96937 | 6511 | 37015 | 67519, 98023, 128527, 159031, 189535 | 13527 | ALE32042 | 13527 | 44031 | 74535, 105039, 135543, 166047, 196551 |
| 6512 | ADX96947 | 6512 | 37016 | 67520, 98024, 128528, 159032, 189536 | 13528 | ALE32043 | 13528 | 44032 | 74536, 105040, 135544, 166048, 196552 |
| 6513 | ADX96957 | 6513 | 37017 | 67521, 98025, 128529, 159033, 189537 | 13529 | ALE32044 | 13529 | 44033 | 74537, 105041, 135545, 166049, 196553 |
| 6514 | ADX96967 | 6514 | 37018 | 67522, 98026, 128530, 159034, 189538 | 13530 | ALE32045 | 13530 | 44034 | 74538, 105042, 135546, 166050, 196554 |
| 6515 | ADX96977 | 6515 | 37019 | 67523, 98027, 128531, 159035, 189539 | 13531 | ALE32046 | 13531 | 44035 | 74539, 105043, 135547, 166051, 196555 |
| 6516 | ADX96987 | 6516 | 37020 | 67524, 98028, 128532, 159036, 189540 | 13532 | ALE32047 | 13532 | 44036 | 74540, 105044, 135548, 166052, 196556 |
| 6517 | ADX96997 | 6517 | 37021 | 67525, 98029, 128533, 159037, 189541 | 13533 | ALE32048 | 13533 | 44037 | 74541, 105045, 135549, 166053, 196557 |
| 6518 | ADX97007 | 6518 | 37022 | 67526, 98030, 128534, 159038, 189542 | 13534 | ALE32049 | 13534 | 44038 | 74542, 105046, 135550, 166054, 196558 |
| 6519 | ADX97018 | 6519 | 37023 | 67527, 98031, 128535, 159039, 189543 | 13535 | ALE32050 | 13535 | 44039 | 74543, 105047, 135551, 166055, 196559 |
| 6520 | ADX97028 | 6520 | 37024 | 67528, 98032, 128536, 159040, 189544 | 13536 | ALE32051 | 13536 | 44040 | 74544, 105048, 135552, 166056, 196560 |
| 6521 | ADX98640 | 6521 | 37025 | 67529, 98033, 128537, 159041, 189545 | 13537 | ALE32052 | 13537 | 44041 | 74545, 105049, 135553, 166057, 196561 |
| 6522 | ADX98650 | 6522 | 37026 | 67530, 98034, 128538, 159042, 189546 | 13538 | ALE32053 | 13538 | 44042 | 74546, 105050, 135554, 166058, 196562 |
| 6523 | ADX98665 | 6523 | 37027 | 67531, 98035, 128539, 159043, 189547 | 13539 | ALE32054 | 13539 | 44043 | 74547, 105051, 135555, 166059, 196563 |
| 6524 | ADX98675 | 6524 | 37028 | 67532, 98036, 128540, 159044, 189548 | 13540 | ALE32055 | 13540 | 44044 | 74548, 105052, 135556, 166060, 196564 |
| 6525 | ADX98695 | 6525 | 37029 | 67533, 98037, 128541, 159045, 189549 | 13541 | ALE32056 | 13541 | 44045 | 74549, 105053, 135557, 166061, 196565 |
| 6526 | ADX98729 | 6526 | 37030 | 67534, 98038, 128542, 159046, 189550 | 13542 | ALE32057 | 13542 | 44046 | 74550, 105054, 135558, 166062, 196566 |
| 6527 | ADX98739 | 6527 | 37031 | 67535, 98039, 128543, 159047, 189551 | 13543 | ALE32058 | 13543 | 44047 | 74551, 105055, 135559, 166063, 196567 |

FIG. 1 continued

| | | | | | | | | | |
|---|---|---|---|---|---|---|---|---|---|
| 6528 | ADX98748 | 6528 | 37032 | 67536, 98040, 128544, 159048, 189552 | 13544 | ALE32059 | 13544 | 44048 | 74552, 105056, 135560, 166064, 196568 |
| 6529 | ADX98758 | 6529 | 37033 | 67537, 98041, 128545, 159049, 189553 | 13545 | ALE32060 | 13545 | 44049 | 74553, 105057, 135561, 166065, 196569 |
| 6530 | ADX98767 | 6530 | 37034 | 67538, 98042, 128546, 159050, 189554 | 13546 | ALE32061 | 13546 | 44050 | 74554, 105058, 135562, 166066, 196570 |
| 6531 | ADX98777 | 6531 | 37035 | 67539, 98043, 128547, 159051, 189555 | 13547 | ALE32062 | 13547 | 44051 | 74555, 105059, 135563, 166067, 196571 |
| 6532 | ADX98785 | 6532 | 37036 | 67540, 98044, 128548, 159052, 189556 | 13548 | ALE32063 | 13548 | 44052 | 74556, 105060, 135564, 166068, 196572 |
| 6533 | ADX98792 | 6533 | 37037 | 67541, 98045, 128549, 159053, 189557 | 13549 | ALE32064 | 13549 | 44053 | 74557, 105061, 135565, 166069, 196573 |
| 6534 | ADX98806 | 6534 | 37038 | 67542, 98046, 128550, 159054, 189558 | 13550 | ALE32065 | 13550 | 44054 | 74558, 105062, 135566, 166070, 196574 |
| 6535 | ADX98818 | 6535 | 37039 | 67543, 98047, 128551, 159055, 189559 | 13551 | ALE32066 | 13551 | 44055 | 74559, 105063, 135567, 166071, 196575 |
| 6536 | ADX98828 | 6536 | 37040 | 67544, 98048, 128552, 159056, 189560 | 13552 | ALE32067 | 13552 | 44056 | 74560, 105064, 135568, 166072, 196576 |
| 6537 | ADX98843 | 6537 | 37041 | 67545, 98049, 128553, 159057, 189561 | 13553 | ALE32068 | 13553 | 44057 | 74561, 105065, 135569, 166073, 196577 |
| 6538 | ADX98853 | 6538 | 37042 | 67546, 98050, 128554, 159058, 189562 | 13554 | ALE32069 | 13554 | 44058 | 74562, 105066, 135570, 166074, 196578 |
| 6539 | ADX98860 | 6539 | 37043 | 67547, 98051, 128555, 159059, 189563 | 13555 | ALE32070 | 13555 | 44059 | 74563, 105067, 135571, 166075, 196579 |
| 6540 | ADX98870 | 6540 | 37044 | 67548, 98052, 128556, 159060, 189564 | 13556 | ALE32071 | 13556 | 44060 | 74564, 105068, 135572, 166076, 196580 |
| 6541 | ADX98880 | 6541 | 37045 | 67549, 98053, 128557, 159061, 189565 | 13557 | ALE32072 | 13557 | 44061 | 74565, 105069, 135573, 166077, 196581 |
| 6542 | ADX98890 | 6542 | 37046 | 67550, 98054, 128558, 159062, 189566 | 13558 | ALE32073 | 13558 | 44062 | 74566, 105070, 135574, 166078, 196582 |
| 6543 | ADX98900 | 6543 | 37047 | 67551, 98055, 128559, 159063, 189567 | 13559 | ALE32074 | 13559 | 44063 | 74567, 105071, 135575, 166079, 196583 |
| 6544 | ADX98910 | 6544 | 37048 | 67552, 98056, 128560, 159064, 189568 | 13560 | ALE32075 | 13560 | 44064 | 74568, 105072, 135576, 166080, 196584 |
| 6545 | ADX98920 | 6545 | 37049 | 67553, 98057, 128561, 159065, 189569 | 13561 | ALE32076 | 13561 | 44065 | 74569, 105073, 135577, 166081, 196585 |

FIG. 1 continued

| | | | | | | | | | |
|---|---|---|---|---|---|---|---|---|---|
| 6546 | ADX98930 | 6546 | 37050 | 67554, 98058, 128562, 159066, 189570 | 13562 | ALE32077 | 13562 | 44066 | 74570, 105074, 135578, 166082, 196586 |
| 6547 | ADX98940 | 6547 | 37051 | 67555, 98059, 128563, 159067, 189571 | 13563 | ALE32078 | 13563 | 44067 | 74571, 105075, 135579, 166083, 196587 |
| 6548 | ADX98950 | 6548 | 37052 | 67556, 98060, 128564, 159068, 189572 | 13564 | ALE32079 | 13564 | 44068 | 74572, 105076, 135580, 166084, 196588 |
| 6549 | ADX98960 | 6549 | 37053 | 67557, 98061, 128565, 159069, 189573 | 13565 | ALE32080 | 13565 | 44069 | 74573, 105077, 135581, 166085, 196589 |
| 6550 | ADX98970 | 6550 | 37054 | 67558, 98062, 128566, 159070, 189574 | 13566 | ALE32081 | 13566 | 44070 | 74574, 105078, 135582, 166086, 196590 |
| 6551 | ADX98980 | 6551 | 37055 | 67559, 98063, 128567, 159071, 189575 | 13567 | ALE32082 | 13567 | 44071 | 74575, 105079, 135583, 166087, 196591 |
| 6552 | ADX98990 | 6552 | 37056 | 67560, 98064, 128568, 159072, 189576 | 13568 | ALE32083 | 13568 | 44072 | 74576, 105080, 135584, 166088, 196592 |
| 6553 | ADX99000 | 6553 | 37057 | 67561, 98065, 128569, 159073, 189577 | 13569 | ALE32084 | 13569 | 44073 | 74577, 105081, 135585, 166089, 196593 |
| 6554 | ADX99581 | 6554 | 37058 | 67562, 98066, 128570, 159074, 189578 | 13570 | ALE32085 | 13570 | 44074 | 74578, 105082, 135586, 166090, 196594 |
| 6555 | ADX99592 | 6555 | 37059 | 67563, 98067, 128571, 159075, 189579 | 13571 | ALE32086 | 13571 | 44075 | 74579, 105083, 135587, 166091, 196595 |
| 6556 | ADX99603 | 6556 | 37060 | 67564, 98068, 128572, 159076, 189580 | 13572 | ALE32087 | 13572 | 44076 | 74580, 105084, 135588, 166092, 196596 |
| 6557 | ADX99614 | 6557 | 37061 | 67565, 98069, 128573, 159077, 189581 | 13573 | ALE32088 | 13573 | 44077 | 74581, 105085, 135589, 166093, 196597 |
| 6558 | ADX99625 | 6558 | 37062 | 67566, 98070, 128574, 159078, 189582 | 13574 | ALE32089 | 13574 | 44078 | 74582, 105086, 135590, 166094, 196598 |
| 6559 | ADX99636 | 6559 | 37063 | 67567, 98071, 128575, 159079, 189583 | 13575 | ALE32090 | 13575 | 44079 | 74583, 105087, 135591, 166095, 196599 |
| 6560 | ADX99647 | 6560 | 37064 | 67568, 98072, 128576, 159080, 189584 | 13576 | ALE32091 | 13576 | 44080 | 74584, 105088, 135592, 166096, 196600 |
| 6561 | ADX99680 | 6561 | 37065 | 67569, 98073, 128577, 159081, 189585 | 13577 | ALE32092 | 13577 | 44081 | 74585, 105089, 135593, 166097, 196601 |
| 6562 | ADX99702 | 6562 | 37066 | 67570, 98074, 128578, 159082, 189586 | 13578 | ALE32093 | 13578 | 44082 | 74586, 105090, 135594, 166098, 196602 |
| 6563 | ADX99843 | 6563 | 37067 | 67571, 98075, 128579, 159083, 189587 | 13579 | ALE32094 | 13579 | 44083 | 74587, 105091, 135595, 166099, 196603 |

FIG. 1 continued

| | | | | | | | | | |
|---|---|---|---|---|---|---|---|---|---|
| 6564 | ADX99854 | 6564 | 37068 | 67572, 98076, 128580, 159084, 189588 | 13580 | ALE32095 | 13580 | 44084 | 74588, 105092, 135596, 166100, 196604 |
| 6565 | ADX99865 | 6565 | 37069 | 67573, 98077, 128581, 159085, 189589 | 13581 | ALE32096 | 13581 | 44085 | 74589, 105093, 135597, 166101, 196605 |
| 6566 | ADX99887 | 6566 | 37070 | 67574, 98078, 128582, 159086, 189590 | 13582 | ALE32097 | 13582 | 44086 | 74590, 105094, 135598, 166102, 196606 |
| 6567 | ADX99898 | 6567 | 37071 | 67575, 98079, 128583, 159087, 189591 | 13583 | ALE32099 | 13583 | 44087 | 74591, 105095, 135599, 166103, 196607 |
| 6568 | ADX99909 | 6568 | 37072 | 67576, 98080, 128584, 159088, 189592 | 13584 | ALE32100 | 13584 | 44088 | 74592, 105096, 135600, 166104, 196608 |
| 6569 | ADX99920 | 6569 | 37073 | 67577, 98081, 128585, 159089, 189593 | 13585 | ALE32101 | 13585 | 44089 | 74593, 105097, 135601, 166105, 196609 |
| 6570 | ADX99931 | 6570 | 37074 | 67578, 98082, 128586, 159090, 189594 | 13586 | ALE32102 | 13586 | 44090 | 74594, 105098, 135602, 166106, 196610 |
| 6571 | ADX99964 | 6571 | 37075 | 67579, 98083, 128587, 159091, 189595 | 13587 | ALE32103 | 13587 | 44091 | 74595, 105099, 135603, 166107, 196611 |
| 6572 | ADX99975 | 6572 | 37076 | 67580, 98084, 128588, 159092, 189596 | 13588 | ALE32104 | 13588 | 44092 | 74596, 105100, 135604, 166108, 196612 |
| 6573 | ADX99986 | 6573 | 37077 | 67581, 98085, 128589, 159093, 189597 | 13589 | ALE32105 | 13589 | 44093 | 74597, 105101, 135605, 166109, 196613 |
| 6574 | ADX99997 | 6574 | 37078 | 67582, 98086, 128590, 159094, 189598 | 13590 | ALE32106 | 13590 | 44094 | 74598, 105102, 135606, 166110, 196614 |
| 6575 | ADY00009 | 6575 | 37079 | 67583, 98087, 128591, 159095, 189599 | 13591 | ALE32107 | 13591 | 44095 | 74599, 105103, 135607, 166111, 196615 |
| 6576 | ADY00020 | 6576 | 37080 | 67584, 98088, 128592, 159096, 189600 | 13592 | ALE32108 | 13592 | 44096 | 74600, 105104, 135608, 166112, 196616 |
| 6577 | ADY04727 | 6577 | 37081 | 67585, 98089, 128593, 159097, 189601 | 13593 | ALE32109 | 13593 | 44097 | 74601, 105105, 135609, 166113, 196617 |
| 6578 | ADY11836 | 6578 | 37082 | 67586, 98090, 128594, 159098, 189602 | 13594 | ALE32110 | 13594 | 44098 | 74602, 105106, 135610, 166114, 196618 |
| 6579 | ADY17654 | 6579 | 37083 | 67587, 98091, 128595, 159099, 189603 | 13595 | ALE32111 | 13595 | 44099 | 74603, 105107, 135611, 166115, 196619 |
| 6580 | ADY17665 | 6580 | 37084 | 67588, 98092, 128596, 159100, 189604 | 13596 | ALE32112 | 13596 | 44100 | 74604, 105108, 135612, 166116, 196620 |
| 6581 | ADY17676 | 6581 | 37085 | 67589, 98093, 128597, 159101, 189605 | 13597 | ALE32113 | 13597 | 44101 | 74605, 105109, 135613, 166117, 196621 |

FIG. 1 continued

| | | | | | | | | | |
|---|---|---|---|---|---|---|---|---|---|
| 6582 | ADY17687 | 6582 | 37086 | 67590, 98094, 128598, 159102, 189606 | 13598 | ALE32114 | 13598 | 44102 | 74606, 105110, 135614, 166118, 196622 |
| 6583 | ADY17698 | 6583 | 37087 | 67591, 98095, 128599, 159103, 189607 | 13599 | ALE32115 | 13599 | 44103 | 74607, 105111, 135615, 166119, 196623 |
| 6584 | ADY38719 | 6584 | 37088 | 67592, 98096, 128600, 159104, 189608 | 13600 | ALE32116 | 13600 | 44104 | 74608, 105112, 135616, 166120, 196624 |
| 6585 | ADY38750 | 6585 | 37089 | 67593, 98097, 128601, 159105, 189609 | 13601 | ALE32117 | 13601 | 44105 | 74609, 105113, 135617, 166121, 196625 |
| 6586 | ADY38760 | 6586 | 37090 | 67594, 98098, 128602, 159106, 189610 | 13602 | ALE32118 | 13602 | 44106 | 74610, 105114, 135618, 166122, 196626 |
| 6587 | ADZ04607 | 6587 | 37091 | 67595, 98099, 128603, 159107, 189611 | 13603 | ALM06086 | 13603 | 44107 | 74611, 105115, 135619, 166123, 196627 |
| 6588 | ADZ05834 | 6588 | 37092 | 67596, 98100, 128604, 159108, 189612 | 13604 | ALM06087 | 13604 | 44108 | 74612, 105116, 135620, 166124, 196628 |
| 6589 | ADZ05845 | 6589 | 37093 | 67597, 98101, 128605, 159109, 189613 | 13605 | ALM06088 | 13605 | 44109 | 74613, 105117, 135621, 166125, 196629 |
| 6590 | ADZ05855 | 6590 | 37094 | 67598, 98102, 128606, 159110, 189614 | 13606 | ALM06089 | 13606 | 44110 | 74614, 105118, 135622, 166126, 196630 |
| 6591 | ADZ47838 | 6591 | 37095 | 67599, 98103, 128607, 159111, 189615 | 13607 | ALN39661 | 13607 | 44111 | 74615, 105119, 135623, 166127, 196631 |
| 6592 | ADZ47858 | 6592 | 37096 | 67600, 98104, 128608, 159112, 189616 | 13608 | ALN39662 | 13608 | 44112 | 74616, 105120, 135624, 166128, 196632 |
| 6593 | ADZ53100 | 6593 | 37097 | 67601, 98105, 128609, 159113, 189617 | 13609 | ALN39663 | 13609 | 44113 | 74617, 105121, 135625, 166129, 196633 |
| 6594 | ADZ53123 | 6594 | 37098 | 67602, 98106, 128610, 159114, 189618 | 13610 | ALN39664 | 13610 | 44114 | 74618, 105122, 135626, 166130, 196634 |
| 6595 | ADZ53125 | 6595 | 37099 | 67603, 98107, 128611, 159115, 189619 | 13611 | ALN39665 | 13611 | 44115 | 74619, 105123, 135627, 166131, 196635 |
| 6596 | ADZ53127 | 6596 | 37100 | 67604, 98108, 128612, 159116, 189620 | 13612 | ALN39666 | 13612 | 44116 | 74620, 105124, 135628, 166132, 196636 |
| 6597 | ADZ53131 | 6597 | 37101 | 67605, 98109, 128613, 159117, 189621 | 13613 | ALN39667 | 13613 | 44117 | 74621, 105125, 135629, 166133, 196637 |
| 6598 | ADZ53133 | 6598 | 37102 | 67606, 98110, 128614, 159118, 189622 | 13614 | ALN39668 | 13614 | 44118 | 74622, 105126, 135630, 166134, 196638 |
| 6599 | ADZ53135 | 6599 | 37103 | 67607, 98111, 128615, 159119, 189623 | 13615 | ALN39669 | 13615 | 44119 | 74623, 105127, 135631, 166135, 196639 |

FIG. 1 continued

| | | | | | | | | | |
|---|---|---|---|---|---|---|---|---|---|
| 6600 | ADZ53138 | 6600 | 37104 | 67608, 98112, 128616, 159120, 189624 | 13616 | ALN39670 | 13616 | 44120 | 74624, 105128, 135632, 166136, 196640 |
| 6601 | ADZ53140 | 6601 | 37105 | 67609, 98113, 128617, 159121, 189625 | 13617 | ALN39671 | 13617 | 44121 | 74625, 105129, 135633, 166137, 196641 |
| 6602 | ADZ93496 | 6602 | 37106 | 67610, 98114, 128618, 159122, 189626 | 13618 | ALN39672 | 13618 | 44122 | 74626, 105130, 135634, 166138, 196642 |
| 6603 | AEA04365 | 6603 | 37107 | 67611, 98115, 128619, 159123, 189627 | 13619 | ALN39673 | 13619 | 44123 | 74627, 105131, 135635, 166139, 196643 |
| 6604 | AEA04376 | 6604 | 37108 | 67612, 98116, 128620, 159124, 189628 | 13620 | ALN39674 | 13620 | 44124 | 74628, 105132, 135636, 166140, 196644 |
| 6605 | AEA10292 | 6605 | 37109 | 67613, 98117, 128621, 159125, 189629 | 13621 | ALN39675 | 13621 | 44125 | 74629, 105133, 135637, 166141, 196645 |
| 6606 | AEA10303 | 6606 | 37110 | 67614, 98118, 128622, 159126, 189630 | 13622 | ALN39676 | 13622 | 44126 | 74630, 105134, 135638, 166142, 196646 |
| 6607 | AEA10313 | 6607 | 37111 | 67615, 98119, 128623, 159127, 189631 | 13623 | ALN39677 | 13623 | 44127 | 74631, 105135, 135639, 166143, 196647 |
| 6608 | AEA10323 | 6608 | 37112 | 67616, 98120, 128624, 159128, 189632 | 13624 | ALN39678 | 13624 | 44128 | 74632, 105136, 135640, 166144, 196648 |
| 6609 | AEA10339 | 6609 | 37113 | 67617, 98121, 128625, 159129, 189633 | 13625 | ALN39679 | 13625 | 44129 | 74633, 105137, 135641, 166145, 196649 |
| 6610 | AEA10349 | 6610 | 37114 | 67618, 98122, 128626, 159130, 189634 | 13626 | ALN39680 | 13626 | 44130 | 74634, 105138, 135642, 166146, 196650 |
| 6611 | AEA30293 | 6611 | 37115 | 67619, 98123, 128627, 159131, 189635 | 13627 | ALN39681 | 13627 | 44131 | 74635, 105139, 135643, 166147, 196651 |
| 6612 | AEA48989 | 6612 | 37116 | 67620, 98124, 128628, 159132, 189636 | 13628 | ALN39682 | 13628 | 44132 | 74636, 105140, 135644, 166148, 196652 |
| 6613 | AEA50985 | 6613 | 37117 | 67621, 98125, 128629, 159133, 189637 | 13629 | ALN39683 | 13629 | 44133 | 74637, 105141, 135645, 166149, 196653 |
| 6614 | AEA72704 | 6614 | 37118 | 67622, 98126, 128630, 159134, 189638 | 13630 | ALN39684 | 13630 | 44134 | 74638, 105142, 135646, 166150, 196654 |
| 6615 | AEA72715 | 6615 | 37119 | 67623, 98127, 128631, 159135, 189639 | 13631 | ALN39685 | 13631 | 44135 | 74639, 105143, 135647, 166151, 196655 |
| 6616 | AEA72726 | 6616 | 37120 | 67624, 98128, 128632, 159136, 189640 | 13632 | ALN39686 | 13632 | 44136 | 74640, 105144, 135648, 166152, 196656 |
| 6617 | AEA72740 | 6617 | 37121 | 67625, 98129, 128633, 159137, 189641 | 13633 | ALN39687 | 13633 | 44137 | 74641, 105145, 135649, 166153, 196657 |

FIG. 1 continued

| | | | | | | | | | |
|---|---|---|---|---|---|---|---|---|---|
| 6618 | AEA72750 | 6618 | 37122 | 67626, 98130, 128634, 159138, 189642 | 13634 | ALN39688 | 13634 | 44138 | 74642, 105146, 135650, 166154, 196658 |
| 6619 | AEA72759 | 6619 | 37123 | 67627, 98131, 128635, 159139, 189643 | 13635 | ALN39689 | 13635 | 44139 | 74643, 105147, 135651, 166155, 196659 |
| 6620 | AEA72777 | 6620 | 37124 | 67628, 98132, 128636, 159140, 189644 | 13636 | ALN39690 | 13636 | 44140 | 74644, 105148, 135652, 166156, 196660 |
| 6621 | AEA72787 | 6621 | 37125 | 67629, 98133, 128637, 159141, 189645 | 13637 | ALN39691 | 13637 | 44141 | 74645, 105149, 135653, 166157, 196661 |
| 6622 | AEA73288 | 6622 | 37126 | 67630, 98134, 128638, 159142, 189646 | 13638 | ALN39692 | 13638 | 44142 | 74646, 105150, 135654, 166158, 196662 |
| 6623 | AEA73299 | 6623 | 37127 | 67631, 98135, 128639, 159143, 189647 | 13639 | ALN39693 | 13639 | 44143 | 74647, 105151, 135655, 166159, 196663 |
| 6624 | AEA73310 | 6624 | 37128 | 67632, 98136, 128640, 159144, 189648 | 13640 | ALN39694 | 13640 | 44144 | 74648, 105152, 135656, 166160, 196664 |
| 6625 | AEA73321 | 6625 | 37129 | 67633, 98137, 128641, 159145, 189649 | 13641 | ALN39695 | 13641 | 44145 | 74649, 105153, 135657, 166161, 196665 |
| 6626 | AEA73332 | 6626 | 37130 | 67634, 98138, 128642, 159146, 189650 | 13642 | ALN39696 | 13642 | 44146 | 74650, 105154, 135658, 166162, 196666 |
| 6627 | AEA73343 | 6627 | 37131 | 67635, 98139, 128643, 159147, 189651 | 13643 | ALN39697 | 13643 | 44147 | 74651, 105155, 135659, 166163, 196667 |
| 6628 | AEA73354 | 6628 | 37132 | 67636, 98140, 128644, 159148, 189652 | 13644 | ALN39698 | 13644 | 44148 | 74652, 105156, 135660, 166164, 196668 |
| 6629 | AEA73365 | 6629 | 37133 | 67637, 98141, 128645, 159149, 189653 | 13645 | ALN39700 | 13645 | 44149 | 74653, 105157, 135661, 166165, 196669 |
| 6630 | AEA73376 | 6630 | 37134 | 67638, 98142, 128646, 159150, 189654 | 13646 | ALN39701 | 13646 | 44150 | 74654, 105158, 135662, 166166, 196670 |
| 6631 | AEA73387 | 6631 | 37135 | 67639, 98143, 128647, 159151, 189655 | 13647 | ALN39702 | 13647 | 44151 | 74655, 105159, 135663, 166167, 196671 |
| 6632 | AEA73398 | 6632 | 37136 | 67640, 98144, 128648, 159152, 189656 | 13648 | ALN39703 | 13648 | 44152 | 74656, 105160, 135664, 166168, 196672 |
| 6633 | AEA73409 | 6633 | 37137 | 67641, 98145, 128649, 159153, 189657 | 13649 | ALN39704 | 13649 | 44153 | 74657, 105161, 135665, 166169, 196673 |
| 6634 | AEA73420 | 6634 | 37138 | 67642, 98146, 128650, 159154, 189658 | 13650 | ALN39705 | 13650 | 44154 | 74658, 105162, 135666, 166170, 196674 |
| 6635 | AEA73452 | 6635 | 37139 | 67643, 98147, 128651, 159155, 189659 | 13651 | ALN39706 | 13651 | 44155 | 74659, 105163, 135667, 166171, 196675 |

FIG. 1 continued

| | | | | | | | | | |
|---|---|---|---|---|---|---|---|---|---|
| 6636 | AEA73463 | 6636 | 37140 | 67644, 98148, 128652, 159156, 189660 | 13652 | ALN39707 | 13652 | 44156 | 74660, 105164, 135668, 166172, 196676 |
| 6637 | AEA73474 | 6637 | 37141 | 67645, 98149, 128653, 159157, 189661 | 13653 | ALN39708 | 13653 | 44157 | 74661, 105165, 135669, 166173, 196677 |
| 6638 | AEA73485 | 6638 | 37142 | 67646, 98150, 128654, 159158, 189662 | 13654 | ALN39709 | 13654 | 44158 | 74662, 105166, 135670, 166174, 196678 |
| 6639 | AEA73496 | 6639 | 37143 | 67647, 98151, 128655, 159159, 189663 | 13655 | ALN39710 | 13655 | 44159 | 74663, 105167, 135671, 166175, 196679 |
| 6640 | AEA73507 | 6640 | 37144 | 67648, 98152, 128656, 159160, 189664 | 13656 | ALN39711 | 13656 | 44160 | 74664, 105168, 135672, 166176, 196680 |
| 6641 | AEA73518 | 6641 | 37145 | 67649, 98153, 128657, 159161, 189665 | 13657 | ALN39712 | 13657 | 44161 | 74665, 105169, 135673, 166177, 196681 |
| 6642 | AEA73529 | 6642 | 37146 | 67650, 98154, 128658, 159162, 189666 | 13658 | ALN39713 | 13658 | 44162 | 74666, 105170, 135674, 166178, 196682 |
| 6643 | AEA73540 | 6643 | 37147 | 67651, 98155, 128659, 159163, 189667 | 13659 | ALN39714 | 13659 | 44163 | 74667, 105171, 135675, 166179, 196683 |
| 6644 | AEA73551 | 6644 | 37148 | 67652, 98156, 128660, 159164, 189668 | 13660 | ALN39715 | 13660 | 44164 | 74668, 105172, 135676, 166180, 196684 |
| 6645 | AEA73562 | 6645 | 37149 | 67653, 98157, 128661, 159165, 189669 | 13661 | ALN39716 | 13661 | 44165 | 74669, 105173, 135677, 166181, 196685 |
| 6646 | AEA73573 | 6646 | 37150 | 67654, 98158, 128662, 159166, 189670 | 13662 | ALN39717 | 13662 | 44166 | 74670, 105174, 135678, 166182, 196686 |
| 6647 | AEA73584 | 6647 | 37151 | 67655, 98159, 128663, 159167, 189671 | 13663 | ALN39718 | 13663 | 44167 | 74671, 105175, 135679, 166183, 196687 |
| 6648 | AEA73595 | 6648 | 37152 | 67656, 98160, 128664, 159168, 189672 | 13664 | ALN39734 | 13664 | 44168 | 74672, 105176, 135680, 166184, 196688 |
| 6649 | AEA73606 | 6649 | 37153 | 67657, 98161, 128665, 159169, 189673 | 13665 | ALN39735 | 13665 | 44169 | 74673, 105177, 135681, 166185, 196689 |
| 6650 | AEA73617 | 6650 | 37154 | 67658, 98162, 128666, 159170, 189674 | 13666 | ALN39736 | 13666 | 44170 | 74674, 105178, 135682, 166186, 196690 |
| 6651 | AEA73628 | 6651 | 37155 | 67659, 98163, 128667, 159171, 189675 | 13667 | ALN39737 | 13667 | 44171 | 74675, 105179, 135683, 166187, 196691 |
| 6652 | AEA73639 | 6652 | 37156 | 67660, 98164, 128668, 159172, 189676 | 13668 | ALN39738 | 13668 | 44172 | 74676, 105180, 135684, 166188, 196692 |
| 6653 | AEA73650 | 6653 | 37157 | 67661, 98165, 128669, 159173, 189677 | 13669 | ALN39739 | 13669 | 44173 | 74677, 105181, 135685, 166189, 196693 |

FIG. 1 continued

| | | | | | | | | | |
|---|---|---|---|---|---|---|---|---|---|
| 6654 | AEA73661 | 6654 | 37158 | 67662, 98166, 128670, 159174, 189678 | 13670 | ALN39740 | 13670 | 44174 | 74678, 105182, 135686, 166190, 196694 |
| 6655 | AEA73672 | 6655 | 37159 | 67663, 98167, 128671, 159175, 189679 | 13671 | ALN39741 | 13671 | 44175 | 74679, 105183, 135687, 166191, 196695 |
| 6656 | AEA73683 | 6656 | 37160 | 67664, 98168, 128672, 159176, 189680 | 13672 | ALN39742 | 13672 | 44176 | 74680, 105184, 135688, 166192, 196696 |
| 6657 | AEA73694 | 6657 | 37161 | 67665, 98169, 128673, 159177, 189681 | 13673 | ALN39743 | 13673 | 44177 | 74681, 105185, 135689, 166193, 196697 |
| 6658 | AEA73705 | 6658 | 37162 | 67666, 98170, 128674, 159178, 189682 | 13674 | ALN39744 | 13674 | 44178 | 74682, 105186, 135690, 166194, 196698 |
| 6659 | AEA73716 | 6659 | 37163 | 67667, 98171, 128675, 159179, 189683 | 13675 | ALN39745 | 13675 | 44179 | 74683, 105187, 135691, 166195, 196699 |
| 6660 | AEA73727 | 6660 | 37164 | 67668, 98172, 128676, 159180, 189684 | 13676 | ALN39746 | 13676 | 44180 | 74684, 105188, 135692, 166196, 196700 |
| 6661 | AEA73738 | 6661 | 37165 | 67669, 98173, 128677, 159181, 189685 | 13677 | ALN39747 | 13677 | 44181 | 74685, 105189, 135693, 166197, 196701 |
| 6662 | AEA73749 | 6662 | 37166 | 67670, 98174, 128678, 159182, 189686 | 13678 | ALN39748 | 13678 | 44182 | 74686, 105190, 135694, 166198, 196702 |
| 6663 | AEA73760 | 6663 | 37167 | 67671, 98175, 128679, 159183, 189687 | 13679 | ALN39749 | 13679 | 44183 | 74687, 105191, 135695, 166199, 196703 |
| 6664 | AEA73771 | 6664 | 37168 | 67672, 98176, 128680, 159184, 189688 | 13680 | ALN39750 | 13680 | 44184 | 74688, 105192, 135696, 166200, 196704 |
| 6665 | AEA73781 | 6665 | 37169 | 67673, 98177, 128681, 159185, 189689 | 13681 | ALN39789 | 13681 | 44185 | 74689, 105193, 135697, 166201, 196705 |
| 6666 | AEA73791 | 6666 | 37170 | 67674, 98178, 128682, 159186, 189690 | 13682 | ALO75895 | 13682 | 44186 | 74690, 105194, 135698, 166202, 196706 |
| 6667 | AEA73801 | 6667 | 37171 | 67675, 98179, 128683, 159187, 189691 | 13683 | ALO75907 | 13683 | 44187 | 74691, 105195, 135699, 166203, 196707 |
| 6668 | AEA73811 | 6668 | 37172 | 67676, 98180, 128684, 159188, 189692 | 13684 | ALO75919 | 13684 | 44188 | 74692, 105196, 135700, 166204, 196708 |
| 6669 | AEA73821 | 6669 | 37173 | 67677, 98181, 128685, 159189, 189693 | 13685 | ALT20080 | 13685 | 44189 | 74693, 105197, 135701, 166205, 196709 |
| 6670 | AEA73831 | 6670 | 37174 | 67678, 98182, 128686, 159190, 189694 | 13686 | ALT66860 | 13686 | 44190 | 74694, 105198, 135702, 166206, 196710 |
| 6671 | AEA73841 | 6671 | 37175 | 67679, 98183, 128687, 159191, 189695 | 13687 | AMA65391 | 13687 | 44191 | 74695, 105199, 135703, 166207, 196711 |

FIG. 1 continued

| | | | | | | | | | |
|---|---|---|---|---|---|---|---|---|---|
| 6672 | AEA73851 | 6672 | 37176 | 67680, 98184, 128688, 159192, 189696 | 13688 | AMA65393 | 13688 | 44192 | 74696, 105200, 135704, 166208, 196712 |
| 6673 | AEA73861 | 6673 | 37177 | 67681, 98185, 128689, 159193, 189697 | 13689 | BAA02768 | 13689 | 44193 | 74697, 105201, 135705, 166209, 196713 |
| 6674 | AEA73871 | 6674 | 37178 | 67682, 98186, 128690, 159194, 189698 | 13690 | BAA02769 | 13690 | 44194 | 74698, 105202, 135706, 166210, 196714 |
| 6675 | AEA73881 | 6675 | 37179 | 67683, 98187, 128691, 159195, 189699 | 13691 | BAC43764 | 13691 | 44195 | 74699, 105203, 135707, 166211, 196715 |
| 6676 | AEA73891 | 6676 | 37180 | 67684, 98188, 128692, 159196, 189700 | 13692 | BAE07201 | 13692 | 44196 | 74700, 105204, 135708, 166212, 196716 |
| 6677 | AEA73901 | 6677 | 37181 | 67685, 98189, 128693, 159197, 189701 | 13693 | BAH95823 | 13693 | 44197 | 74701, 105205, 135709, 166213, 196717 |
| 6678 | AEA73911 | 6678 | 37182 | 67686, 98190, 128694, 159198, 189702 | 13694 | BAH95824 | 13694 | 44198 | 74702, 105206, 135710, 166214, 196718 |
| 6679 | AEA73921 | 6679 | 37183 | 67687, 98191, 128695, 159199, 189703 | 13695 | BAJ07997 | 13695 | 44199 | 74703, 105207, 135711, 166215, 196719 |
| 6680 | AEA73931 | 6680 | 37184 | 67688, 98192, 128696, 159200, 189704 | 13696 | BAJ39949 | 13696 | 44200 | 74704, 105208, 135712, 166216, 196720 |
| 6681 | AEA73961 | 6681 | 37185 | 67689, 98193, 128697, 159201, 189705 | 13697 | BAJ39950 | 13697 | 44201 | 74705, 105209, 135713, 166217, 196721 |
| 6682 | AEA73971 | 6682 | 37186 | 67690, 98194, 128698, 159202, 189706 | 13698 | BAJ39951 | 13698 | 44202 | 74706, 105210, 135714, 166218, 196722 |
| 6683 | AEA73981 | 6683 | 37187 | 67691, 98195, 128699, 159203, 189707 | 13699 | BAJ39952 | 13699 | 44203 | 74707, 105211, 135715, 166219, 196723 |
| 6684 | AEA73991 | 6684 | 37188 | 67692, 98196, 128700, 159204, 189708 | 13700 | BAJ39953 | 13700 | 44204 | 74708, 105212, 135716, 166220, 196724 |
| 6685 | AEA74001 | 6685 | 37189 | 67693, 98197, 128701, 159205, 189709 | 13701 | BAJ39954 | 13701 | 44205 | 74709, 105213, 135717, 166221, 196725 |
| 6686 | AEA74011 | 6686 | 37190 | 67694, 98198, 128702, 159206, 189710 | 13702 | BAJ39955 | 13702 | 44206 | 74710, 105214, 135718, 166222, 196726 |
| 6687 | AEA74021 | 6687 | 37191 | 67695, 98199, 128703, 159207, 189711 | 13703 | BAJ39956 | 13703 | 44207 | 74711, 105215, 135719, 166223, 196727 |
| 6688 | AEA74031 | 6688 | 37192 | 67696, 98200, 128704, 159208, 189712 | 13704 | BAJ39957 | 13704 | 44208 | 74712, 105216, 135720, 166224, 196728 |
| 6689 | AEA74035 | 6689 | 37193 | 67697, 98201, 128705, 159209, 189713 | 13705 | BAJ39958 | 13705 | 44209 | 74713, 105217, 135721, 166225, 196729 |

FIG. 1 continued

| | | | | | | | | | |
|---|---|---|---|---|---|---|---|---|---|
| 6690 | AEA77299 | 6690 | 37194 | 67698, 98202, 128706, 159210, 189714 | 13706 | BAJ39959 | 13706 | 44210 | 74714, 105218, 135722, 166226, 196730 |
| 6691 | AEB21316 | 6691 | 37195 | 67699, 98203, 128707, 159211, 189715 | 13707 | BAJ39960 | 13707 | 44211 | 74715, 105219, 135723, 166227, 196731 |
| 6692 | AEB21326 | 6692 | 37196 | 67700, 98204, 128708, 159212, 189716 | 13708 | BAJ39961 | 13708 | 44212 | 74716, 105220, 135724, 166228, 196732 |
| 6693 | AEB21338 | 6693 | 37197 | 67701, 98205, 128709, 159213, 189717 | 13709 | BAJ39962 | 13709 | 44213 | 74717, 105221, 135725, 166229, 196733 |
| 6694 | AEB21348 | 6694 | 37198 | 67702, 98206, 128710, 159214, 189718 | 13710 | BAJ39963 | 13710 | 44214 | 74718, 105222, 135726, 166230, 196734 |
| 6695 | AEB40206 | 6695 | 37199 | 67703, 98207, 128711, 159215, 189719 | 13711 | BAJ39964 | 13711 | 44215 | 74719, 105223, 135727, 166231, 196735 |
| 6696 | AEB66895 | 6696 | 37200 | 67704, 98208, 128712, 159216, 189720 | 13712 | BAJ39965 | 13712 | 44216 | 74720, 105224, 135728, 166232, 196736 |
| 6697 | AEB71102 | 6697 | 37201 | 67705, 98209, 128713, 159217, 189721 | 13713 | BAJ39966 | 13713 | 44217 | 74721, 105225, 135729, 166233, 196737 |
| 6698 | AEB71896 | 6698 | 37202 | 67706, 98210, 128714, 159218, 189722 | 13714 | BAJ39967 | 13714 | 44218 | 74722, 105226, 135730, 166234, 196738 |
| 6699 | AEB71916 | 6699 | 37203 | 67707, 98211, 128715, 159219, 189723 | 13715 | BAJ39968 | 13715 | 44219 | 74723, 105227, 135731, 166235, 196739 |
| 6700 | AEB71925 | 6700 | 37204 | 67708, 98212, 128716, 159220, 189724 | 13716 | BAJ39969 | 13716 | 44220 | 74724, 105228, 135732, 166236, 196740 |
| 6701 | AEB71936 | 6701 | 37205 | 67709, 98213, 128717, 159221, 189725 | 13717 | BAJ39970 | 13717 | 44221 | 74725, 105229, 135733, 166237, 196741 |
| 6702 | AEB71947 | 6702 | 37206 | 67710, 98214, 128718, 159222, 189726 | 13718 | BAJ39971 | 13718 | 44222 | 74726, 105230, 135734, 166238, 196742 |
| 6703 | AEB71958 | 6703 | 37207 | 67711, 98215, 128719, 159223, 189727 | 13719 | BAJ39972 | 13719 | 44223 | 74727, 105231, 135735, 166239, 196743 |
| 6704 | AEB71969 | 6704 | 37208 | 67712, 98216, 128720, 159224, 189728 | 13720 | BAJ39973 | 13720 | 44224 | 74728, 105232, 135736, 166240, 196744 |
| 6705 | AEB71980 | 6705 | 37209 | 67713, 98217, 128721, 159225, 189729 | 13721 | BAJ39974 | 13721 | 44225 | 74729, 105233, 135737, 166241, 196745 |
| 6706 | AEB71992 | 6706 | 37210 | 67714, 98218, 128722, 159226, 189730 | 13722 | BAJ39975 | 13722 | 44226 | 74730, 105234, 135738, 166242, 196746 |
| 6707 | AEC13313 | 6707 | 37211 | 67715, 98219, 128723, 159227, 189731 | 13723 | BAJ39976 | 13723 | 44227 | 74731, 105235, 135739, 166243, 196747 |

FIG. 1 continued

| | | | | | | | | | |
|---|---|---|---|---|---|---|---|---|---|
| 6708 | AEC46553 | 6708 | 37212 | 67716, 98220, 128724, 159228, 189732 | 13724 | BAJ39977 | 13724 | 44228 | 74732, 105236, 135740, 166244, 196748 |
| 6709 | AEC46555 | 6709 | 37213 | 67717, 98221, 128725, 159229, 189733 | 13725 | BAJ39978 | 13725 | 44229 | 74733, 105237, 135741, 166245, 196749 |
| 6710 | AEC46557 | 6710 | 37214 | 67718, 98222, 128726, 159230, 189734 | 13726 | BAJ39979 | 13726 | 44230 | 74734, 105238, 135742, 166246, 196750 |
| 6711 | AEC53259 | 6711 | 37215 | 67719, 98223, 128727, 159231, 189735 | 13727 | BAJ39980 | 13727 | 44231 | 74735, 105239, 135743, 166247, 196751 |
| 6712 | AEC53269 | 6712 | 37216 | 67720, 98224, 128728, 159232, 189736 | 13728 | BAJ39981 | 13728 | 44232 | 74736, 105240, 135744, 166248, 196752 |
| 6713 | AEC53279 | 6713 | 37217 | 67721, 98225, 128729, 159233, 189737 | 13729 | BAJ39982 | 13729 | 44233 | 74737, 105241, 135745, 166249, 196753 |
| 6714 | AEC53289 | 6714 | 37218 | 67722, 98226, 128730, 159234, 189738 | 13730 | BAJ39983 | 13730 | 44234 | 74738, 105242, 135746, 166250, 196754 |
| 6715 | AEC53299 | 6715 | 37219 | 67723, 98227, 128731, 159235, 189739 | 13731 | BAJ39984 | 13731 | 44235 | 74739, 105243, 135747, 166251, 196755 |
| 6716 | AEC53327 | 6716 | 37220 | 67724, 98228, 128732, 159236, 189740 | 13732 | BAJ39985 | 13732 | 44236 | 74740, 105244, 135748, 166252, 196756 |
| 6717 | AEC53347 | 6717 | 37221 | 67725, 98229, 128733, 159237, 189741 | 13733 | BAJ39987 | 13733 | 44237 | 74741, 105245, 135749, 166253, 196757 |
| 6718 | AEC53404 | 6718 | 37222 | 67726, 98230, 128734, 159238, 189742 | 13734 | BAJ39988 | 13734 | 44238 | 74742, 105246, 135750, 166254, 196758 |
| 6719 | AEC53414 | 6719 | 37223 | 67727, 98231, 128735, 159239, 189743 | 13735 | BAJ39989 | 13735 | 44239 | 74743, 105247, 135751, 166255, 196759 |
| 6720 | AEE27177 | 6720 | 37224 | 67728, 98232, 128736, 159240, 189744 | 13736 | BAJ39990 | 13736 | 44240 | 74744, 105248, 135752, 166256, 196760 |
| 6721 | AEE27187 | 6721 | 37225 | 67729, 98233, 128737, 159241, 189745 | 13737 | BAJ39993 | 13737 | 44241 | 74745, 105249, 135753, 166257, 196761 |
| 6722 | AEE27207 | 6722 | 37226 | 67730, 98234, 128738, 159242, 189746 | 13738 | BAJ39994 | 13738 | 44242 | 74746, 105250, 135754, 166258, 196762 |
| 6723 | AEG64752 | 6723 | 37227 | 67731, 98235, 128739, 159243, 189747 | 13739 | BAJ39996 | 13739 | 44243 | 74747, 105251, 135755, 166259, 196763 |
| 6724 | AEG64762 | 6724 | 37228 | 67732, 98236, 128740, 159244, 189748 | 13740 | BAJ39997 | 13740 | 44244 | 74748, 105252, 135756, 166260, 196764 |
| 6725 | AEG64784 | 6725 | 37229 | 67733, 98237, 128741, 159245, 189749 | 13741 | BAJ39998 | 13741 | 44245 | 74749, 105253, 135757, 166261, 196765 |

FIG. 1 continued

| | | | | | | | | | |
|---|---|---|---|---|---|---|---|---|---|
| 6726 | AEG64834 | 6726 | 37230 | 67734, 98238, 128742, 159246, 189750 | 13742 | BAJ39999 | 13742 | 44246 | 74750, 105254, 135758, 166262, 196766 |
| 6727 | AEG64845 | 6727 | 37231 | 67735, 98239, 128743, 159247, 189751 | 13743 | BAJ40000 | 13743 | 44247 | 74751, 105255, 135759, 166263, 196767 |
| 6728 | AEG64856 | 6728 | 37232 | 67736, 98240, 128744, 159248, 189752 | 13744 | BAJ40001 | 13744 | 44248 | 74752, 105256, 135760, 166264, 196768 |
| 6729 | AEG64867 | 6729 | 37233 | 67737, 98241, 128745, 159249, 189753 | 13745 | BAJ40002 | 13745 | 44249 | 74753, 105257, 135761, 166265, 196769 |
| 6730 | AEG64878 | 6730 | 37234 | 67738, 98242, 128746, 159250, 189754 | 13746 | BAJ40003 | 13746 | 44250 | 74754, 105258, 135762, 166266, 196770 |
| 6731 | AEG64889 | 6731 | 37235 | 67739, 98243, 128747, 159251, 189755 | 13747 | BAJ40004 | 13747 | 44251 | 74755, 105259, 135763, 166267, 196771 |
| 6732 | AEG64911 | 6732 | 37236 | 67740, 98244, 128748, 159252, 189756 | 13748 | BAJ40006 | 13748 | 44252 | 74756, 105260, 135764, 166268, 196772 |
| 6733 | AEG64922 | 6733 | 37237 | 67741, 98245, 128749, 159253, 189757 | 13749 | BAJ40007 | 13749 | 44253 | 74757, 105261, 135765, 166269, 196773 |
| 6734 | AEG64933 | 6734 | 37238 | 67742, 98246, 128750, 159254, 189758 | 13750 | BAJ40008 | 13750 | 44254 | 74758, 105262, 135766, 166270, 196774 |
| 6735 | AEG64944 | 6735 | 37239 | 67743, 98247, 128751, 159255, 189759 | 13751 | BAJ40009 | 13751 | 44255 | 74759, 105263, 135767, 166271, 196775 |
| 6736 | AEG64955 | 6736 | 37240 | 67744, 98248, 128752, 159256, 189760 | 13752 | BAJ40010 | 13752 | 44256 | 74760, 105264, 135768, 166272, 196776 |
| 6737 | AEG64966 | 6737 | 37241 | 67745, 98249, 128753, 159257, 189761 | 13753 | BAJ40011 | 13753 | 44257 | 74761, 105265, 135769, 166273, 196777 |
| 6738 | AEG64977 | 6738 | 37242 | 67746, 98250, 128754, 159258, 189762 | 13754 | BAJ40012 | 13754 | 44258 | 74762, 105266, 135770, 166274, 196778 |
| 6739 | AEG64988 | 6739 | 37243 | 67747, 98251, 128755, 159259, 189763 | 13755 | BAJ40013 | 13755 | 44259 | 74763, 105267, 135771, 166275, 196779 |
| 6740 | AEG64999 | 6740 | 37244 | 67748, 98252, 128756, 159260, 189764 | 13756 | BAJ40014 | 13756 | 44260 | 74764, 105268, 135772, 166276, 196780 |
| 6741 | AEG65010 | 6741 | 37245 | 67749, 98253, 128757, 159261, 189765 | 13757 | BAJ40015 | 13757 | 44261 | 74765, 105269, 135773, 166277, 196781 |
| 6742 | AEG65021 | 6742 | 37246 | 67750, 98254, 128758, 159262, 189766 | 13758 | BAJ40016 | 13758 | 44262 | 74766, 105270, 135774, 166278, 196782 |
| 6743 | AEG65032 | 6743 | 37247 | 67751, 98255, 128759, 159263, 189767 | 13759 | BAJ40017 | 13759 | 44263 | 74767, 105271, 135775, 166279, 196783 |

FIG. 1 continued

| | | | | | | | | | |
|---|---|---|---|---|---|---|---|---|---|
| 6744 | AEG65043 | 6744 | 37248 | 67752, 98256, 128760, 159264, 189768 | 13760 | BAJ40018 | 13760 | 44264 | 74768, 105272, 135776, 166280, 196784 |
| 6745 | AEG65054 | 6745 | 37249 | 67753, 98257, 128761, 159265, 189769 | 13761 | BAJ40019 | 13761 | 44265 | 74769, 105273, 135777, 166281, 196785 |
| 6746 | AEG65065 | 6746 | 37250 | 67754, 98258, 128762, 159266, 189770 | 13762 | BAJ40020 | 13762 | 44266 | 74770, 105274, 135778, 166282, 196786 |
| 6747 | AEG65076 | 6747 | 37251 | 67755, 98259, 128763, 159267, 189771 | 13763 | BAJ40021 | 13763 | 44267 | 74771, 105275, 135779, 166283, 196787 |
| 6748 | AEG65087 | 6748 | 37252 | 67756, 98260, 128764, 159268, 189772 | 13764 | BAJ40023 | 13764 | 44268 | 74772, 105276, 135780, 166284, 196788 |
| 6749 | AEG65098 | 6749 | 37253 | 67757, 98261, 128765, 159269, 189773 | 13765 | BAJ40024 | 13765 | 44269 | 74773, 105277, 135781, 166285, 196789 |
| 6750 | AEG65109 | 6750 | 37254 | 67758, 98262, 128766, 159270, 189774 | 13766 | BAJ40025 | 13766 | 44270 | 74774, 105278, 135782, 166286, 196790 |
| 6751 | AEG65120 | 6751 | 37255 | 67759, 98263, 128767, 159271, 189775 | 13767 | BAJ40026 | 13767 | 44271 | 74775, 105279, 135783, 166287, 196791 |
| 6752 | AEG65131 | 6752 | 37256 | 67760, 98264, 128768, 159272, 189776 | 13768 | BAJ40027 | 13768 | 44272 | 74776, 105280, 135784, 166288, 196792 |
| 6753 | AEG65142 | 6753 | 37257 | 67761, 98265, 128769, 159273, 189777 | 13769 | BAJ40028 | 13769 | 44273 | 74777, 105281, 135785, 166289, 196793 |
| 6754 | AEG65153 | 6754 | 37258 | 67762, 98266, 128770, 159274, 189778 | 13770 | BAJ40029 | 13770 | 44274 | 74778, 105282, 135786, 166290, 196794 |
| 6755 | AEG65164 | 6755 | 37259 | 67763, 98267, 128771, 159275, 189779 | 13771 | BAJ40030 | 13771 | 44275 | 74779, 105283, 135787, 166291, 196795 |
| 6756 | AEG65175 | 6756 | 37260 | 67764, 98268, 128772, 159276, 189780 | 13772 | BAJ40031 | 13772 | 44276 | 74780, 105284, 135788, 166292, 196796 |
| 6757 | AEG65186 | 6757 | 37261 | 67765, 98269, 128773, 159277, 189781 | 13773 | BAJ40032 | 13773 | 44277 | 74781, 105285, 135789, 166293, 196797 |
| 6758 | AEG65197 | 6758 | 37262 | 67766, 98270, 128774, 159278, 189782 | 13774 | BAJ40033 | 13774 | 44278 | 74782, 105286, 135790, 166294, 196798 |
| 6759 | AEG65208 | 6759 | 37263 | 67767, 98271, 128775, 159279, 189783 | 13775 | BAJ40034 | 13775 | 44279 | 74783, 105287, 135791, 166295, 196799 |
| 6760 | AEG65219 | 6760 | 37264 | 67768, 98272, 128776, 159280, 189784 | 13776 | BAJ40035 | 13776 | 44280 | 74784, 105288, 135792, 166296, 196800 |
| 6761 | AEG65230 | 6761 | 37265 | 67769, 98273, 128777, 159281, 189785 | 13777 | BAJ40036 | 13777 | 44281 | 74785, 105289, 135793, 166297, 196801 |

FIG. 1 continued

| | | | | | | | | | |
|---|---|---|---|---|---|---|---|---|---|
| 6762 | AEG65252 | 6762 | 37266 | 67770, 98274, 128778, 159282, 189786 | 13778 | BAJ40037 | 13778 | 44282 | 74786, 105290, 135794, 166298, 196802 |
| 6763 | AEG65263 | 6763 | 37267 | 67771, 98275, 128779, 159283, 189787 | 13779 | BAJ40038 | 13779 | 44283 | 74787, 105291, 135795, 166299, 196803 |
| 6764 | AEG65274 | 6764 | 37268 | 67772, 98276, 128780, 159284, 189788 | 13780 | BAJ40039 | 13780 | 44284 | 74788, 105292, 135796, 166300, 196804 |
| 6765 | AEG65285 | 6765 | 37269 | 67773, 98277, 128781, 159285, 189789 | 13781 | BAJ40040 | 13781 | 44285 | 74789, 105293, 135797, 166301, 196805 |
| 6766 | AEG65296 | 6766 | 37270 | 67774, 98278, 128782, 159286, 189790 | 13782 | BAJ40041 | 13782 | 44286 | 74790, 105294, 135798, 166302, 196806 |
| 6767 | AEG65307 | 6767 | 37271 | 67775, 98279, 128783, 159287, 189791 | 13783 | BAJ40042 | 13783 | 44287 | 74791, 105295, 135799, 166303, 196807 |
| 6768 | AEG65318 | 6768 | 37272 | 67776, 98280, 128784, 159288, 189792 | 13784 | BAJ40043 | 13784 | 44288 | 74792, 105296, 135800, 166304, 196808 |
| 6769 | AEG65329 | 6769 | 37273 | 67777, 98281, 128785, 159289, 189793 | 13785 | BAJ40044 | 13785 | 44289 | 74793, 105297, 135801, 166305, 196809 |
| 6770 | AEG65340 | 6770 | 37274 | 67778, 98282, 128786, 159290, 189794 | 13786 | BAJ40045 | 13786 | 44290 | 74794, 105298, 135802, 166306, 196810 |
| 6771 | AEG65351 | 6771 | 37275 | 67779, 98283, 128787, 159291, 189795 | 13787 | BAJ40046 | 13787 | 44291 | 74795, 105299, 135803, 166307, 196811 |
| 6772 | AEG65362 | 6772 | 37276 | 67780, 98284, 128788, 159292, 189796 | 13788 | BAJ40047 | 13788 | 44292 | 74796, 105300, 135804, 166308, 196812 |
| 6773 | AEG65373 | 6773 | 37277 | 67781, 98285, 128789, 159293, 189797 | 13789 | BAJ40048 | 13789 | 44293 | 74797, 105301, 135805, 166309, 196813 |
| 6774 | AEG65384 | 6774 | 37278 | 67782, 98286, 128790, 159294, 189798 | 13790 | BAJ40050 | 13790 | 44294 | 74798, 105302, 135806, 166310, 196814 |
| 6775 | AEG65406 | 6775 | 37279 | 67783, 98287, 128791, 159295, 189799 | 13791 | BAJ40051 | 13791 | 44295 | 74799, 105303, 135807, 166311, 196815 |
| 6776 | AEG65417 | 6776 | 37280 | 67784, 98288, 128792, 159296, 189800 | 13792 | BAJ40052 | 13792 | 44296 | 74800, 105304, 135808, 166312, 196816 |
| 6777 | AEG65428 | 6777 | 37281 | 67785, 98289, 128793, 159297, 189801 | 13793 | BAJ40053 | 13793 | 44297 | 74801, 105305, 135809, 166313, 196817 |
| 6778 | AEG65439 | 6778 | 37282 | 67786, 98290, 128794, 159298, 189802 | 13794 | BAJ40054 | 13794 | 44298 | 74802, 105306, 135810, 166314, 196818 |
| 6779 | AEG65450 | 6779 | 37283 | 67787, 98291, 128795, 159299, 189803 | 13795 | BAJ40055 | 13795 | 44299 | 74803, 105307, 135811, 166315, 196819 |

FIG. 1 continued

| | | | | | | | | | |
|---|---|---|---|---|---|---|---|---|---|
| 6780 | AEG65461 | 6780 | 37284 | 67788, 98292, 128796, 159300, 189804 | 13796 | BAJ40056 | 13796 | 44300 | 74804, 105308, 135812, 166316, 196820 |
| 6781 | AEG65472 | 6781 | 37285 | 67789, 98293, 128797, 159301, 189805 | 13797 | BAJ40057 | 13797 | 44301 | 74805, 105309, 135813, 166317, 196821 |
| 6782 | AEG65483 | 6782 | 37286 | 67790, 98294, 128798, 159302, 189806 | 13798 | BAJ40058 | 13798 | 44302 | 74806, 105310, 135814, 166318, 196822 |
| 6783 | AEG65494 | 6783 | 37287 | 67791, 98295, 128799, 159303, 189807 | 13799 | BAJ40059 | 13799 | 44303 | 74807, 105311, 135815, 166319, 196823 |
| 6784 | AEG65505 | 6784 | 37288 | 67792, 98296, 128800, 159304, 189808 | 13800 | BAJ40060 | 13800 | 44304 | 74808, 105312, 135816, 166320, 196824 |
| 6785 | AEG65516 | 6785 | 37289 | 67793, 98297, 128801, 159305, 189809 | 13801 | BAJ40061 | 13801 | 44305 | 74809, 105313, 135817, 166321, 196825 |
| 6786 | AEG65527 | 6786 | 37290 | 67794, 98298, 128802, 159306, 189810 | 13802 | BAJ40062 | 13802 | 44306 | 74810, 105314, 135818, 166322, 196826 |
| 6787 | AEG65538 | 6787 | 37291 | 67795, 98299, 128803, 159307, 189811 | 13803 | BAJ40063 | 13803 | 44307 | 74811, 105315, 135819, 166323, 196827 |
| 6788 | AEG65560 | 6788 | 37292 | 67796, 98300, 128804, 159308, 189812 | 13804 | BAJ40064 | 13804 | 44308 | 74812, 105316, 135820, 166324, 196828 |
| 6789 | AEG65571 | 6789 | 37293 | 67797, 98301, 128805, 159309, 189813 | 13805 | BAK23398 | 13805 | 44309 | 74813, 105317, 135821, 166325, 196829 |
| 6790 | AEG65582 | 6790 | 37294 | 67798, 98302, 128806, 159310, 189814 | 13806 | BAK23400 | 13806 | 44310 | 74814, 105318, 135822, 166326, 196830 |
| 6791 | AEG65593 | 6791 | 37295 | 67799, 98303, 128807, 159311, 189815 | 13807 | BAK23401 | 13807 | 44311 | 74815, 105319, 135823, 166327, 196831 |
| 6792 | AEG65604 | 6792 | 37296 | 67800, 98304, 128808, 159312, 189816 | 13808 | BAK23402 | 13808 | 44312 | 74816, 105320, 135824, 166328, 196832 |
| 6793 | AEG65626 | 6793 | 37297 | 67801, 98305, 128809, 159313, 189817 | 13809 | BAK23403 | 13809 | 44313 | 74817, 105321, 135825, 166329, 196833 |
| 6794 | AEG65637 | 6794 | 37298 | 67802, 98306, 128810, 159314, 189818 | 13810 | BAK23404 | 13810 | 44314 | 74818, 105322, 135826, 166330, 196834 |
| 6795 | AEG65648 | 6795 | 37299 | 67803, 98307, 128811, 159315, 189819 | 13811 | BAK23405 | 13811 | 44315 | 74819, 105323, 135827, 166331, 196835 |
| 6796 | AEG65659 | 6796 | 37300 | 67804, 98308, 128812, 159316, 189820 | 13812 | BAK23406 | 13812 | 44316 | 74820, 105324, 135828, 166332, 196836 |
| 6797 | AEG65670 | 6797 | 37301 | 67805, 98309, 128813, 159317, 189821 | 13813 | BAK23407 | 13813 | 44317 | 74821, 105325, 135829, 166333, 196837 |

FIG. 1 continued

| | | | | | | | | | |
|---|---|---|---|---|---|---|---|---|---|
| 6798 | AEG65681 | 6798 | 37302 | 67806, 98310, 128814, 159318, 189822 | 13814 | BAK23408 | 13814 | 44318 | 74822, 105326, 135830, 166334, 196838 |
| 6799 | AEG65692 | 6799 | 37303 | 67807, 98311, 128815, 159319, 189823 | 13815 | BAK23411 | 13815 | 44319 | 74823, 105327, 135831, 166335, 196839 |
| 6800 | AEG65703 | 6800 | 37304 | 67808, 98312, 128816, 159320, 189824 | 13816 | BAK23412 | 13816 | 44320 | 74824, 105328, 135832, 166336, 196840 |
| 6801 | AEG65747 | 6801 | 37305 | 67809, 98313, 128817, 159321, 189825 | 13817 | BAK23413 | 13817 | 44321 | 74825, 105329, 135833, 166337, 196841 |
| 6802 | AEG65758 | 6802 | 37306 | 67810, 98314, 128818, 159322, 189826 | 13818 | BAK23414 | 13818 | 44322 | 74826, 105330, 135834, 166338, 196842 |
| 6803 | AEG65769 | 6803 | 37307 | 67811, 98315, 128819, 159323, 189827 | 13819 | BAM65746 | 13819 | 44323 | 74827, 105331, 135835, 166339, 196843 |
| 6804 | AEG65780 | 6804 | 37308 | 67812, 98316, 128820, 159324, 189828 | 13820 | BAO79716 | 13820 | 44324 | 74828, 105332, 135836, 166340, 196844 |
| 6805 | AEG65813 | 6805 | 37309 | 67813, 98317, 128821, 159325, 189829 | 13821 | CAB95856 | 13821 | 44325 | 74829, 105333, 135837, 166341, 196845 |
| 6806 | AEG79801 | 6806 | 37310 | 67814, 98318, 128822, 159326, 189830 | 13822 | CAB95857 | 13822 | 44326 | 74830, 105334, 135838, 166342, 196846 |
| 6807 | AEG79807 | 6807 | 37311 | 67815, 98319, 128823, 159327, 189831 | 13823 | CBW54815 | 13823 | 44327 | 74831, 105335, 135839, 166343, 196847 |
| 6808 | AEG79835 | 6808 | 37312 | 67816, 98320, 128824, 159328, 189832 | 13824 | CBW54817 | 13824 | 44328 | 74832, 105336, 135840, 166344, 196848 |
| 6809 | AEH59363 | 6809 | 37313 | 67817, 98321, 128825, 159329, 189833 | 13825 | CBW54818 | 13825 | 44329 | 74833, 105337, 135841, 166345, 196849 |
| 6810 | AEH59367 | 6810 | 37314 | 67818, 98322, 128826, 159330, 189834 | 13826 | CCG47908 | 13826 | 44330 | 74834, 105338, 135842, 166346, 196850 |
| 6811 | AEH59369 | 6811 | 37315 | 67819, 98323, 128827, 159331, 189835 | 13827 | AAB39851 | 13827 | 44331 | 74835, 105339, 135843, 166347, 196851 |
| 6812 | AEH59371 | 6812 | 37316 | 67820, 98324, 128828, 159332, 189836 | 13828 | AAA43178 | 13828 | 44332 | 74836, 105340, 135844, 166348, 196852 |
| 6813 | AEH59373 | 6813 | 37317 | 67821, 98325, 128829, 159333, 189837 | 13829 | AAA43185 | 13829 | 44333 | 74837, 105341, 135845, 166349, 196853 |
| 6814 | AEH59375 | 6814 | 37318 | 67822, 98326, 128830, 159334, 189838 | 13830 | AAA43187 | 13830 | 44334 | 74838, 105342, 135846, 166350, 196854 |
| 6815 | AEH59379 | 6815 | 37319 | 67823, 98327, 128831, 159335, 189839 | 13831 | AAA43209 | 13831 | 44335 | 74839, 105343, 135847, 166351, 196855 |

FIG. 1 continued

| | | | | | | | | | |
|---|---|---|---|---|---|---|---|---|---|
| 6816 | AEH59381 | 6816 | 37320 | 67824, 98328, 128832, 159336, 189840 | 13832 | AAC40998 | 13832 | 44336 | 74840, 105344, 135848, 166352, 196856 |
| 6817 | AEH59383 | 6817 | 37321 | 67825, 98329, 128833, 159337, 189841 | 13833 | AAC40999 | 13833 | 44337 | 74841, 105345, 135849, 166353, 196857 |
| 6818 | AEH59385 | 6818 | 37322 | 67826, 98330, 128834, 159338, 189842 | 13834 | ACA28844 | 13834 | 44338 | 74842, 105346, 135850, 166354, 196858 |
| 6819 | AEH59387 | 6819 | 37323 | 67827, 98331, 128835, 159339, 189843 | 13835 | ACA28844/ml | 13835 | 44339 | 74843, 105347, 135851, 166355, 196859 |
| 6820 | AEH59393 | 6820 | 37324 | 67828, 98332, 128836, 159340, 189844 | 13836 | ACV82259 | 13836 | 44340 | 74844, 105348, 135852, 166356, 196860 |
| 6821 | AEH59397 | 6821 | 37325 | 67829, 98333, 128837, 159341, 189845 | 13837 | ACV82259/ml | 13837 | 44341 | 74845, 105349, 135853, 166357, 196861 |
| 6822 | AEH59399 | 6822 | 37326 | 67830, 98334, 128838, 159342, 189846 | 13838 | ACV82259/m2 | 13838 | 44342 | 74846, 105350, 135854, 166358, 196862 |
| 6823 | AEH59403 | 6823 | 37327 | 67831, 98335, 128839, 159343, 189847 | 13839 | ACP41953 | 13839 | 44343 | 74847, 105351, 135855, 166359, 196863 |
| 6824 | AEH59407 | 6824 | 37328 | 67832, 98336, 128840, 159344, 189848 | 13840 | AFM72832 | 13840 | 44344 | 74848, 105352, 135856, 166360, 196864 |
| 6825 | AEH59409 | 6825 | 37329 | 67833, 98337, 128841, 159345, 189849 | 13841 | EPI516528 | 13841 | 44345 | 74849, 105353, 135857, 166361, 196865 |
| 6826 | AEH59411 | 6826 | 37330 | 67834, 98338, 128842, 159346, 189850 | 13842 | AGM53850 | 13842 | 44346 | 74850, 105354, 135858, 166362, 196866 |
| 6827 | AEH59413 | 6827 | 37331 | 67835, 98339, 128843, 159347, 189851 | 13843 | EPI731463 | 13843 | 44347 | 74851, 105355, 135859, 166363, 196867 |
| 6828 | AEH59585 | 6828 | 37332 | 67836, 98340, 128844, 159348, 189852 | 13844 | EPI696972 | 13844 | 44348 | 74852, 105356, 135860, 166364, 196868 |
| 6829 | AEH59587 | 6829 | 37333 | 67837, 98341, 128845, 159349, 189853 | 13845 | EPI662594 | 13845 | 44349 | 74853, 105357, 135861, 166365, 196869 |
| 6830 | AEH59589 | 6830 | 37334 | 67838, 98342, 128846, 159350, 189854 | 13846 | EPI685579 | 13846 | 44350 | 74854, 105358, 135862, 166366, 196870 |
| 6831 | AEH59591 | 6831 | 37335 | 67839, 98343, 128847, 159351, 189855 | 13847 | EPI830230 | 13847 | 44351 | 74855, 105359, 135863, 166367, 196871 |
| 6832 | AEH59593 | 6832 | 37336 | 67840, 98344, 128848, 159352, 189856 | 13848 | ACQ45338 | 13848 | 44352 | 74856, 105360, 135864, 166368, 196872 |
| 6833 | AEH59595 | 6833 | 37337 | 67841, 98345, 128849, 159353, 189857 | 13849 | ACQ45338/ml | 13849 | 44353 | 74857, 105361, 135865, 166369, 196873 |

FIG. 1 continued

| | | | | | | | | | |
|---|---|---|---|---|---|---|---|---|---|
| 6834 | AEH59597 | 6834 | 37338 | 67842, 98346, 128850, 159354, 189858 | 13850 | ACQ45338/m2 | 13850 | 44354 | 74858, 105362, 135866, 166370, 196874 |
| 6835 | AEH59599 | 6835 | 37339 | 67843, 98347, 128851, 159355, 189859 | 13851 | ACU79871 | 13851 | 44355 | 74859, 105363, 135867, 166371, 196875 |
| 6836 | AEH59601 | 6836 | 37340 | 67844, 98348, 128852, 159356, 189860 | 13852 | ACU79871/ml | 13852 | 44356 | 74860, 105364, 135868, 166372, 196876 |
| 6837 | AEH59604 | 6837 | 37341 | 67845, 98349, 128853, 159357, 189861 | 13853 | EPI643118 | 13853 | 44357 | 74861, 105365, 135869, 166373, 196877 |
| 6838 | AEH59614 | 6838 | 37342 | 67846, 98350, 128854, 159358, 189862 | 13854 | EPI675798 | 13854 | 44358 | 74862, 105366, 135870, 166374, 196878 |
| 6839 | AEH59624 | 6839 | 37343 | 67847, 98351, 128855, 159359, 189863 | 13855 | EPI578430 | 13855 | 44359 | 74863, 105367, 135871, 166375, 196879 |
| 6840 | AEH77259 | 6840 | 37344 | 67848, 98352, 128856, 159360, 189864 | 13856 | EPI614406 | 13856 | 44360 | 74864, 105368, 135872, 166376, 196880 |
| 6841 | AEH77270 | 6841 | 37345 | 67849, 98353, 128857, 159361, 189865 | 13857 | ACU65077/ml | 13857 | 44361 | 74865, 105369, 135873, 166377, 196881 |
| 6842 | AEH77279 | 6842 | 37346 | 67850, 98354, 128858, 159362, 189866 | 13858 | ACU65077/m2 | 13858 | 44362 | 74866, 105370, 135874, 166378, 196882 |
| 6843 | AEI29215 | 6843 | 37347 | 67851, 98355, 128859, 159363, 189867 | 13859 | ABP51976 | 13859 | 44363 | 74867, 105371, 135875, 166379, 196883 |
| 6844 | AEI29225 | 6844 | 37348 | 67852, 98356, 128860, 159364, 189868 | 13860 | ABP51976/ml | 13860 | 44364 | 74868, 105372, 135876, 166380, 196884 |
| 6845 | AEI29591 | 6845 | 37349 | 67853, 98357, 128861, 159365, 189869 | 13861 | ABW90125 | 13861 | 44365 | 74869, 105373, 135877, 166381, 196885 |
| 6846 | AEI54347 | 6846 | 37350 | 67854, 98358, 128862, 159366, 189870 | 13862 | ABW90126 | 13862 | 44366 | 74870, 105374, 135878, 166382, 196886 |
| 6847 | AEI54358 | 6847 | 37351 | 67855, 98359, 128863, 159367, 189871 | 13863 | ABW90127 | 13863 | 44367 | 74871, 105375, 135879, 166383, 196887 |
| 6848 | AEI54369 | 6848 | 37352 | 67856, 98360, 128864, 159368, 189872 | 13864 | ABW90128 | 13864 | 44368 | 74872, 105376, 135880, 166384, 196888 |
| 6849 | AEI54380 | 6849 | 37353 | 67857, 98361, 128865, 159369, 189873 | 13865 | ABW90129 | 13865 | 44369 | 74873, 105377, 135881, 166385, 196889 |
| 6850 | AEI54391 | 6850 | 37354 | 67858, 98362, 128866, 159370, 189874 | 13866 | ABW90130 | 13866 | 44370 | 74874, 105378, 135882, 166386, 196890 |
| 6851 | AEI54402 | 6851 | 37355 | 67859, 98363, 128867, 159371, 189875 | 13867 | ABW90132 | 13867 | 44371 | 74875, 105379, 135883, 166387, 196891 |

FIG. 1 continued

| | | | | | | | | | |
|---|---|---|---|---|---|---|---|---|---|
| 6852 | AEI54413 | 6852 | 37356 | 67860, 98364, 128868, 159372, 189876 | 13868 | ABW90133 | 13868 | 44372 | 74876, 105380, 135884, 166388, 196892 |
| 6853 | AEI54424 | 6853 | 37357 | 67861, 98365, 128869, 159373, 189877 | 13869 | ABW90134 | 13869 | 44373 | 74877, 105381, 135885, 166389, 196893 |
| 6854 | AEI54446 | 6854 | 37358 | 67862, 98366, 128870, 159374, 189878 | 13870 | ABW90135 | 13870 | 44374 | 74878, 105382, 135886, 166390, 196894 |
| 6855 | AEI54457 | 6855 | 37359 | 67863, 98367, 128871, 159375, 189879 | 13871 | HB649491 | 13871 | 44375 | 74879, 105383, 135887, 166391, 196895 |
| 6856 | AEI54468 | 6856 | 37360 | 67864, 98368, 128872, 159376, 189880 | 13872 | EPI439507 | 13872 | 44376 | 74880, 105384, 135888, 166392, 196896 |
| 6857 | AEI54479 | 6857 | 37361 | 67865, 98369, 128873, 159377, 189881 | 13873 | EPI482777 | 13873 | 44377 | 74881, 105385, 135889, 166393, 196897 |
| 6858 | AEI54490 | 6858 | 37362 | 67866, 98370, 128874, 159378, 189882 | 13874 | EPI745532 | 13874 | 44378 | 74882, 105386, 135890, 166394, 196898 |
| 6859 | AEI54501 | 6859 | 37363 | 67867, 98371, 128875, 159379, 189883 | 13875 | EPI278594 | 13875 | 44379 | 74883, 105387, 135891, 166395, 196899 |
| 6860 | AEI59979 | 6860 | 37364 | 67868, 98372, 128876, 159380, 189884 | 13876 | AEE69009 | 13876 | 44380 | 74884, 105388, 135892, 166396, 196900 |
| 6861 | AEI59990 | 6861 | 37365 | 67869, 98373, 128877, 159381, 189885 | 13877 | GQ280797 | 13877 | 44381 | 74885, 105389, 135893, 166397, 196901 |
| 6862 | AEI60001 | 6862 | 37366 | 67870, 98374, 128878, 159382, 189886 | 13878 | EPI178457 | 13878 | 44382 | 74886, 105390, 135894, 166398, 196902 |
| 6863 | AEI60012 | 6863 | 37367 | 67871, 98375, 128879, 159383, 189887 | 13879 | EPI176470 | 13879 | 44383 | 74887, 105391, 135895, 166399, 196903 |
| 6864 | AEI60023 | 6864 | 37368 | 67872, 98376, 128880, 159384, 189888 | 13880 | EPI280341 | 13880 | 44384 | 74888, 105392, 135896, 166400, 196904 |
| 6865 | AEI60034 | 6865 | 37369 | 67873, 98377, 128881, 159385, 189889 | 13881 | EPI240319 | 13881 | 44385 | 74889, 105393, 135897, 166401, 196905 |
| 6866 | AEI60045 | 6866 | 37370 | 67874, 98378, 128882, 159386, 189890 | 13882 | EPI183134 | 13882 | 44386 | 74890, 105394, 135898, 166402, 196906 |
| 6867 | AEI60086 | 6867 | 37371 | 67875, 98379, 128883, 159387, 189891 | 13883 | EPI368693 | 13883 | 44387 | 74891, 105395, 135899, 166403, 196907 |
| 6868 | AEI60109 | 6868 | 37372 | 67876, 98380, 128884, 159388, 189892 | 13884 | EPI291788 | 13884 | 44388 | 74892, 105396, 135900, 166404, 196908 |
| 6869 | AEI86734 | 6869 | 37373 | 67877, 98381, 128885, 159389, 189893 | 13885 | EPI482788 | 13885 | 44389 | 74893, 105397, 135901, 166405, 196909 |

FIG. 1 continued

| | | | | | | | | | |
|---|---|---|---|---|---|---|---|---|---|
| 6870 | AEI86764 | 6870 | 37374 | 67878, 98382, 128886, 159390, 189894 | 13886 | EPI178946/m1 | 13886 | 44390 | 74894, 105398, 135902, 166406, 196910 |
| 6871 | AEI86774 | 6871 | 37375 | 67879, 98383, 128887, 159391, 189895 | 13887 | EPI482791/m2 | 13887 | 44391 | 74895, 105399, 135903, 166407, 196911 |
| 6872 | AEI86784 | 6872 | 37376 | 67880, 98384, 128888, 159392, 189896 | 13888 | EPI291799 | 13888 | 44392 | 74896, 105400, 135904, 166408, 196912 |
| 6873 | AEI86794 | 6873 | 37377 | 67881, 98385, 128889, 159393, 189897 | 13889 | EPI482799 | 13889 | 44393 | 74897, 105401, 135905, 166409, 196913 |
| 6874 | AEI86804 | 6874 | 37378 | 67882, 98386, 128890, 159394, 189898 | 13890 | EPI291807 | 13890 | 44394 | 74898, 105402, 135906, 166410, 196914 |
| 6875 | AEI86814 | 6875 | 37379 | 67883, 98387, 128891, 159395, 189899 | 13891 | EPI638970 | 13891 | 44395 | 74899, 105403, 135907, 166411, 196915 |
| 6876 | AEI86824 | 6876 | 37380 | 67884, 98388, 128892, 159396, 189900 | 13892 | ABI19015 | 13892 | 44396 | 74900, 105404, 135908, 166412, 196916 |
| 6877 | AEI86834 | 6877 | 37381 | 67885, 98389, 128893, 159397, 189901 | 13893 | EPI687790 | 13893 | 44397 | 74901, 105405, 135909, 166413, 196917 |
| 6878 | AEI86854 | 6878 | 37382 | 67886, 98390, 128894, 159398, 189902 | 13894 | EPI841265 | 13894 | 44398 | 74902, 105406, 135910, 166414, 196918 |
| 6879 | AEI86864 | 6879 | 37383 | 67887, 98391, 128895, 159399, 189903 | 13895 | EPI291846 | 13895 | 44399 | 74903, 105407, 135911, 166415, 196919 |
| 6880 | AEI86874 | 6880 | 37384 | 67888, 98392, 128896, 159400, 189904 | 13896 | EPI558121 | 13896 | 44400 | 74904, 105408, 135912, 166416, 196920 |
| 6881 | AEI86894 | 6881 | 37385 | 67889, 98393, 128897, 159401, 189905 | 13897 | EPI564139 | 13897 | 44401 | 74905, 105409, 135913, 166417, 196921 |
| 6882 | AEI86904 | 6882 | 37386 | 67890, 98394, 128898, 159402, 189906 | 13898 | EPI786706 | 13898 | 44402 | 74906, 105410, 135914, 166418, 196922 |
| 6883 | AEI86914 | 6883 | 37387 | 67891, 98395, 128899, 159403, 189907 | 13899 | EPI395313 | 13899 | 44403 | 74907, 105411, 135915, 166419, 196923 |
| 6884 | AEI86924 | 6884 | 37388 | 67892, 98396, 128900, 159404, 189908 | 13900 | EPI291696 | 13900 | 44404 | 74908, 105412, 135916, 166420, 196924 |
| 6885 | AEI86934 | 6885 | 37389 | 67893, 98397, 128901, 159405, 189909 | 13901 | ACU80014 | 13901 | 44405 | 74909, 105413, 135917, 166421, 196925 |
| 6886 | AEI86944 | 6886 | 37390 | 67894, 98398, 128902, 159406, 189910 | 13902 | EPI177400 | 13902 | 44406 | 74910, 105414, 135918, 166422, 196926 |
| 6887 | AEI86964 | 6887 | 37391 | 67895, 98399, 128903, 159407, 189911 | 13903 | ACT36512 | 13903 | 44407 | 74911, 105415, 135919, 166423, 196927 |

FIG. 1 continued

| | | | | | | | | | |
|---|---|---|---|---|---|---|---|---|---|
| 6888 | AEI86974 | 6888 | 37392 | 67896, 98400, 128904, 159408, 189912 | 13904 | AJE30344 | 13904 | 44408 | 74912, 105416, 135920, 166424, 196928 |
| 6889 | AEI86984 | 6889 | 37393 | 67897, 98401, 128905, 159409, 189913 | 13905 | EPI178948 | 13905 | 44409 | 74913, 105417, 135921, 166425, 196929 |
| 6890 | AEI86994 | 6890 | 37394 | 67898, 98402, 128906, 159410, 189914 | 13906 | EPI178949 | 13906 | 44410 | 74914, 105418, 135922, 166426, 196930 |
| 6891 | AEI87004 | 6891 | 37395 | 67899, 98403, 128907, 159411, 189915 | 13907 | EPI590132 | 13907 | 44411 | 74915, 105419, 135923, 166427, 196931 |
| 6892 | AEI87014 | 6892 | 37396 | 67900, 98404, 128908, 159412, 189916 | 13908 | ABU80400 | 13908 | 44412 | 74916, 105420, 135924, 166428, 196932 |
| 6893 | AEI87034 | 6893 | 37397 | 67901, 98405, 128909, 159413, 189917 | 13909 | AB021709 | 13909 | 44413 | 74917, 105421, 135925, 166429, 196933 |
| 6894 | AEI87044 | 6894 | 37398 | 67902, 98406, 128910, 159414, 189918 | 13910 | CAZ65588 | 13910 | 44414 | 74918, 105422, 135926, 166430, 196934 |
| 6895 | AEI87054 | 6895 | 37399 | 67903, 98407, 128911, 159415, 189919 | 13911 | EPI697744 | 13911 | 44415 | 74919, 105423, 135927, 166431, 196935 |
| 6896 | AEI87064 | 6896 | 37400 | 67904, 98408, 128912, 159416, 189920 | 13912 | EPI768525 | 13912 | 44416 | 74920, 105424, 135928, 166432, 196936 |
| 6897 | AEI87074 | 6897 | 37401 | 67905, 98409, 128913, 159417, 189921 | 13913 | EPI726930 | 13913 | 44417 | 74921, 105425, 135929, 166433, 196937 |
| 6898 | AEI87094 | 6898 | 37402 | 67906, 98410, 128914, 159418, 189922 | 13914 | EPI813817 | 13914 | 44418 | 74922, 105426, 135930, 166434, 196938 |
| 6899 | AEI87104 | 6899 | 37403 | 67907, 98411, 128915, 159419, 189923 | 13915 | EPI466626 | 13915 | 44419 | 74923, 105427, 135931, 166435, 196939 |
| 6900 | AEI91963 | 6900 | 37404 | 67908, 98412, 128916, 159420, 189924 | 13916 | EPI541966 | 13916 | 44420 | 74924, 105428, 135932, 166436, 196940 |
| 6901 | AEI91977 | 6901 | 37405 | 67909, 98413, 128917, 159421, 189925 | 13917 | EPI652003 | 13917 | 44421 | 74925, 105429, 135933, 166437, 196941 |
| 6902 | AEI91978 | 6902 | 37406 | 67910, 98414, 128918, 159422, 189926 | 13918 | EPI291877 | 13918 | 44422 | 74926, 105430, 135934, 166438, 196942 |
| 6903 | AEI91998 | 6903 | 37407 | 67911, 98415, 128919, 159423, 189927 | 13919 | ABR29595 | 13919 | 44423 | 74927, 105431, 135935, 166439, 196943 |
| 6904 | AEI91999 | 6904 | 37408 | 67912, 98416, 128920, 159424, 189928 | 13920 | EPI291885 | 13920 | 44424 | 74928, 105432, 135936, 166440, 196944 |
| 6905 | AEI92018 | 6905 | 37409 | 67913, 98417, 128921, 159425, 189929 | 13921 | EPI176515 | 13921 | 44425 | 74929, 105433, 135937, 166441, 196945 |

FIG. 1 continued

| | | | | | | | | | |
|---|---|---|---|---|---|---|---|---|---|
| 6906 | AEJ10400 | 6906 | 37410 | 67914, 98418, 128922, 159426, 189930 | 13922 | EPI189182 | 13922 | 44426 | 74930, 105434, 135938, 166442, 196946 |
| 6907 | AEJ10410 | 6907 | 37411 | 67915, 98419, 128923, 159427, 189931 | 13923 | EPI180574 | 13923 | 44427 | 74931, 105435, 135939, 166443, 196947 |
| 6908 | AEJ10420 | 6908 | 37412 | 67916, 98420, 128924, 159428, 189932 | 13924 | EPI377499 | 13924 | 44428 | 74932, 105436, 135940, 166444, 196948 |
| 6909 | AEJ10430 | 6909 | 37413 | 67917, 98421, 128925, 159429, 189933 | 13925 | EPI346916 | 13925 | 44429 | 74933, 105437, 135941, 166445, 196949 |
| 6910 | AEJ10440 | 6910 | 37414 | 67918, 98422, 128926, 159430, 189934 | 13926 | ACV49600 | 13926 | 44430 | 74934, 105438, 135942, 166446, 196950 |
| 6911 | AEJ10450 | 6911 | 37415 | 67919, 98423, 128927, 159431, 189935 | 13927 | BAF48361 | 13927 | 44431 | 74935, 105439, 135943, 166447, 196951 |
| 6912 | AEJ10480 | 6912 | 37416 | 67920, 98424, 128928, 159432, 189936 | 13928 | EPI507594 | 13928 | 44432 | 74936, 105440, 135944, 166448, 196952 |
| 6913 | AEJ10490 | 6913 | 37417 | 67921, 98425, 128929, 159433, 189937 | 13929 | EPI461953 | 13929 | 44433 | 74937, 105441, 135945, 166449, 196953 |
| 6914 | AEJ10500 | 6914 | 37418 | 67922, 98426, 128930, 159434, 189938 | 13930 | EPI461953/ml | 13930 | 44434 | 74938, 105442, 135946, 166450, 196954 |
| 6915 | AEJ10510 | 6915 | 37419 | 67923, 98427, 128931, 159435, 189939 | 13931 | EPI668105 | 13931 | 44435 | 74939, 105443, 135947, 166451, 196955 |
| 6916 | AEJ10520 | 6916 | 37420 | 67924, 98428, 128932, 159436, 189940 | 13932 | EPI578446 | 13932 | 44436 | 74940, 105444, 135948, 166452, 196956 |
| 6917 | AEJ10530 | 6917 | 37421 | 67925, 98429, 128933, 159437, 189941 | 13933 | EPI551882 | 13933 | 44437 | 74941, 105445, 135949, 166453, 196957 |
| 6918 | AEJ10540 | 6918 | 37422 | 67926, 98430, 128934, 159438, 189942 | 13934 | EPI344389 | 13934 | 44438 | 74942, 105446, 135950, 166454, 196958 |
| 6919 | AEJ10550 | 6919 | 37423 | 67927, 98431, 128935, 159439, 189943 | 13935 | EPI348782 | 13935 | 44439 | 74943, 105447, 135951, 166455, 196959 |
| 6920 | AEJ10570 | 6920 | 37424 | 67928, 98432, 128936, 159440, 189944 | 13936 | EPI642513 | 13936 | 44440 | 74944, 105448, 135952, 166456, 196960 |
| 6921 | AEJ10580 | 6921 | 37425 | 67929, 98433, 128937, 159441, 189945 | 13937 | EPI293965 | 13937 | 44441 | 74945, 105449, 135953, 166457, 196961 |
| 6922 | AEJ36302 | 6922 | 37426 | 67930, 98434, 128938, 159442, 189946 | 13938 | EPI465400 | 13938 | 44442 | 74946, 105450, 135954, 166458, 196962 |
| 6923 | AEJ36312 | 6923 | 37427 | 67931, 98435, 128939, 159443, 189947 | 13939 | EPI328898 | 13939 | 44443 | 74947, 105451, 135955, 166459, 196963 |

FIG. 1 continued

| | | | | | | | | | |
|---|---|---|---|---|---|---|---|---|---|
| 6924 | AEJ37853 | 6924 | 37428 | 67932, 98436, 128940, 159444, 189948 | 13940 | EPI328900 | 13940 | 44444 | 74948, 105452, 135956, 166460, 196964 |
| 6925 | AEJ37863 | 6925 | 37429 | 67933, 98437, 128941, 159445, 189949 | 13941 | EPI574644 | 13941 | 44445 | 74949, 105453, 135957, 166461, 196965 |
| 6926 | AEJ37873 | 6926 | 37430 | 67934, 98438, 128942, 159446, 189950 | 13942 | EPI563212 | 13942 | 44446 | 74950, 105454, 135958, 166462, 196966 |
| 6927 | AEJ37883 | 6927 | 37431 | 67935, 98439, 128943, 159447, 189951 | 13943 | EPI553999 | 13943 | 44447 | 74951, 105455, 135959, 166463, 196967 |
| 6928 | AEJ37893 | 6928 | 37432 | 67936, 98440, 128944, 159448, 189952 | 13944 | EPI551570 | 13944 | 44448 | 74952, 105456, 135960, 166464, 196968 |
| 6929 | AEJ37903 | 6929 | 37433 | 67937, 98441, 128945, 159449, 189953 | 13945 | EPI629738 | 13945 | 44449 | 74953, 105457, 135961, 166465, 196969 |
| 6930 | AEJ37923 | 6930 | 37434 | 67938, 98442, 128946, 159450, 189954 | 13946 | EPI631887 | 13946 | 44450 | 74954, 105458, 135962, 166466, 196970 |
| 6931 | AEJ37943 | 6931 | 37435 | 67939, 98443, 128947, 159451, 189955 | 13947 | EPI577026 | 13947 | 44451 | 74955, 105459, 135963, 166467, 196971 |
| 6932 | AEJ37953 | 6932 | 37436 | 67940, 98444, 128948, 159452, 189956 | 13948 | EPI404927 | 13948 | 44452 | 74956, 105460, 135964, 166468, 196972 |
| 6933 | AEJ37963 | 6933 | 37437 | 67941, 98445, 128949, 159453, 189957 | 13949 | EPI489319 | 13949 | 44453 | 74957, 105461, 135965, 166469, 196973 |
| 6934 | AEJ37973 | 6934 | 37438 | 67942, 98446, 128950, 159454, 189958 | 13950 | EPI530647 | 13950 | 44454 | 74958, 105462, 135966, 166470, 196974 |
| 6935 | AEJ37983 | 6935 | 37439 | 67943, 98447, 128951, 159455, 189959 | 13951 | EPI541083 | 13951 | 44455 | 74959, 105463, 135967, 166471, 196975 |
| 6936 | AEK21369 | 6936 | 37440 | 67944, 98448, 128952, 159456, 189960 | 13952 | EPI684315 | 13952 | 44456 | 74960, 105464, 135968, 166472, 196976 |
| 6937 | AEK21380 | 6937 | 37441 | 67945, 98449, 128953, 159457, 189961 | 13953 | EPI614462 | 13953 | 44457 | 74961, 105465, 135969, 166473, 196977 |
| 6938 | AEK21396 | 6938 | 37442 | 67946, 98450, 128954, 159458, 189962 | 13954 | EPI541465 | 13954 | 44458 | 74962, 105466, 135970, 166474, 196978 |
| 6939 | AEK21406 | 6939 | 37443 | 67947, 98451, 128955, 159459, 189963 | 13955 | EPI696967 | 13955 | 44459 | 74963, 105467, 135971, 166475, 196979 |
| 6940 | AEK21416 | 6940 | 37444 | 67948, 98452, 128956, 159460, 189964 | 13956 | EPI674597 | 13956 | 44460 | 74964, 105468, 135972, 166476, 196980 |
| 6941 | AEK21426 | 6941 | 37445 | 67949, 98453, 128957, 159461, 189965 | 13957 | EPI530677 | 13957 | 44461 | 74965, 105469, 135973, 166477, 196981 |

FIG. 1 continued

| | | | | | | | | | |
|---|---|---|---|---|---|---|---|---|---|
| 6942 | AEK21436 | 6942 | 37446 | 67950, 98454, 128958, 159462, 189966 | 13958 | EPI530679 | 13958 | 44462 | 74966, 105470, 135974, 166478, 196982 |
| 6943 | AEK21456 | 6943 | 37447 | 67951, 98455, 128959, 159463, 189967 | 13959 | AAG01785 | 13959 | 44463 | 74967, 105471, 135975, 166479, 196983 |
| 6944 | AEK21466 | 6944 | 37448 | 67952, 98456, 128960, 159464, 189968 | 13960 | EPI814528 | 13960 | 44464 | 74968, 105472, 135976, 166480, 196984 |
| 6945 | AEK21476 | 6945 | 37449 | 67953, 98457, 128961, 159465, 189969 | 13961 | EPI674736 | 13961 | 44465 | 74969, 105473, 135977, 166481, 196985 |
| 6946 | AEK21486 | 6946 | 37450 | 67954, 98458, 128962, 159466, 189970 | 13962 | EPI614444 | 13962 | 44466 | 74970, 105474, 135978, 166482, 196986 |
| 6947 | AEK28774 | 6947 | 37451 | 67955, 98459, 128963, 159467, 189971 | 13963 | EPI551814 | 13963 | 44467 | 74971, 105475, 135979, 166483, 196987 |
| 6948 | AEK28785 | 6948 | 37452 | 67956, 98460, 128964, 159468, 189972 | 13964 | EPI696955 | 13964 | 44468 | 74972, 105476, 135980, 166484, 196988 |
| 6949 | AEK28796 | 6949 | 37453 | 67957, 98461, 128965, 159469, 189973 | 13965 | EPI740790 | 13965 | 44469 | 74973, 105477, 135981, 166485, 196989 |
| 6950 | AEK28807 | 6950 | 37454 | 67958, 98462, 128966, 159470, 189974 | 13966 | EPI377499 | 13966 | 44470 | 74974, 105478, 135982, 166486, 196990 |
| 6951 | AEK28818 | 6951 | 37455 | 67959, 98463, 128967, 159471, 189975 | 13967 | EPI391247 | 13967 | 44471 | 74975, 105479, 135983, 166487, 196991 |
| 6952 | AEK28828 | 6952 | 37456 | 67960, 98464, 128968, 159472, 189976 | 13968 | EPI407123 | 13968 | 44472 | 74976, 105480, 135984, 166488, 196992 |
| 6953 | AEK28839 | 6953 | 37457 | 67961, 98465, 128969, 159473, 189977 | 13969 | EPI407126 | 13969 | 44473 | 74977, 105481, 135985, 166489, 196993 |
| 6954 | AEK28850 | 6954 | 37458 | 67962, 98466, 128970, 159474, 189978 | 13970 | EPI562037 | 13970 | 44474 | 74978, 105482, 135986, 166490, 196994 |
| 6955 | AEK28861 | 6955 | 37459 | 67963, 98467, 128971, 159475, 189979 | 13971 | EPI562034 | 13971 | 44475 | 74979, 105483, 135987, 166491, 196995 |
| 6956 | AEK28872 | 6956 | 37460 | 67964, 98468, 128972, 159476, 189980 | 13972 | EPI653140 | 13972 | 44476 | 74980, 105484, 135988, 166492, 196996 |
| 6957 | AEK28883 | 6957 | 37461 | 67965, 98469, 128973, 159477, 189981 | 13973 | ACR48873/m | 13973 | 44477 | 74981, 105485, 135989, 166493, 196997 |
| 6958 | AEK28894 | 6958 | 37462 | 67966, 98470, 128974, 159478, 189982 | 13974 | ACR48874/m | 13974 | 44478 | 74982, 105486, 135990, 166494, 196998 |
| 6959 | AEK28905 | 6959 | 37463 | 67967, 98471, 128975, 159479, 189983 | 13975 | ACD47234 | 13975 | 44479 | 74983, 105487, 135991, 166495, 196999 |

FIG. 1 continued

| | | | | | | | | | |
|---|---|---|---|---|---|---|---|---|---|
| 6960 | AEK28916 | 6960 | 37464 | 67968, 98472, 128976, 159480, 189984 | 13976 | ACZ36881 | 13976 | 44480 | 74984, 105488, 135992, 166496, 197000 |
| 6961 | AEK28927 | 6961 | 37465 | 67969, 98473, 128977, 159481, 189985 | 13977 | EPI500771 | 13977 | 44481 | 74985, 105489, 135993, 166497, 197001 |
| 6962 | AEK28949 | 6962 | 37466 | 67970, 98474, 128978, 159482, 189986 | 13978 | ABF93441 | 13978 | 44482 | 74986, 105490, 135994, 166498, 197002 |
| 6963 | AEK28960 | 6963 | 37467 | 67971, 98475, 128979, 159483, 189987 | 13979 | AGG12577 | 13979 | 44483 | 74987, 105491, 135995, 166499, 197003 |
| 6964 | AEK28971 | 6964 | 37468 | 67972, 98476, 128980, 159484, 189988 | 13980 | AGC13463 | 13980 | 44484 | 74988, 105492, 135996, 166500, 197004 |
| 6965 | AEK28982 | 6965 | 37469 | 67973, 98477, 128981, 159485, 189989 | 13981 | ACI06178/ml | 13981 | 44485 | 74989, 105493, 135997, 166501, 197005 |
| 6966 | AEK28993 | 6966 | 37470 | 67974, 98478, 128982, 159486, 189990 | 13982 | AHF20402 | 13982 | 44486 | 74990, 105494, 135998, 166502, 197006 |
| 6967 | AEK29004 | 6967 | 37471 | 67975, 98479, 128983, 159487, 189991 | 13983 | ABQ45850 | 13983 | 44487 | 74991, 105495, 135999, 166503, 197007 |
| 6968 | AEK29026 | 6968 | 37472 | 67976, 98480, 128984, 159488, 189992 | 13984 | AKI82373 | 13984 | 44488 | 74992, 105496, 136000, 166504, 197008 |
| 6969 | AEK29048 | 6969 | 37473 | 67977, 98481, 128985, 159489, 189993 | 13985 | EPI284473 | 13985 | 44489 | 74993, 105497, 136001, 166505, 197009 |
| 6970 | AEK29070 | 6970 | 37474 | 67978, 98482, 128986, 159490, 189994 | 13986 | ACO07033 | 13986 | 44490 | 74994, 105498, 136002, 166506, 197010 |
| 6971 | AEK29081 | 6971 | 37475 | 67979, 98483, 128987, 159491, 189995 | 13987 | EPI174803 | 13987 | 44491 | 74995, 105499, 136003, 166507, 197011 |
| 6972 | AEK29092 | 6972 | 37476 | 67980, 98484, 128988, 159492, 189996 | 13988 | AGZ62382 | 13988 | 44492 | 74996, 105500, 136004, 166508, 197012 |
| 6973 | AEK29125 | 6973 | 37477 | 67981, 98485, 128989, 159493, 189997 | 13989 | ABG67978/m | 13989 | 44493 | 74997, 105501, 136005, 166509, 197013 |
| 6974 | AEK29136 | 6974 | 37478 | 67982, 98486, 128990, 159494, 189998 | 13990 | EPI827075 | 13990 | 44494 | 74998, 105502, 136006, 166510, 197014 |
| 6975 | AEK29169 | 6975 | 37479 | 67983, 98487, 128991, 159495, 189999 | 13991 | ABP96850 | 13991 | 44495 | 74999, 105503, 136007, 166511, 197015 |
| 6976 | AEK29180 | 6976 | 37480 | 67984, 98488, 128992, 159496, 190000 | 13992 | EPI827077 | 13992 | 44496 | 75000, 105504, 136008, 166512, 197016 |
| 6977 | AEK29191 | 6977 | 37481 | 67985, 98489, 128993, 159497, 190001 | 13993 | EPI594523 | 13993 | 44497 | 75001, 105505, 136009, 166513, 197017 |

FIG. 1 continued

| | | | | | | | | | |
|---|---|---|---|---|---|---|---|---|---|
| 6978 | AEK29202 | 6978 | 37482 | 67986, 98490, 128994, 159498, 190002 | 13994 | AAD37782 | 13994 | 44498 | 75002, 105506, 136010, 166514, 197018 |
| 6979 | AEK29213 | 6979 | 37483 | 67987, 98491, 128995, 159499, 190003 | 13995 | AAD51927 | 13995 | 44499 | 75003, 105507, 136011, 166515, 197019 |
| 6980 | AEK29224 | 6980 | 37484 | 67988, 98492, 128996, 159500, 190004 | 13996 | AEO89181 | 13996 | 44500 | 75004, 105508, 136012, 166516, 197020 |
| 6981 | AEK29235 | 6981 | 37485 | 67989, 98493, 128997, 159501, 190005 | 13997 | AFM78567 | 13997 | 44501 | 75005, 105509, 136013, 166517, 197021 |
| 6982 | AEK29268 | 6982 | 37486 | 67990, 98494, 128998, 159502, 190006 | 13998 | ACR48872 | 13998 | 44502 | 75006, 105510, 136014, 166518, 197022 |
| 6983 | AEK59838 | 6983 | 37487 | 67991, 98495, 128999, 159503, 190007 | 13999 | ABW06108 | 13999 | 44503 | 75007, 105511, 136015, 166519, 197023 |
| 6984 | AEK98378 | 6984 | 37488 | 67992, 98496, 129000, 159504, 190008 | 14000 | EPI341633 | 14000 | 44504 | 75008, 105512, 136016, 166520, 197024 |
| 6985 | AEK98380 | 6985 | 37489 | 67993, 98497, 129001, 159505, 190009 | 14001 | ABD95991 | 14001 | 44505 | 75009, 105513, 136017, 166521, 197025 |
| 6986 | AEK98382 | 6986 | 37490 | 67994, 98498, 129002, 159506, 190010 | 14002 | AGN69453 | 14002 | 44506 | 75010, 105514, 136018, 166522, 197026 |
| 6987 | AEK98386 | 6987 | 37491 | 67995, 98499, 129003, 159507, 190011 | 14003 | AGN69452 | 14003 | 44507 | 75011, 105515, 136019, 166523, 197027 |
| 6988 | AEK98388 | 6988 | 37492 | 67996, 98500, 129004, 159508, 190012 | 14004 | ABD73284 | 14004 | 44508 | 75012, 105516, 136020, 166524, 197028 |
| 6989 | AEK98390 | 6989 | 37493 | 67997, 98501, 129005, 159509, 190013 | 14005 | ABF93440 | 14005 | 44509 | 75013, 105517, 136021, 166525, 197029 |
| 6990 | AEK98392 | 6990 | 37494 | 67998, 98502, 129006, 159510, 190014 | 14006 | AKC45369 | 14006 | 44510 | 75014, 105518, 136022, 166526, 197030 |
| 6991 | AEK98394 | 6991 | 37495 | 67999, 98503, 129007, 159511, 190015 | 14007 | AJS18479 | 14007 | 44511 | 75015, 105519, 136023, 166527, 197031 |
| 6992 | AEK98396 | 6992 | 37496 | 68000, 98504, 129008, 159512, 190016 | 14008 | EPI691378 | 14008 | 44512 | 75016, 105520, 136024, 166528, 197032 |
| 6993 | AEK98398 | 6993 | 37497 | 68001, 98505, 129009, 159513, 190017 | 14009 | EPI533583 | 14009 | 44513 | 75017, 105521, 136025, 166529, 197033 |
| 6994 | AEK98400 | 6994 | 37498 | 68002, 98506, 129010, 159514, 190018 | 14010 | AKS48023 | 14010 | 44514 | 75018, 105522, 136026, 166530, 197034 |
| 6995 | AEK98402 | 6995 | 37499 | 68003, 98507, 129011, 159515, 190019 | 14011 | EPI587621 | 14011 | 44515 | 75019, 105523, 136027, 166531, 197035 |

FIG. 1 continued

| | | | | | | | | | |
|---|---|---|---|---|---|---|---|---|---|
| 6996 | AEK98404 | 6996 | 37500 | 68004, 98508, 129012, 159516, 190020 | 14012 | AJE30333 | 14012 | 44516 | 75020, 105524, 136028, 166532, 197036 |
| 6997 | AEK98406 | 6997 | 37501 | 68005, 98509, 129013, 159517, 190021 | 14013 | EPI459855 | 14013 | 44517 | 75021, 105525, 136029, 166533, 197037 |
| 6998 | AEL11687 | 6998 | 37502 | 68006, 98510, 129014, 159518, 190022 | 14014 | EPI459855/ml | 14014 | 44518 | 75022, 105526, 136030, 166534, 197038 |
| 6999 | AEL31632 | 6999 | 37503 | 68007, 98511, 129015, 159519, 190023 | 14015 | ACZ36872 | 14015 | 44519 | 75023, 105527, 136031, 166535, 197039 |
| 7000 | AEL89297 | 7000 | 37504 | 68008, 98512, 129016, 159520, 190024 | 14016 | AGB51388 | 14016 | 44520 | 75024, 105528, 136032, 166536, 197040 |
| 7001 | AEL89307 | 7001 | 37505 | 68009, 98513, 129017, 159521, 190025 | 14017 | EPI439507 | 14017 | 44521 | 75025, 105529, 136033, 166537, 197041 |
| 7002 | AEL89317 | 7002 | 37506 | 68010, 98514, 129018, 159522, 190026 | 14018 | EPI164216 | 14018 | 44522 | 75026, 105530, 136034, 166538, 197042 |
| 7003 | AEL89327 | 7003 | 37507 | 68011, 98515, 129019, 159523, 190027 | 14019 | EPI486492 | 14019 | 44523 | 75027, 105531, 136035, 166539, 197043 |
| 7004 | AEL89337 | 7004 | 37508 | 68012, 98516, 129020, 159524, 190028 | 14020 | EPI740738 | 14020 | 44524 | 75028, 105532, 136036, 166540, 197044 |
| 7005 | AEL89347 | 7005 | 37509 | 68013, 98517, 129021, 159525, 190029 | 14021 | EPI730495 | 14021 | 44525 | 75029, 105533, 136037, 166541, 197045 |
| 7006 | AEL89357 | 7006 | 37510 | 68014, 98518, 129022, 159526, 190030 | 14022 | EPI712926 | 14022 | 44526 | 75030, 105534, 136038, 166542, 197046 |
| 7007 | AEL89367 | 7007 | 37511 | 68015, 98519, 129023, 159527, 190031 | 14023 | AGL44438 | 14023 | 44527 | 75031, 105535, 136039, 166543, 197047 |
| 7008 | AEL89391 | 7008 | 37512 | 68016, 98520, 129024, 159528, 190032 | 14024 | EPI445996 | 14024 | 44528 | 75032, 105536, 136040, 166544, 197048 |
| 7009 | AEL89401 | 7009 | 37513 | 68017, 98521, 129025, 159529, 190033 | 14025 | EPI433309 | 14025 | 44529 | 75033, 105537, 136041, 166545, 197049 |
| 7010 | AEL89411 | 7010 | 37514 | 68018, 98522, 129026, 159530, 190034 | 14026 | EPI470859 | 14026 | 44530 | 75034, 105538, 136042, 166546, 197050 |
| 7011 | AEL89421 | 7011 | 37515 | 68019, 98523, 129027, 159531, 190035 | 14027 | EPI498037 | 14027 | 44531 | 75035, 105539, 136043, 166547, 197051 |
| 7012 | AEL89441 | 7012 | 37516 | 68020, 98524, 129028, 159532, 190036 | 14028 | AGO17847 | 14028 | 44532 | 75036, 105540, 136044, 166548, 197052 |
| 7013 | AEL89451 | 7013 | 37517 | 68021, 98525, 129029, 159533, 190037 | 14029 | ANZ03807 | 14029 | 44533 | 75037, 105541, 136045, 166549, 197053 |

FIG. 1 continued

| | | | | | | | | | |
|---|---|---|---|---|---|---|---|---|---|
| 7014 | AEL89461 | 7014 | 37518 | 68022, 98526, 129030, 159534, 190038 | 14030 | EPI680526 | 14030 | 44534 | 75038, 105542, 136046, 166550, 197054 |
| 7015 | AEL89471 | 7015 | 37519 | 68023, 98527, 129031, 159535, 190039 | 14031 | ALT20080 | 14031 | 44535 | 75039, 105543, 136047, 166551, 197055 |
| 7016 | AEL89481 | 7016 | 37520 | 68024, 98528, 129032, 159536, 190040 | | | | | |

FIG. 1 continued

| | column 1 | column 2 | column 3 | column 4 | | column 1 | column 2 | column 3 | column 4 |
|---|---|---|---|---|---|---|---|---|---|
| Row | NCBI, Genbank or EpiFlu Accession No. | A | B | C | Row | NCBI, Genbank or EpiFlu Accession No. | A | B | C |
| 1 | ABL76276 | 26398 | 56902 | 87406, 117910, 148414, 178918, 209422 | 1091 | AGX21370 | 27488 | 57992 | 88496, 119000, 149504, 180008, 210512 |
| 2 | ABL76287 | 26399 | 56903 | 87407, 117911, 148415, 178919, 209423 | 1092 | AGX21381 | 27489 | 57993 | 88497, 119001, 149505, 180009, 210513 |
| 3 | ABL76298 | 26400 | 56904 | 87408, 117912, 148416, 178920, 209424 | 1093 | AGX21392 | 27490 | 57994 | 88498, 119002, 149506, 180010, 210514 |
| 4 | ABL76309 | 26401 | 56905 | 87409, 117913, 148417, 178921, 209425 | 1094 | AGX21403 | 27491 | 57995 | 88499, 119003, 149507, 180011, 210515 |
| 5 | ABL76331 | 26402 | 56906 | 87410, 117914, 148418, 178922, 209426 | 1095 | AGX21414 | 27492 | 57996 | 88500, 119004, 149508, 180012, 210516 |
| 6 | ABL76342 | 26403 | 56907 | 87411, 117915, 148419, 178923, 209427 | 1096 | AGX21425 | 27493 | 57997 | 88501, 119005, 149509, 180013, 210517 |
| 7 | ABL76353 | 26404 | 56908 | 87412, 117916, 148420, 178924, 209428 | 1097 | AGX21436 | 27494 | 57998 | 88502, 119006, 149510, 180014, 210518 |
| 8 | ABL76375 | 26405 | 56909 | 87413, 117917, 148421, 178925, 209429 | 1098 | AGX21447 | 27495 | 57999 | 88503, 119007, 149511, 180015, 210519 |
| 9 | ABL76386 | 26406 | 56910 | 87414, 117918, 148422, 178926, 209430 | 1099 | AGX21458 | 27496 | 58000 | 88504, 119008, 149512, 180016, 210520 |
| 10 | ABL76408 | 26407 | 56911 | 87415, 117919, 148423, 178927, 209431 | 1100 | AGX21469 | 27497 | 58001 | 88505, 119009, 149513, 180017, 210521 |
| 11 | ABL76419 | 26408 | 56912 | 87416, 117920, 148424, 178928, 209432 | 1101 | AGX21480 | 27498 | 58002 | 88506, 119010, 149514, 180018, 210522 |

FIG. 2

| | | | | | | | | | |
|---|---|---|---|---|---|---|---|---|---|
| 12 | ABL76441 | 26409 | 56913 | 87417, 117921, 148425, 178929, 209433 | 1102 | AGX21491 | 27499 | 58003 | 88507, 119011, 149515, 180019, 210523 |
| 13 | ABL76463 | 26410 | 56914 | 87418, 117922, 148426, 178930, 209434 | 1103 | AGX21502 | 27500 | 58004 | 88508, 119012, 149516, 180020, 210524 |
| 14 | ABL76474 | 26411 | 56915 | 87419, 117923, 148427, 178931, 209435 | 1104 | AGX21513 | 27501 | 58005 | 88509, 119013, 149517, 180021, 210525 |
| 15 | ABL76485 | 26412 | 56916 | 87420, 117924, 148428, 178932, 209436 | 1105 | AGX21524 | 27502 | 58006 | 88510, 119014, 149518, 180022, 210526 |
| 16 | ABL76507 | 26413 | 56917 | 87421, 117925, 148429, 178933, 209437 | 1106 | AGX21535 | 27503 | 58007 | 88511, 119015, 149519, 180023, 210527 |
| 17 | ABL76518 | 26414 | 56918 | 87422, 117926, 148430, 178934, 209438 | 1107 | AGX21546 | 27504 | 58008 | 88512, 119016, 149520, 180024, 210528 |
| 18 | ABL76529 | 26415 | 56919 | 87423, 117927, 148431, 178935, 209439 | 1108 | AGX21557 | 27505 | 58009 | 88513, 119017, 149521, 180025, 210529 |
| 19 | ABL76540 | 26416 | 56920 | 87424, 117928, 148432, 178936, 209440 | 1109 | AGX21568 | 27506 | 58010 | 88514, 119018, 149522, 180026, 210530 |
| 20 | ABL76551 | 26417 | 56921 | 87425, 117929, 148433, 178937, 209441 | 1110 | AGX21579 | 27507 | 58011 | 88515, 119019, 149523, 180027, 210531 |
| 21 | ABL76562 | 26418 | 56922 | 87426, 117930, 148434, 178938, 209442 | 1111 | AGX21590 | 27508 | 58012 | 88516, 119020, 149524, 180028, 210532 |
| 22 | ABL76573 | 26419 | 56923 | 87427, 117931, 148435, 178939, 209443 | 1112 | AGX21601 | 27509 | 58013 | 88517, 119021, 149525, 180029, 210533 |
| 23 | ABL76584 | 26420 | 56924 | 87428, 117932, 148436, 178940, 209444 | 1113 | AGX21611 | 27510 | 58014 | 88518, 119022, 149526, 180030, 210534 |
| 24 | ABL76595 | 26421 | 56925 | 87429, 117933, 148437, 178941, 209445 | 1114 | AGX21622 | 27511 | 58015 | 88519, 119023, 149527, 180031, 210535 |
| 25 | ABL76606 | 26422 | 56926 | 87430, 117934, 148438, 178942, 209446 | 1115 | AGX21633 | 27512 | 58016 | 88520, 119024, 149528, 180032, 210536 |
| 26 | ABL76617 | 26423 | 56927 | 87431, 117935, 148439, 178943, 209447 | 1116 | AGX21644 | 27513 | 58017 | 88521, 119025, 149529, 180033, 210537 |
| 27 | ABL76628 | 26424 | 56928 | 87432, 117936, 148440, 178944, 209448 | 1117 | AGX21655 | 27514 | 58018 | 88522, 119026, 149530, 180034, 210538 |
| 28 | ABL76639 | 26425 | 56929 | 87433, 117937, 148441, 178945, 209449 | 1118 | AGX21666 | 27515 | 58019 | 88523, 119027, 149531, 180035, 210539 |
| 29 | ABL76683 | 26426 | 56930 | 87434, 117938, 148442, 178946, 209450 | 1119 | AGX21677 | 27516 | 58020 | 88524, 119028, 149532, 180036, 210540 |

FIG. 2 continued

| | | | | | | | | | |
|---|---|---|---|---|---|---|---|---|---|
| 30 | ABL76694 | 26427 | 56931 | 87435, 117939, 148443, 178947, 209451 | 1120 | AGX21688 | 27517 | 58021 | 88525, 119029, 149533, 180037, 210541 |
| 31 | ABL76716 | 26428 | 56932 | 87436, 117940, 148444, 178948, 209452 | 1121 | AGX21699 | 27518 | 58022 | 88526, 119030, 149534, 180038, 210542 |
| 32 | ABL76760 | 26429 | 56933 | 87437, 117941, 148445, 178949, 209453 | 1122 | AGX21710 | 27519 | 58023 | 88527, 119031, 149535, 180039, 210543 |
| 33 | ABL76771 | 26430 | 56934 | 87438, 117942, 148446, 178950, 209454 | 1123 | AGX21721 | 27520 | 58024 | 88528, 119032, 149536, 180040, 210544 |
| 34 | ABL76782 | 26431 | 56935 | 87439, 117943, 148447, 178951, 209455 | 1124 | AGX21732 | 27521 | 58025 | 88529, 119033, 149537, 180041, 210545 |
| 35 | ABL76793 | 26432 | 56936 | 87440, 117944, 148448, 178952, 209456 | 1125 | AGX21743 | 27522 | 58026 | 88530, 119034, 149538, 180042, 210546 |
| 36 | ABL76815 | 26433 | 56937 | 87441, 117945, 148449, 178953, 209457 | 1126 | AGX21754 | 27523 | 58027 | 88531, 119035, 149539, 180043, 210547 |
| 37 | ABL76826 | 26434 | 56938 | 87442, 117946, 148450, 178954, 209458 | 1127 | AGX21776 | 27524 | 58028 | 88532, 119036, 149540, 180044, 210548 |
| 38 | ABL76837 | 26435 | 56939 | 87443, 117947, 148451, 178955, 209459 | 1128 | AGX21787 | 27525 | 58029 | 88533, 119037, 149541, 180045, 210549 |
| 39 | ABL76848 | 26436 | 56940 | 87444, 117948, 148452, 178956, 209460 | 1129 | AGX21798 | 27526 | 58030 | 88534, 119038, 149542, 180046, 210550 |
| 40 | ABL76859 | 26437 | 56941 | 87445, 117949, 148453, 178957, 209461 | 1130 | AGX21809 | 27527 | 58031 | 88535, 119039, 149543, 180047, 210551 |
| 41 | ABL76881 | 26438 | 56942 | 87446, 117950, 148454, 178958, 209462 | 1131 | AGX21820 | 27528 | 58032 | 88536, 119040, 149544, 180048, 210552 |
| 42 | ABL76892 | 26439 | 56943 | 87447, 117951, 148455, 178959, 209463 | 1132 | AGX21831 | 27529 | 58033 | 88537, 119041, 149545, 180049, 210553 |
| 43 | ABL76903 | 26440 | 56944 | 87448, 117952, 148456, 178960, 209464 | 1133 | AGX21842 | 27530 | 58034 | 88538, 119042, 149546, 180050, 210554 |
| 44 | ABL76914 | 26441 | 56945 | 87449, 117953, 148457, 178961, 209465 | 1134 | AGX21853 | 27531 | 58035 | 88539, 119043, 149547, 180051, 210555 |
| 45 | ABL76936 | 26442 | 56946 | 87450, 117954, 148458, 178962, 209466 | 1135 | AGX21864 | 27532 | 58036 | 88540, 119044, 149548, 180052, 210556 |
| 46 | ABL76947 | 26443 | 56947 | 87451, 117955, 148459, 178963, 209467 | 1136 | AGX21875 | 27533 | 58037 | 88541, 119045, 149549, 180053, 210557 |
| 47 | ABL76958 | 26444 | 56948 | 87452, 117956, 148460, 178964, 209468 | 1137 | AGX21886 | 27534 | 58038 | 88542, 119046, 149550, 180054, 210558 |

FIG. 2 continued

| | | | | | | | | | |
|---|---|---|---|---|---|---|---|---|---|
| 48 | ABL76969 | 26445 | 56949 | 87453, 117957, 148461, 178965, 209469 | 1138 | AGX21897 | 27535 | 58039 | 88543, 119047, 149551, 180055, 210559 |
| 49 | ABL76980 | 26446 | 56950 | 87454, 117958, 148462, 178966, 209470 | 1139 | AGX21908 | 27536 | 58040 | 88544, 119048, 149552, 180056, 210560 |
| 50 | ABL76991 | 26447 | 56951 | 87455, 117959, 148463, 178967, 209471 | 1140 | AGX21919 | 27537 | 58041 | 88545, 119049, 149553, 180057, 210561 |
| 51 | ABL77002 | 26448 | 56952 | 87456, 117960, 148464, 178968, 209472 | 1141 | AGX21941 | 27538 | 58042 | 88546, 119050, 149554, 180058, 210562 |
| 52 | ABL77013 | 26449 | 56953 | 87457, 117961, 148465, 178969, 209473 | 1142 | AGX21952 | 27539 | 58043 | 88547, 119051, 149555, 180059, 210563 |
| 53 | ABL77024 | 26450 | 56954 | 87458, 117962, 148466, 178970, 209474 | 1143 | AGX21963 | 27540 | 58044 | 88548, 119052, 149556, 180060, 210564 |
| 54 | ABL77035 | 26451 | 56955 | 87459, 117963, 148467, 178971, 209475 | 1144 | AGX21974 | 27541 | 58045 | 88549, 119053, 149557, 180061, 210565 |
| 55 | ABL77046 | 26452 | 56956 | 87460, 117964, 148468, 178972, 209476 | 1145 | AGX21985 | 27542 | 58046 | 88550, 119054, 149558, 180062, 210566 |
| 56 | ABL77057 | 26453 | 56957 | 87461, 117965, 148469, 178973, 209477 | 1146 | AGX21996 | 27543 | 58047 | 88551, 119055, 149559, 180063, 210567 |
| 57 | ABL77068 | 26454 | 56958 | 87462, 117966, 148470, 178974, 209478 | 1147 | AGX22007 | 27544 | 58048 | 88552, 119056, 149560, 180064, 210568 |
| 58 | ABL77090 | 26455 | 56959 | 87463, 117967, 148471, 178975, 209479 | 1148 | AGX22018 | 27545 | 58049 | 88553, 119057, 149561, 180065, 210569 |
| 59 | ABL77101 | 26456 | 56960 | 87464, 117968, 148472, 178976, 209480 | 1149 | AGX22029 | 27546 | 58050 | 88554, 119058, 149562, 180066, 210570 |
| 60 | ABL77134 | 26457 | 56961 | 87465, 117969, 148473, 178977, 209481 | 1150 | AGX22040 | 27547 | 58051 | 88555, 119059, 149563, 180067, 210571 |
| 61 | ABL77145 | 26458 | 56962 | 87466, 117970, 148474, 178978, 209482 | 1151 | AGX22051 | 27548 | 58052 | 88556, 119060, 149564, 180068, 210572 |
| 62 | ABL77156 | 26459 | 56963 | 87467, 117971, 148475, 178979, 209483 | 1152 | AGX22062 | 27549 | 58053 | 88557, 119061, 149565, 180069, 210573 |
| 63 | ABL77178 | 26460 | 56964 | 87468, 117972, 148476, 178980, 209484 | 1153 | AGX22073 | 27550 | 58054 | 88558, 119062, 149566, 180070, 210574 |
| 64 | ABL77189 | 26461 | 56965 | 87469, 117973, 148477, 178981, 209485 | 1154 | AGX22095 | 27551 | 58055 | 88559, 119063, 149567, 180071, 210575 |
| 65 | ABL77200 | 26462 | 56966 | 87470, 117974, 148478, 178982, 209486 | 1155 | AGX22106 | 27552 | 58056 | 88560, 119064, 149568, 180072, 210576 |

FIG. 2 continued

| | | | | | | | | | |
|---|---|---|---|---|---|---|---|---|---|
| 66 | ABL77222 | 26463 | 56967 | 87471, 117975, 148479, 178983, 209487 | 1156 | AGX22128 | 27553 | 58057 | 88561, 119065, 149569, 180073, 210577 |
| 67 | ABL77233 | 26464 | 56968 | 87472, 117976, 148480, 178984, 209488 | 1157 | AGX22139 | 27554 | 58058 | 88562, 119066, 149570, 180074, 210578 |
| 68 | ABL77244 | 26465 | 56969 | 87473, 117977, 148481, 178985, 209489 | 1158 | AGX22150 | 27555 | 58059 | 88563, 119067, 149571, 180075, 210579 |
| 69 | ABL77255 | 26466 | 56970 | 87474, 117978, 148482, 178986, 209490 | 1159 | AGX22161 | 27556 | 58060 | 88564, 119068, 149572, 180076, 210580 |
| 70 | ABL77266 | 26467 | 56971 | 87475, 117979, 148483, 178987, 209491 | 1160 | AGX22172 | 27557 | 58061 | 88565, 119069, 149573, 180077, 210581 |
| 71 | ABL77277 | 26468 | 56972 | 87476, 117980, 148484, 178988, 209492 | 1161 | AGX22183 | 27558 | 58062 | 88566, 119070, 149574, 180078, 210582 |
| 72 | ABL77288 | 26469 | 56973 | 87477, 117981, 148485, 178989, 209493 | 1162 | AGX22194 | 27559 | 58063 | 88567, 119071, 149575, 180079, 210583 |
| 73 | ABL77299 | 26470 | 56974 | 87478, 117982, 148486, 178990, 209494 | 1163 | AGX22205 | 27560 | 58064 | 88568, 119072, 149576, 180080, 210584 |
| 74 | ABL77310 | 26471 | 56975 | 87479, 117983, 148487, 178991, 209495 | 1164 | AGX22216 | 27561 | 58065 | 88569, 119073, 149577, 180081, 210585 |
| 75 | ABL77321 | 26472 | 56976 | 87480, 117984, 148488, 178992, 209496 | 1165 | AGX22227 | 27562 | 58066 | 88570, 119074, 149578, 180082, 210586 |
| 76 | ABL77332 | 26473 | 56977 | 87481, 117985, 148489, 178993, 209497 | 1166 | AGX22238 | 27563 | 58067 | 88571, 119075, 149579, 180083, 210587 |
| 77 | ABL77343 | 26474 | 56978 | 87482, 117986, 148490, 178994, 209498 | 1167 | AGX22249 | 27564 | 58068 | 88572, 119076, 149580, 180084, 210588 |
| 78 | ABL77365 | 26475 | 56979 | 87483, 117987, 148491, 178995, 209499 | 1168 | AGX22260 | 27565 | 58069 | 88573, 119077, 149581, 180085, 210589 |
| 79 | ABL84340 | 26476 | 56980 | 87484, 117988, 148492, 178996, 209500 | 1169 | AGX22271 | 27566 | 58070 | 88574, 119078, 149582, 180086, 210590 |
| 80 | ABN50382 | 26477 | 56981 | 87485, 117989, 148493, 178997, 209501 | 1170 | AGX22282 | 27567 | 58071 | 88575, 119079, 149583, 180087, 210591 |
| 81 | ABN50393 | 26478 | 56982 | 87486, 117990, 148494, 178998, 209502 | 1171 | AGX22293 | 27568 | 58072 | 88576, 119080, 149584, 180088, 210592 |
| 82 | ABN50404 | 26479 | 56983 | 87487, 117991, 148495, 178999, 209503 | 1172 | AGX22304 | 27569 | 58073 | 88577, 119081, 149585, 180089, 210593 |
| 83 | ABN50415 | 26480 | 56984 | 87488, 117992, 148496, 179000, 209504 | 1173 | AGX22315 | 27570 | 58074 | 88578, 119082, 149586, 180090, 210594 |

FIG. 2 continued

| | | | | | | | | | |
|---|---|---|---|---|---|---|---|---|---|
| 84 | ABN50426 | 26481 | 56985 | 87489, 117993, 148497, 179001, 209505 | 1174 | AGX22326 | 27571 | 58075 | 88579, 119083, 149587, 180091, 210595 |
| 85 | ABN50437 | 26482 | 56986 | 87490, 117994, 148498, 179002, 209506 | 1175 | AGX22337 | 27572 | 58076 | 88580, 119084, 149588, 180092, 210596 |
| 86 | ABN50459 | 26483 | 56987 | 87491, 117995, 148499, 179003, 209507 | 1176 | AGX22348 | 27573 | 58077 | 88581, 119085, 149589, 180093, 210597 |
| 87 | ABN50470 | 26484 | 56988 | 87492, 117996, 148500, 179004, 209508 | 1177 | AGX22359 | 27574 | 58078 | 88582, 119086, 149590, 180094, 210598 |
| 88 | ABN50481 | 26485 | 56989 | 87493, 117997, 148501, 179005, 209509 | 1178 | AGX22370 | 27575 | 58079 | 88583, 119087, 149591, 180095, 210599 |
| 89 | ABN50503 | 26486 | 56990 | 87494, 117998, 148502, 179006, 209510 | 1179 | AGX22381 | 27576 | 58080 | 88584, 119088, 149592, 180096, 210600 |
| 90 | ABN50514 | 26487 | 56991 | 87495, 117999, 148503, 179007, 209511 | 1180 | AGX22392 | 27577 | 58081 | 88585, 119089, 149593, 180097, 210601 |
| 91 | ABN50525 | 26488 | 56992 | 87496, 118000, 148504, 179008, 209512 | 1181 | AGX22403 | 27578 | 58082 | 88586, 119090, 149594, 180098, 210602 |
| 92 | ABN50536 | 26489 | 56993 | 87497, 118001, 148505, 179009, 209513 | 1182 | AGX22414 | 27579 | 58083 | 88587, 119091, 149595, 180099, 210603 |
| 93 | ABN50547 | 26490 | 56994 | 87498, 118002, 148506, 179010, 209514 | 1183 | AGX22425 | 27580 | 58084 | 88588, 119092, 149596, 180100, 210604 |
| 94 | ABN50558 | 26491 | 56995 | 87499, 118003, 148507, 179011, 209515 | 1184 | AGX22436 | 27581 | 58085 | 88589, 119093, 149597, 180101, 210605 |
| 95 | ABN50569 | 26492 | 56996 | 87500, 118004, 148508, 179012, 209516 | 1185 | AGX22445 | 27582 | 58086 | 88590, 119094, 149598, 180102, 210606 |
| 96 | ABN50580 | 26493 | 56997 | 87501, 118005, 148509, 179013, 209517 | 1186 | AGX22456 | 27583 | 58087 | 88591, 119095, 149599, 180103, 210607 |
| 97 | ABN50591 | 26494 | 56998 | 87502, 118006, 148510, 179014, 209518 | 1187 | AGX22467 | 27584 | 58088 | 88592, 119096, 149600, 180104, 210608 |
| 98 | ABN50602 | 26495 | 56999 | 87503, 118007, 148511, 179015, 209519 | 1188 | AGX22478 | 27585 | 58089 | 88593, 119097, 149601, 180105, 210609 |
| 99 | ABN50624 | 26496 | 57000 | 87504, 118008, 148512, 179016, 209520 | 1189 | AGX22489 | 27586 | 58090 | 88594, 119098, 149602, 180106, 210610 |
| 100 | ABN50635 | 26497 | 57001 | 87505, 118009, 148513, 179017, 209521 | 1190 | AGX22500 | 27587 | 58091 | 88595, 119099, 149603, 180107, 210611 |
| 101 | ABN50646 | 26498 | 57002 | 87506, 118010, 148514, 179018, 209522 | 1191 | AGX22511 | 27588 | 58092 | 88596, 119100, 149604, 180108, 210612 |

FIG. 2 continued

| | | | | | | | | | |
|---|---|---|---|---|---|---|---|---|---|
| 102 | ABN50657 | 26499 | 57003 | 87507, 118011, 148515, 179019, 209523 | 1192 | AGX22522 | 27589 | 58093 | 88597, 119101, 149605, 180109, 210613 |
| 103 | ABN50679 | 26500 | 57004 | 87508, 118012, 148516, 179020, 209524 | 1193 | AGX22533 | 27590 | 58094 | 88598, 119102, 149606, 180110, 210614 |
| 104 | ABN50690 | 26501 | 57005 | 87509, 118013, 148517, 179021, 209525 | 1194 | AGX22566 | 27591 | 58095 | 88599, 119103, 149607, 180111, 210615 |
| 105 | ABN50701 | 26502 | 57006 | 87510, 118014, 148518, 179022, 209526 | 1195 | AGX22577 | 27592 | 58096 | 88600, 119104, 149608, 180112, 210616 |
| 106 | ABN50712 | 26503 | 57007 | 87511, 118015, 148519, 179023, 209527 | 1196 | AGX22588 | 27593 | 58097 | 88601, 119105, 149609, 180113, 210617 |
| 107 | ABN50723 | 26504 | 57008 | 87512, 118016, 148520, 179024, 209528 | 1197 | AGX22599 | 27594 | 58098 | 88602, 119106, 149610, 180114, 210618 |
| 108 | ABN50734 | 26505 | 57009 | 87513, 118017, 148521, 179025, 209529 | 1198 | AGX22610 | 27595 | 58099 | 88603, 119107, 149611, 180115, 210619 |
| 109 | ABN50745 | 26506 | 57010 | 87514, 118018, 148522, 179026, 209530 | 1199 | AGX22621 | 27596 | 58100 | 88604, 119108, 149612, 180116, 210620 |
| 110 | ABN51184 | 26507 | 57011 | 87515, 118019, 148523, 179027, 209531 | 1200 | AGX22632 | 27597 | 58101 | 88605, 119109, 149613, 180117, 210621 |
| 111 | ABN51195 | 26508 | 57012 | 87516, 118020, 148524, 179028, 209532 | 1201 | AGX22643 | 27598 | 58102 | 88606, 119110, 149614, 180118, 210622 |
| 112 | ABN58661 | 26509 | 57013 | 87517, 118021, 148525, 179029, 209533 | 1202 | AGX22654 | 27599 | 58103 | 88607, 119111, 149615, 180119, 210623 |
| 113 | ABN59445 | 26510 | 57014 | 87518, 118022, 148526, 179030, 209534 | 1203 | AGX22665 | 27600 | 58104 | 88608, 119112, 149616, 180120, 210624 |
| 114 | AB072377 | 26511 | 57015 | 87519, 118023, 148527, 179031, 209535 | 1204 | AGX22676 | 27601 | 58105 | 88609, 119113, 149617, 180121, 210625 |
| 115 | ABR15973 | 26512 | 57016 | 87520, 118024, 148528, 179032, 209536 | 1205 | AGX22687 | 27602 | 58106 | 88610, 119114, 149618, 180122, 210626 |
| 116 | ABR15995 | 26513 | 57017 | 87521, 118025, 148529, 179033, 209537 | 1206 | AGX22698 | 27603 | 58107 | 88611, 119115, 149619, 180123, 210627 |
| 117 | ABR16017 | 26514 | 57018 | 87522, 118026, 148530, 179034, 209538 | 1207 | AGX22709 | 27604 | 58108 | 88612, 119116, 149620, 180124, 210628 |
| 118 | ACA64899 | 26515 | 57019 | 87523, 118027, 148531, 179035, 209539 | 1208 | AGX22720 | 27605 | 58109 | 88613, 119117, 149621, 180125, 210629 |
| 119 | ACA64932 | 26516 | 57020 | 87524, 118028, 148532, 179036, 209540 | 1209 | AGX22731 | 27606 | 58110 | 88614, 119118, 149622, 180126, 210630 |

FIG. 2 continued

| | | | | | | | | | |
|---|---|---|---|---|---|---|---|---|---|
| 120 | ACA64943 | 26517 | 57021 | 87525, 118029, 148533, 179037, 209541 | 1210 | AGX22742 | 27607 | 58111 | 88615, 119119, 149623, 180127, 210631 |
| 121 | ACA64954 | 26518 | 57022 | 87526, 118030, 148534, 179038, 209542 | 1211 | AGX22753 | 27608 | 58112 | 88616, 119120, 149624, 180128, 210632 |
| 122 | ACA64965 | 26519 | 57023 | 87527, 118031, 148535, 179039, 209543 | 1212 | AGX22764 | 27609 | 58113 | 88617, 119121, 149625, 180129, 210633 |
| 123 | ACA64998 | 26520 | 57024 | 87528, 118032, 148536, 179040, 209544 | 1213 | AGX22775 | 27610 | 58114 | 88618, 119122, 149626, 180130, 210634 |
| 124 | ACA65020 | 26521 | 57025 | 87529, 118033, 148537, 179041, 209545 | 1214 | AGX22786 | 27611 | 58115 | 88619, 119123, 149627, 180131, 210635 |
| 125 | ACA65031 | 26522 | 57026 | 87530, 118034, 148538, 179042, 209546 | 1215 | AGX22797 | 27612 | 58116 | 88620, 119124, 149628, 180132, 210636 |
| 126 | ACA65042 | 26523 | 57027 | 87531, 118035, 148539, 179043, 209547 | 1216 | AGX22808 | 27613 | 58117 | 88621, 119125, 149629, 180133, 210637 |
| 127 | ACA65053 | 26524 | 57028 | 87532, 118036, 148540, 179044, 209548 | 1217 | AGX22819 | 27614 | 58118 | 88622, 119126, 149630, 180134, 210638 |
| 128 | ACA65075 | 26525 | 57029 | 87533, 118037, 148541, 179045, 209549 | 1218 | AGX22830 | 27615 | 58119 | 88623, 119127, 149631, 180135, 210639 |
| 129 | ACA65086 | 26526 | 57030 | 87534, 118038, 148542, 179046, 209550 | 1219 | AGX22841 | 27616 | 58120 | 88624, 119128, 149632, 180136, 210640 |
| 130 | ACA65097 | 26527 | 57031 | 87535, 118039, 148543, 179047, 209551 | 1220 | AGX22852 | 27617 | 58121 | 88625, 119129, 149633, 180137, 210641 |
| 131 | ACA96552 | 26528 | 57032 | 87536, 118040, 148544, 179048, 209552 | 1221 | AGX22863 | 27618 | 58122 | 88626, 119130, 149634, 180138, 210642 |
| 132 | ACA96563 | 26529 | 57033 | 87537, 118041, 148545, 179049, 209553 | 1222 | AGX22874 | 27619 | 58123 | 88627, 119131, 149635, 180139, 210643 |
| 133 | ACA96574 | 26530 | 57034 | 87538, 118042, 148546, 179050, 209554 | 1223 | AGX22885 | 27620 | 58124 | 88628, 119132, 149636, 180140, 210644 |
| 134 | ACA96585 | 26531 | 57035 | 87539, 118043, 148547, 179051, 209555 | 1224 | AGX22896 | 27621 | 58125 | 88629, 119133, 149637, 180141, 210645 |
| 135 | ACA96596 | 26532 | 57036 | 87540, 118044, 148548, 179052, 209556 | 1225 | AGX22907 | 27622 | 58126 | 88630, 119134, 149638, 180142, 210646 |
| 136 | ACA96607 | 26533 | 57037 | 87541, 118045, 148549, 179053, 209557 | 1226 | AGX22918 | 27623 | 58127 | 88631, 119135, 149639, 180143, 210647 |
| 137 | ACA96618 | 26534 | 57038 | 87542, 118046, 148550, 179054, 209558 | 1227 | AGX22929 | 27624 | 58128 | 88632, 119136, 149640, 180144, 210648 |

FIG. 2 continued

| | | | | | | | | | |
|---|---|---|---|---|---|---|---|---|---|
| 138 | ACA96629 | 26535 | 57039 | 87543, 118047, 148551, 179055, 209559 | 1228 | AGX22940 | 27625 | 58129 | 88633, 119137, 149641, 180145, 210649 |
| 139 | ACA96640 | 26536 | 57040 | 87544, 118048, 148552, 179056, 209560 | 1229 | AGX22951 | 27626 | 58130 | 88634, 119138, 149642, 180146, 210650 |
| 140 | ACD56566 | 26537 | 57041 | 87545, 118049, 148553, 179057, 209561 | 1230 | AGX22962 | 27627 | 58131 | 88635, 119139, 149643, 180147, 210651 |
| 141 | ACD56577 | 26538 | 57042 | 87546, 118050, 148554, 179058, 209562 | 1231 | AGX22973 | 27628 | 58132 | 88636, 119140, 149644, 180148, 210652 |
| 142 | ACF41658 | 26539 | 57043 | 87547, 118051, 148555, 179059, 209563 | 1232 | AGX22984 | 27629 | 58133 | 88637, 119141, 149645, 180149, 210653 |
| 143 | ACF54136 | 26540 | 57044 | 87548, 118052, 148556, 179060, 209564 | 1233 | AGX22995 | 27630 | 58134 | 88638, 119142, 149646, 180150, 210654 |
| 144 | ACF54147 | 26541 | 57045 | 87549, 118053, 148557, 179061, 209565 | 1234 | AGX23006 | 27631 | 58135 | 88639, 119143, 149647, 180151, 210655 |
| 145 | ACF54158 | 26542 | 57046 | 87550, 118054, 148558, 179062, 209566 | 1235 | AGX23017 | 27632 | 58136 | 88640, 119144, 149648, 180152, 210656 |
| 146 | ACF54169 | 26543 | 57047 | 87551, 118055, 148559, 179063, 209567 | 1236 | AGX23028 | 27633 | 58137 | 88641, 119145, 149649, 180153, 210657 |
| 147 | ACF54180 | 26544 | 57048 | 87552, 118056, 148560, 179064, 209568 | 1237 | AGX23039 | 27634 | 58138 | 88642, 119146, 149650, 180154, 210658 |
| 148 | ACF54202 | 26545 | 57049 | 87553, 118057, 148561, 179065, 209569 | 1238 | AGX23050 | 27635 | 58139 | 88643, 119147, 149651, 180155, 210659 |
| 149 | ACF54213 | 26546 | 57050 | 87554, 118058, 148562, 179066, 209570 | 1239 | AGX23061 | 27636 | 58140 | 88644, 119148, 149652, 180156, 210660 |
| 150 | ACF54224 | 26547 | 57051 | 87555, 118059, 148563, 179067, 209571 | 1240 | AGX23072 | 27637 | 58141 | 88645, 119149, 149653, 180157, 210661 |
| 151 | ACF54257 | 26548 | 57052 | 87556, 118060, 148564, 179068, 209572 | 1241 | AGX23083 | 27638 | 58142 | 88646, 119150, 149654, 180158, 210662 |
| 152 | ACF54268 | 26549 | 57053 | 87557, 118061, 148565, 179069, 209573 | 1242 | AGX23094 | 27639 | 58143 | 88647, 119151, 149655, 180159, 210663 |
| 153 | ACF54279 | 26550 | 57054 | 87558, 118062, 148566, 179070, 209574 | 1243 | AGX23105 | 27640 | 58144 | 88648, 119152, 149656, 180160, 210664 |
| 154 | ACF54290 | 26551 | 57055 | 87559, 118063, 148567, 179071, 209575 | 1244 | AGX23116 | 27641 | 58145 | 88649, 119153, 149657, 180161, 210665 |
| 155 | ACF54312 | 26552 | 57056 | 87560, 118064, 148568, 179072, 209576 | 1245 | AGX23127 | 27642 | 58146 | 88650, 119154, 149658, 180162, 210666 |

FIG. 2 continued

| | | | | | | | | | |
|---|---|---|---|---|---|---|---|---|---|
| 156 | ACF54323 | 26553 | 57057 | 87561, 118065, 148569, 179073, 209577 | 1246 | AGX23138 | 27643 | 58147 | 88651, 119155, 149659, 180163, 210667 |
| 157 | ACF54345 | 26554 | 57058 | 87562, 118066, 148570, 179074, 209578 | 1247 | AGX23149 | 27644 | 58148 | 88652, 119156, 149660, 180164, 210668 |
| 158 | ACF54367 | 26555 | 57059 | 87563, 118067, 148571, 179075, 209579 | 1248 | AGX23160 | 27645 | 58149 | 88653, 119157, 149661, 180165, 210669 |
| 159 | ACN32556 | 26556 | 57060 | 87564, 118068, 148572, 179076, 209580 | 1249 | AGX23171 | 27646 | 58150 | 88654, 119158, 149662, 180166, 210670 |
| 160 | ACN32567 | 26557 | 57061 | 87565, 118069, 148573, 179077, 209581 | 1250 | AGX23182 | 27647 | 58151 | 88655, 119159, 149663, 180167, 210671 |
| 161 | ACN32578 | 26558 | 57062 | 87566, 118070, 148574, 179078, 209582 | 1251 | AGX23193 | 27648 | 58152 | 88656, 119160, 149664, 180168, 210672 |
| 162 | ACN32589 | 26559 | 57063 | 87567, 118071, 148575, 179079, 209583 | 1252 | AGX23204 | 27649 | 58153 | 88657, 119161, 149665, 180169, 210673 |
| 163 | ACN32600 | 26560 | 57064 | 87568, 118072, 148576, 179080, 209584 | 1253 | AGX23215 | 27650 | 58154 | 88658, 119162, 149666, 180170, 210674 |
| 164 | ACN32611 | 26561 | 57065 | 87569, 118073, 148577, 179081, 209585 | 1254 | AGX23226 | 27651 | 58155 | 88659, 119163, 149667, 180171, 210675 |
| 165 | ACN32716 | 26562 | 57066 | 87570, 118074, 148578, 179082, 209586 | 1255 | AGX23237 | 27652 | 58156 | 88660, 119164, 149668, 180172, 210676 |
| 166 | ACN32771 | 26563 | 57067 | 87571, 118075, 148579, 179083, 209587 | 1256 | AGX23248 | 27653 | 58157 | 88661, 119165, 149669, 180173, 210677 |
| 167 | ACN32782 | 26564 | 57068 | 87572, 118076, 148580, 179084, 209588 | 1257 | AGX23259 | 27654 | 58158 | 88662, 119166, 149670, 180174, 210678 |
| 168 | ACO05957 | 26565 | 57069 | 87573, 118077, 148581, 179085, 209589 | 1258 | AGX23270 | 27655 | 58159 | 88663, 119167, 149671, 180175, 210679 |
| 169 | ACO05968 | 26566 | 57070 | 87574, 118078, 148582, 179086, 209590 | 1259 | AGX23281 | 27656 | 58160 | 88664, 119168, 149672, 180176, 210680 |
| 170 | ACO05979 | 26567 | 57071 | 87575, 118079, 148583, 179087, 209591 | 1260 | AGX23292 | 27657 | 58161 | 88665, 119169, 149673, 180177, 210681 |
| 171 | ACO05990 | 26568 | 57072 | 87576, 118080, 148584, 179088, 209592 | 1261 | AGX23314 | 27658 | 58162 | 88666, 119170, 149674, 180178, 210682 |
| 172 | ACO06001 | 26569 | 57073 | 87577, 118081, 148585, 179089, 209593 | 1262 | AGX23325 | 27659 | 58163 | 88667, 119171, 149675, 180179, 210683 |
| 173 | ACO06012 | 26570 | 57074 | 87578, 118082, 148586, 179090, 209594 | 1263 | AGX23336 | 27660 | 58164 | 88668, 119172, 149676, 180180, 210684 |

FIG. 2 continued

| | | | | | | | | | |
|---|---|---|---|---|---|---|---|---|---|
| 174 | AC006023 | 26571 | 57075 | 87579, 118083, 148587, 179091, 209595 | 1264 | AGX23347 | 27661 | 58165 | 88669, 119173, 149677, 180181, 210685 |
| 175 | AC006062 | 26572 | 57076 | 87580, 118084, 148588, 179092, 209596 | 1265 | AGX23358 | 27662 | 58166 | 88670, 119174, 149678, 180182, 210686 |
| 176 | AC094661 | 26573 | 57077 | 87581, 118085, 148589, 179093, 209597 | 1266 | AGX23369 | 27663 | 58167 | 88671, 119175, 149679, 180183, 210687 |
| 177 | ACR15622 | 26574 | 57078 | 87582, 118086, 148590, 179094, 209598 | 1267 | AGX23380 | 27664 | 58168 | 88672, 119176, 149680, 180184, 210688 |
| 178 | ACR15633 | 26575 | 57079 | 87583, 118087, 148591, 179095, 209599 | 1268 | AGX23391 | 27665 | 58169 | 88673, 119177, 149681, 180185, 210689 |
| 179 | ACR15644 | 26576 | 57080 | 87584, 118088, 148592, 179096, 209600 | 1269 | AGX23413 | 27666 | 58170 | 88674, 119178, 149682, 180186, 210690 |
| 180 | ACR15655 | 26577 | 57081 | 87585, 118089, 148593, 179097, 209601 | 1270 | AGX23424 | 27667 | 58171 | 88675, 119179, 149683, 180187, 210691 |
| 181 | ACR15666 | 26578 | 57082 | 87586, 118090, 148594, 179098, 209602 | 1271 | AGX23435 | 27668 | 58172 | 88676, 119180, 149684, 180188, 210692 |
| 182 | ACR15677 | 26579 | 57083 | 87587, 118091, 148595, 179099, 209603 | 1272 | AGX23446 | 27669 | 58173 | 88677, 119181, 149685, 180189, 210693 |
| 183 | ACR15710 | 26580 | 57084 | 87588, 118092, 148596, 179100, 209604 | 1273 | AGX23457 | 27670 | 58174 | 88678, 119182, 149686, 180190, 210694 |
| 184 | ACR15721 | 26581 | 57085 | 87589, 118093, 148597, 179101, 209605 | 1274 | AGX23468 | 27671 | 58175 | 88679, 119183, 149687, 180191, 210695 |
| 185 | ACR39336 | 26582 | 57086 | 87590, 118094, 148598, 179102, 209606 | 1275 | AGX23479 | 27672 | 58176 | 88680, 119184, 149688, 180192, 210696 |
| 186 | AEA51386 | 26583 | 57087 | 87591, 118095, 148599, 179103, 209607 | 1276 | AGX23490 | 27673 | 58177 | 88681, 119185, 149689, 180193, 210697 |
| 187 | AEA51387 | 26584 | 57088 | 87592, 118096, 148600, 179104, 209608 | 1277 | AGX23501 | 27674 | 58178 | 88682, 119186, 149690, 180194, 210698 |
| 188 | AEA51388 | 26585 | 57089 | 87593, 118097, 148601, 179105, 209609 | 1278 | AGX23512 | 27675 | 58179 | 88683, 119187, 149691, 180195, 210699 |
| 189 | AEA51389 | 26586 | 57090 | 87594, 118098, 148602, 179106, 209610 | 1279 | AGX23523 | 27676 | 58180 | 88684, 119188, 149692, 180196, 210700 |
| 190 | AEA51390 | 26587 | 57091 | 87595, 118099, 148603, 179107, 209611 | 1280 | AGX23534 | 27677 | 58181 | 88685, 119189, 149693, 180197, 210701 |
| 191 | AEA51391 | 26588 | 57092 | 87596, 118100, 148604, 179108, 209612 | 1281 | AGX23545 | 27678 | 58182 | 88686, 119190, 149694, 180198, 210702 |

FIG. 2 continued

| | | | | | | | | | |
|---|---|---|---|---|---|---|---|---|---|
| 192 | AEA51392 | 26589 | 57093 | 87597, 118101, 148605, 179109, 209613 | 1282 | AGX23556 | 27679 | 58183 | 88687, 119191, 149695, 180199, 210703 |
| 193 | AEA51395 | 26590 | 57094 | 87598, 118102, 148606, 179110, 209614 | 1283 | AGX23567 | 27680 | 58184 | 88688, 119192, 149696, 180200, 210704 |
| 194 | AEA51398 | 26591 | 57095 | 87599, 118103, 148607, 179111, 209615 | 1284 | AGX23578 | 27681 | 58185 | 88689, 119193, 149697, 180201, 210705 |
| 195 | AEA51399 | 26592 | 57096 | 87600, 118104, 148608, 179112, 209616 | 1285 | AGX23600 | 27682 | 58186 | 88690, 119194, 149698, 180202, 210706 |
| 196 | AEG21014 | 26593 | 57097 | 87601, 118105, 148609, 179113, 209617 | 1286 | AGX23611 | 27683 | 58187 | 88691, 119195, 149699, 180203, 210707 |
| 197 | AEG21015 | 26594 | 57098 | 87602, 118106, 148610, 179114, 209618 | 1287 | AGX23622 | 27684 | 58188 | 88692, 119196, 149700, 180204, 210708 |
| 198 | AEG21016 | 26595 | 57099 | 87603, 118107, 148611, 179115, 209619 | 1288 | AGX23633 | 27685 | 58189 | 88693, 119197, 149701, 180205, 210709 |
| 199 | AEG21017 | 26596 | 57100 | 87604, 118108, 148612, 179116, 209620 | 1289 | AGX23644 | 27686 | 58190 | 88694, 119198, 149702, 180206, 210710 |
| 200 | AEG21018 | 26597 | 57101 | 87605, 118109, 148613, 179117, 209621 | 1290 | AGX23655 | 27687 | 58191 | 88695, 119199, 149703, 180207, 210711 |
| 201 | AEG21019 | 26598 | 57102 | 87606, 118110, 148614, 179118, 209622 | 1291 | AGX23666 | 27688 | 58192 | 88696, 119200, 149704, 180208, 210712 |
| 202 | AEG21021 | 26599 | 57103 | 87607, 118111, 148615, 179119, 209623 | 1292 | AGX23677 | 27689 | 58193 | 88697, 119201, 149705, 180209, 210713 |
| 203 | AEG21022 | 26600 | 57104 | 87608, 118112, 148616, 179120, 209624 | 1293 | AGX23688 | 27690 | 58194 | 88698, 119202, 149706, 180210, 210714 |
| 204 | AEG21023 | 26601 | 57105 | 87609, 118113, 148617, 179121, 209625 | 1294 | AGX23699 | 27691 | 58195 | 88699, 119203, 149707, 180211, 210715 |
| 205 | AEG21024 | 26602 | 57106 | 87610, 118114, 148618, 179122, 209626 | 1295 | AGX23710 | 27692 | 58196 | 88700, 119204, 149708, 180212, 210716 |
| 206 | AEG21025 | 26603 | 57107 | 87611, 118115, 148619, 179123, 209627 | 1296 | AGX23721 | 27693 | 58197 | 88701, 119205, 149709, 180213, 210717 |
| 207 | AEG21026 | 26604 | 57108 | 87612, 118116, 148620, 179124, 209628 | 1297 | AGX23732 | 27694 | 58198 | 88702, 119206, 149710, 180214, 210718 |
| 208 | AEG21027 | 26605 | 57109 | 87613, 118117, 148621, 179125, 209629 | 1298 | AGX23743 | 27695 | 58199 | 88703, 119207, 149711, 180215, 210719 |
| 209 | AEG21028 | 26606 | 57110 | 87614, 118118, 148622, 179126, 209630 | 1299 | AGX23754 | 27696 | 58200 | 88704, 119208, 149712, 180216, 210720 |

FIG. 2 continued

| | | | | | | | | | |
|---|---|---|---|---|---|---|---|---|---|
| 210 | AEG21029 | 26607 | 57111 | 87615, 118119, 148623, 179127, 209631 | 1300 | AGX23765 | 27697 | 58201 | 88705, 119209, 149713, 180217, 210721 |
| 211 | AE080052 | 26608 | 57112 | 87616, 118120, 148624, 179128, 209632 | 1301 | AGX23776 | 27698 | 58202 | 88706, 119210, 149714, 180218, 210722 |
| 212 | AE080067 | 26609 | 57113 | 87617, 118121, 148625, 179129, 209633 | 1302 | AGX23787 | 27699 | 58203 | 88707, 119211, 149715, 180219, 210723 |
| 213 | AE080078 | 26610 | 57114 | 87618, 118122, 148626, 179130, 209634 | 1303 | AGX23798 | 27700 | 58204 | 88708, 119212, 149716, 180220, 210724 |
| 214 | AE080086 | 26611 | 57115 | 87619, 118123, 148627, 179131, 209635 | 1304 | AGX23809 | 27701 | 58205 | 88709, 119213, 149717, 180221, 210725 |
| 215 | AE080097 | 26612 | 57116 | 87620, 118124, 148628, 179132, 209636 | 1305 | AGX23820 | 27702 | 58206 | 88710, 119214, 149718, 180222, 210726 |
| 216 | AE080108 | 26613 | 57117 | 87621, 118125, 148629, 179133, 209637 | 1306 | AGX23831 | 27703 | 58207 | 88711, 119215, 149719, 180223, 210727 |
| 217 | AE080145 | 26614 | 57118 | 87622, 118126, 148630, 179134, 209638 | 1307 | AGX23842 | 27704 | 58208 | 88712, 119216, 149720, 180224, 210728 |
| 218 | AE080154 | 26615 | 57119 | 87623, 118127, 148631, 179135, 209639 | 1308 | AGX23853 | 27705 | 58209 | 88713, 119217, 149721, 180225, 210729 |
| 219 | AE080183 | 26616 | 57120 | 87624, 118128, 148632, 179136, 209640 | 1309 | AGX23864 | 27706 | 58210 | 88714, 119218, 149722, 180226, 210730 |
| 220 | AE080194 | 26617 | 57121 | 87625, 118129, 148633, 179137, 209641 | 1310 | AGX23875 | 27707 | 58211 | 88715, 119219, 149723, 180227, 210731 |
| 221 | AE080205 | 26618 | 57122 | 87626, 118130, 148634, 179138, 209642 | 1311 | AGX23886 | 27708 | 58212 | 88716, 119220, 149724, 180228, 210732 |
| 222 | AE080216 | 26619 | 57123 | 87627, 118131, 148635, 179139, 209643 | 1312 | AGX23897 | 27709 | 58213 | 88717, 119221, 149725, 180229, 210733 |
| 223 | AE080227 | 26620 | 57124 | 87628, 118132, 148636, 179140, 209644 | 1313 | AGX23908 | 27710 | 58214 | 88718, 119222, 149726, 180230, 210734 |
| 224 | AE080238 | 26621 | 57125 | 87629, 118133, 148637, 179141, 209645 | 1314 | AGX23919 | 27711 | 58215 | 88719, 119223, 149727, 180231, 210735 |
| 225 | AEP20178 | 26622 | 57126 | 87630, 118134, 148638, 179142, 209646 | 1315 | AGX23930 | 27712 | 58216 | 88720, 119224, 149728, 180232, 210736 |
| 226 | AEP20189 | 26623 | 57127 | 87631, 118135, 148639, 179143, 209647 | 1316 | AGX23941 | 27713 | 58217 | 88721, 119225, 149729, 180233, 210737 |
| 227 | AEP20200 | 26624 | 57128 | 87632, 118136, 148640, 179144, 209648 | 1317 | AGX23952 | 27714 | 58218 | 88722, 119226, 149730, 180234, 210738 |

FIG. 2 continued

| | | | | | | | | | |
|---|---|---|---|---|---|---|---|---|---|
| 228 | AEP20211 | 26625 | 57129 | 87633, 118137, 148641, 179145, 209649 | 1318 | AGX23963 | 27715 | 58219 | 88723, 119227, 149731, 180235, 210739 |
| 229 | AEP20222 | 26626 | 57130 | 87634, 118138, 148642, 179146, 209650 | 1319 | AGX23974 | 27716 | 58220 | 88724, 119228, 149732, 180236, 210740 |
| 230 | AEP20233 | 26627 | 57131 | 87635, 118139, 148643, 179147, 209651 | 1320 | AGX23985 | 27717 | 58221 | 88725, 119229, 149733, 180237, 210741 |
| 231 | AEP20244 | 26628 | 57132 | 87636, 118140, 148644, 179148, 209652 | 1321 | AGX23996 | 27718 | 58222 | 88726, 119230, 149734, 180238, 210742 |
| 232 | AEP20255 | 26629 | 57133 | 87637, 118141, 148645, 179149, 209653 | 1322 | AGX24007 | 27719 | 58223 | 88727, 119231, 149735, 180239, 210743 |
| 233 | AEP20277 | 26630 | 57134 | 87638, 118142, 148646, 179150, 209654 | 1323 | AGX24018 | 27720 | 58224 | 88728, 119232, 149736, 180240, 210744 |
| 234 | AEP20299 | 26631 | 57135 | 87639, 118143, 148647, 179151, 209655 | 1324 | AGX24029 | 27721 | 58225 | 88729, 119233, 149737, 180241, 210745 |
| 235 | AEP20310 | 26632 | 57136 | 87640, 118144, 148648, 179152, 209656 | 1325 | AGX24040 | 27722 | 58226 | 88730, 119234, 149738, 180242, 210746 |
| 236 | AEP20332 | 26633 | 57137 | 87641, 118145, 148649, 179153, 209657 | 1326 | AGX24051 | 27723 | 58227 | 88731, 119235, 149739, 180243, 210747 |
| 237 | AEP20343 | 26634 | 57138 | 87642, 118146, 148650, 179154, 209658 | 1327 | AGX24062 | 27724 | 58228 | 88732, 119236, 149740, 180244, 210748 |
| 238 | AEP20354 | 26635 | 57139 | 87643, 118147, 148651, 179155, 209659 | 1328 | AGX24073 | 27725 | 58229 | 88733, 119237, 149741, 180245, 210749 |
| 239 | AEP20365 | 26636 | 57140 | 87644, 118148, 148652, 179156, 209660 | 1329 | AGX24084 | 27726 | 58230 | 88734, 119238, 149742, 180246, 210750 |
| 240 | AEP20376 | 26637 | 57141 | 87645, 118149, 148653, 179157, 209661 | 1330 | AGX24095 | 27727 | 58231 | 88735, 119239, 149743, 180247, 210751 |
| 241 | AEP20398 | 26638 | 57142 | 87646, 118150, 148654, 179158, 209662 | 1331 | AGX24106 | 27728 | 58232 | 88736, 119240, 149744, 180248, 210752 |
| 242 | AEP20409 | 26639 | 57143 | 87647, 118151, 148655, 179159, 209663 | 1332 | AGX24117 | 27729 | 58233 | 88737, 119241, 149745, 180249, 210753 |
| 243 | AEP20420 | 26640 | 57144 | 87648, 118152, 148656, 179160, 209664 | 1333 | AGX24128 | 27730 | 58234 | 88738, 119242, 149746, 180250, 210754 |
| 244 | AEP20431 | 26641 | 57145 | 87649, 118153, 148657, 179161, 209665 | 1334 | AGX24139 | 27731 | 58235 | 88739, 119243, 149747, 180251, 210755 |
| 245 | AEP20442 | 26642 | 57146 | 87650, 118154, 148658, 179162, 209666 | 1335 | AGX24150 | 27732 | 58236 | 88740, 119244, 149748, 180252, 210756 |

FIG. 2 continued

| | | | | | | | | | |
|---|---|---|---|---|---|---|---|---|---|
| 246 | AEP20453 | 26643 | 57147 | 87651, 118155, 148659, 179163, 209667 | 1336 | AGX24161 | 27733 | 58237 | 88741, 119245, 149749, 180253, 210757 |
| 247 | AEQ39027 | 26644 | 57148 | 87652, 118156, 148660, 179164, 209668 | 1337 | AGX24172 | 27734 | 58238 | 88742, 119246, 149750, 180254, 210758 |
| 248 | AEQ39260 | 26645 | 57149 | 87653, 118157, 148661, 179165, 209669 | 1338 | AGX24183 | 27735 | 58239 | 88743, 119247, 149751, 180255, 210759 |
| 249 | AEQ39271 | 26646 | 57150 | 87654, 118158, 148662, 179166, 209670 | 1339 | AGX24194 | 27736 | 58240 | 88744, 119248, 149752, 180256, 210760 |
| 250 | AEQ39282 | 26647 | 57151 | 87655, 118159, 148663, 179167, 209671 | 1340 | AGX24205 | 27737 | 58241 | 88745, 119249, 149753, 180257, 210761 |
| 251 | AEQ39315 | 26648 | 57152 | 87656, 118160, 148664, 179168, 209672 | 1341 | AGX24227 | 27738 | 58242 | 88746, 119250, 149754, 180258, 210762 |
| 252 | AEQ39326 | 26649 | 57153 | 87657, 118161, 148665, 179169, 209673 | 1342 | AGX24238 | 27739 | 58243 | 88747, 119251, 149755, 180259, 210763 |
| 253 | AEQ39337 | 26650 | 57154 | 87658, 118162, 148666, 179170, 209674 | 1343 | AGX24249 | 27740 | 58244 | 88748, 119252, 149756, 180260, 210764 |
| 254 | AEQ39348 | 26651 | 57155 | 87659, 118163, 148667, 179171, 209675 | 1344 | AGX24260 | 27741 | 58245 | 88749, 119253, 149757, 180261, 210765 |
| 255 | AEQ39359 | 26652 | 57156 | 87660, 118164, 148668, 179172, 209676 | 1345 | AGX24271 | 27742 | 58246 | 88750, 119254, 149758, 180262, 210766 |
| 256 | AEQ39370 | 26653 | 57157 | 87661, 118165, 148669, 179173, 209677 | 1346 | AGX24282 | 27743 | 58247 | 88751, 119255, 149759, 180263, 210767 |
| 257 | AEQ39392 | 26654 | 57158 | 87662, 118166, 148670, 179174, 209678 | 1347 | AGX24293 | 27744 | 58248 | 88752, 119256, 149760, 180264, 210768 |
| 258 | AEQ39429 | 26655 | 57159 | 87663, 118167, 148671, 179175, 209679 | 1348 | AGX24304 | 27745 | 58249 | 88753, 119257, 149761, 180265, 210769 |
| 259 | AEQ39440 | 26656 | 57160 | 87664, 118168, 148672, 179176, 209680 | 1349 | AGX24315 | 27746 | 58250 | 88754, 119258, 149762, 180266, 210770 |
| 260 | AEQ39451 | 26657 | 57161 | 87665, 118169, 148673, 179177, 209681 | 1350 | AGX24326 | 27747 | 58251 | 88755, 119259, 149763, 180267, 210771 |
| 261 | AEQ39462 | 26658 | 57162 | 87666, 118170, 148674, 179178, 209682 | 1351 | AGX24337 | 27748 | 58252 | 88756, 119260, 149764, 180268, 210772 |
| 262 | AEQ39484 | 26659 | 57163 | 87667, 118171, 148675, 179179, 209683 | 1352 | AGX24348 | 27749 | 58253 | 88757, 119261, 149765, 180269, 210773 |
| 263 | AEQ39506 | 26660 | 57164 | 87668, 118172, 148676, 179180, 209684 | 1353 | AGX24359 | 27750 | 58254 | 88758, 119262, 149766, 180270, 210774 |

FIG. 2 continued

| | | | | | | | | | |
|---|---|---|---|---|---|---|---|---|---|
| 264 | AEQ39517 | 26661 | 57165 | 87669, 118173, 148677, 179181, 209685 | 1354 | AGX24381 | 27751 | 58255 | 88759, 119263, 149767, 180271, 210775 |
| 265 | AER27038 | 26662 | 57166 | 87670, 118174, 148678, 179182, 209686 | 1355 | AGX24392 | 27752 | 58256 | 88760, 119264, 149768, 180272, 210776 |
| 266 | AER27060 | 26663 | 57167 | 87671, 118175, 148679, 179183, 209687 | 1356 | AGX24403 | 27753 | 58257 | 88761, 119265, 149769, 180273, 210777 |
| 267 | AET10061 | 26664 | 57168 | 87672, 118176, 148680, 179184, 209688 | 1357 | AGX24414 | 27754 | 58258 | 88762, 119266, 149770, 180274, 210778 |
| 268 | AET10062 | 26665 | 57169 | 87673, 118177, 148681, 179185, 209689 | 1358 | AGX24425 | 27755 | 58259 | 88763, 119267, 149771, 180275, 210779 |
| 269 | AET10064 | 26666 | 57170 | 87674, 118178, 148682, 179186, 209690 | 1359 | AGX24436 | 27756 | 58260 | 88764, 119268, 149772, 180276, 210780 |
| 270 | AET10065 | 26667 | 57171 | 87675, 118179, 148683, 179187, 209691 | 1360 | AGX24447 | 27757 | 58261 | 88765, 119269, 149773, 180277, 210781 |
| 271 | AET10066 | 26668 | 57172 | 87676, 118180, 148684, 179188, 209692 | 1361 | AGX24458 | 27758 | 58262 | 88766, 119270, 149774, 180278, 210782 |
| 272 | AET10067 | 26669 | 57173 | 87677, 118181, 148685, 179189, 209693 | 1362 | AGX24469 | 27759 | 58263 | 88767, 119271, 149775, 180279, 210783 |
| 273 | AET10068 | 26670 | 57174 | 87678, 118182, 148686, 179190, 209694 | 1363 | AGX24480 | 27760 | 58264 | 88768, 119272, 149776, 180280, 210784 |
| 274 | AET10069 | 26671 | 57175 | 87679, 118183, 148687, 179191, 209695 | 1364 | AGX24491 | 27761 | 58265 | 88769, 119273, 149777, 180281, 210785 |
| 275 | AET10070 | 26672 | 57176 | 87680, 118184, 148688, 179192, 209696 | 1365 | AGX24502 | 27762 | 58266 | 88770, 119274, 149778, 180282, 210786 |
| 276 | AET10071 | 26673 | 57177 | 87681, 118185, 148689, 179193, 209697 | 1366 | AGX24513 | 27763 | 58267 | 88771, 119275, 149779, 180283, 210787 |
| 277 | AET10072 | 26674 | 57178 | 87682, 118186, 148690, 179194, 209698 | 1367 | AGX24524 | 27764 | 58268 | 88772, 119276, 149780, 180284, 210788 |
| 278 | AET10073 | 26675 | 57179 | 87683, 118187, 148691, 179195, 209699 | 1368 | AGX24535 | 27765 | 58269 | 88773, 119277, 149781, 180285, 210789 |
| 279 | AET10074 | 26676 | 57180 | 87684, 118188, 148692, 179196, 209700 | 1369 | AGX24546 | 27766 | 58270 | 88774, 119278, 149782, 180286, 210790 |
| 280 | AET10076 | 26677 | 57181 | 87685, 118189, 148693, 179197, 209701 | 1370 | AGX24557 | 27767 | 58271 | 88775, 119279, 149783, 180287, 210791 |
| 281 | AET10077 | 26678 | 57182 | 87686, 118190, 148694, 179198, 209702 | 1371 | AGX24579 | 27768 | 58272 | 88776, 119280, 149784, 180288, 210792 |

FIG. 2 continued

| | | | | | | | | | |
|---|---|---|---|---|---|---|---|---|---|
| 282 | AET10078 | 26679 | 57183 | 87687, 118191, 148695, 179199, 209703 | 1372 | AGX24590 | 27769 | 58273 | 88777, 119281, 149785, 180289, 210793 |
| 283 | AET10079 | 26680 | 57184 | 87688, 118192, 148696, 179200, 209704 | 1373 | AGX24601 | 27770 | 58274 | 88778, 119282, 149786, 180290, 210794 |
| 284 | AET10080 | 26681 | 57185 | 87689, 118193, 148697, 179201, 209705 | 1374 | AGX24612 | 27771 | 58275 | 88779, 119283, 149787, 180291, 210795 |
| 285 | AET10081 | 26682 | 57186 | 87690, 118194, 148698, 179202, 209706 | 1375 | AGX24623 | 27772 | 58276 | 88780, 119284, 149788, 180292, 210796 |
| 286 | AET10082 | 26683 | 57187 | 87691, 118195, 148699, 179203, 209707 | 1376 | AGX24634 | 27773 | 58277 | 88781, 119285, 149789, 180293, 210797 |
| 287 | AET10083 | 26684 | 57188 | 87692, 118196, 148700, 179204, 209708 | 1377 | AGX24656 | 27774 | 58278 | 88782, 119286, 149790, 180294, 210798 |
| 288 | AET10084 | 26685 | 57189 | 87693, 118197, 148701, 179205, 209709 | 1378 | AGX24667 | 27775 | 58279 | 88783, 119287, 149791, 180295, 210799 |
| 289 | AET10085 | 26686 | 57190 | 87694, 118198, 148702, 179206, 209710 | 1379 | AGX24678 | 27776 | 58280 | 88784, 119288, 149792, 180296, 210800 |
| 290 | AET43124 | 26687 | 57191 | 87695, 118199, 148703, 179207, 209711 | 1380 | AGX24689 | 27777 | 58281 | 88785, 119289, 149793, 180297, 210801 |
| 291 | AET43135 | 26688 | 57192 | 87696, 118200, 148704, 179208, 209712 | 1381 | AGX24700 | 27778 | 58282 | 88786, 119290, 149794, 180298, 210802 |
| 292 | AET43146 | 26689 | 57193 | 87697, 118201, 148705, 179209, 209713 | 1382 | AGX24711 | 27779 | 58283 | 88787, 119291, 149795, 180299, 210803 |
| 293 | AET43157 | 26690 | 57194 | 87698, 118202, 148706, 179210, 209714 | 1383 | AGX24722 | 27780 | 58284 | 88788, 119292, 149796, 180300, 210804 |
| 294 | AET43168 | 26691 | 57195 | 87699, 118203, 148707, 179211, 209715 | 1384 | AGX24733 | 27781 | 58285 | 88789, 119293, 149797, 180301, 210805 |
| 295 | AET43179 | 26692 | 57196 | 87700, 118204, 148708, 179212, 209716 | 1385 | AGX24744 | 27782 | 58286 | 88790, 119294, 149798, 180302, 210806 |
| 296 | AET43190 | 26693 | 57197 | 87701, 118205, 148709, 179213, 209717 | 1386 | AGX24755 | 27783 | 58287 | 88791, 119295, 149799, 180303, 210807 |
| 297 | AET43201 | 26694 | 57198 | 87702, 118206, 148710, 179214, 209718 | 1387 | AGX24766 | 27784 | 58288 | 88792, 119296, 149800, 180304, 210808 |
| 298 | AET43212 | 26695 | 57199 | 87703, 118207, 148711, 179215, 209719 | 1388 | AGX24777 | 27785 | 58289 | 88793, 119297, 149801, 180305, 210809 |
| 299 | AET43223 | 26696 | 57200 | 87704, 118208, 148712, 179216, 209720 | 1389 | AGX24788 | 27786 | 58290 | 88794, 119298, 149802, 180306, 210810 |

FIG. 2 continued

| | | | | | | | | | |
|---|---|---|---|---|---|---|---|---|---|
| 300 | AET50943 | 26697 | 57201 | 87705, 118209, 148713, 179217, 209721 | 1390 | AGX24799 | 27787 | 58291 | 88795, 119299, 149803, 180307, 210811 |
| 301 | AET50954 | 26698 | 57202 | 87706, 118210, 148714, 179218, 209722 | 1391 | AGX24810 | 27788 | 58292 | 88796, 119300, 149804, 180308, 210812 |
| 302 | AET50965 | 26699 | 57203 | 87707, 118211, 148715, 179219, 209723 | 1392 | AGX24821 | 27789 | 58293 | 88797, 119301, 149805, 180309, 210813 |
| 303 | AET50976 | 26700 | 57204 | 87708, 118212, 148716, 179220, 209724 | 1393 | AGX24832 | 27790 | 58294 | 88798, 119302, 149806, 180310, 210814 |
| 304 | AET74255 | 26701 | 57205 | 87709, 118213, 148717, 179221, 209725 | 1394 | AGX24843 | 27791 | 58295 | 88799, 119303, 149807, 180311, 210815 |
| 305 | AET74277 | 26702 | 57206 | 87710, 118214, 148718, 179222, 209726 | 1395 | AGX24854 | 27792 | 58296 | 88800, 119304, 149808, 180312, 210816 |
| 306 | AET74288 | 26703 | 57207 | 87711, 118215, 148719, 179223, 209727 | 1396 | AGX24865 | 27793 | 58297 | 88801, 119305, 149809, 180313, 210817 |
| 307 | AET74299 | 26704 | 57208 | 87712, 118216, 148720, 179224, 209728 | 1397 | AGX24876 | 27794 | 58298 | 88802, 119306, 149810, 180314, 210818 |
| 308 | AET74329 | 26705 | 57209 | 87713, 118217, 148721, 179225, 209729 | 1398 | AGX24887 | 27795 | 58299 | 88803, 119307, 149811, 180315, 210819 |
| 309 | AET74340 | 26706 | 57210 | 87714, 118218, 148722, 179226, 209730 | 1399 | AGX24898 | 27796 | 58300 | 88804, 119308, 149812, 180316, 210820 |
| 310 | AET74351 | 26707 | 57211 | 87715, 118219, 148723, 179227, 209731 | 1400 | AGX84854 | 27797 | 58301 | 88805, 119309, 149813, 180317, 210821 |
| 311 | AEY69077 | 26708 | 57212 | 87716, 118220, 148724, 179228, 209732 | 1401 | AGX84865 | 27798 | 58302 | 88806, 119310, 149814, 180318, 210822 |
| 312 | AFB77676 | 26709 | 57213 | 87717, 118221, 148725, 179229, 209733 | 1402 | AGX84876 | 27799 | 58303 | 88807, 119311, 149815, 180319, 210823 |
| 313 | AFB77677 | 26710 | 57214 | 87718, 118222, 148726, 179230, 209734 | 1403 | AGX84887 | 27800 | 58304 | 88808, 119312, 149816, 180320, 210824 |
| 314 | AFB77678 | 26711 | 57215 | 87719, 118223, 148727, 179231, 209735 | 1404 | AGX84898 | 27801 | 58305 | 88809, 119313, 149817, 180321, 210825 |
| 315 | AFB77679 | 26712 | 57216 | 87720, 118224, 148728, 179232, 209736 | 1405 | AGX84920 | 27802 | 58306 | 88810, 119314, 149818, 180322, 210826 |
| 316 | AFB77680 | 26713 | 57217 | 87721, 118225, 148729, 179233, 209737 | 1406 | AGZ59821 | 27803 | 58307 | 88811, 119315, 149819, 180323, 210827 |
| 317 | AFB77681 | 26714 | 57218 | 87722, 118226, 148730, 179234, 209738 | 1407 | AGZ59832 | 27804 | 58308 | 88812, 119316, 149820, 180324, 210828 |

FIG. 2 continued

| | | | | | | | | | |
|---|---|---|---|---|---|---|---|---|---|
| 318 | AFB77682 | 26715 | 57219 | 87723, 118227, 148731, 179235, 209739 | 1408 | AGZ59843 | 27805 | 58309 | 88813, 119317, 149821, 180325, 210829 |
| 319 | AFB77683 | 26716 | 57220 | 87724, 118228, 148732, 179236, 209740 | 1409 | AGZ59854 | 27806 | 58310 | 88814, 119318, 149822, 180326, 210830 |
| 320 | AFB77684 | 26717 | 57221 | 87725, 118229, 148733, 179237, 209741 | 1410 | AGZ59865 | 27807 | 58311 | 88815, 119319, 149823, 180327, 210831 |
| 321 | AFB77685 | 26718 | 57222 | 87726, 118230, 148734, 179238, 209742 | 1411 | AGZ59876 | 27808 | 58312 | 88816, 119320, 149824, 180328, 210832 |
| 322 | AFB77686 | 26719 | 57223 | 87727, 118231, 148735, 179239, 209743 | 1412 | AGZ59887 | 27809 | 58313 | 88817, 119321, 149825, 180329, 210833 |
| 323 | AFB77687 | 26720 | 57224 | 87728, 118232, 148736, 179240, 209744 | 1413 | AGZ59898 | 27810 | 58314 | 88818, 119322, 149826, 180330, 210834 |
| 324 | AFB77688 | 26721 | 57225 | 87729, 118233, 148737, 179241, 209745 | 1414 | AGZ59909 | 27811 | 58315 | 88819, 119323, 149827, 180331, 210835 |
| 325 | AFB77689 | 26722 | 57226 | 87730, 118234, 148738, 179242, 209746 | 1415 | AGZ59920 | 27812 | 58316 | 88820, 119324, 149828, 180332, 210836 |
| 326 | AFB77690 | 26723 | 57227 | 87731, 118235, 148739, 179243, 209747 | 1416 | AGZ59931 | 27813 | 58317 | 88821, 119325, 149829, 180333, 210837 |
| 327 | AFE00360 | 26724 | 57228 | 87732, 118236, 148740, 179244, 209748 | 1417 | AGZ59942 | 27814 | 58318 | 88822, 119326, 149830, 180334, 210838 |
| 328 | AFF18534 | 26725 | 57229 | 87733, 118237, 148741, 179245, 209749 | 1418 | AGZ59953 | 27815 | 58319 | 88823, 119327, 149831, 180335, 210839 |
| 329 | AFF18543 | 26726 | 57230 | 87734, 118238, 148742, 179246, 209750 | 1419 | AGZ59965 | 27816 | 58320 | 88824, 119328, 149832, 180336, 210840 |
| 330 | AFG48978 | 26727 | 57231 | 87735, 118239, 148743, 179247, 209751 | 1420 | AGZ59976 | 27817 | 58321 | 88825, 119329, 149833, 180337, 210841 |
| 331 | AFG48997 | 26728 | 57232 | 87736, 118240, 148744, 179248, 209752 | 1421 | AGZ59987 | 27818 | 58322 | 88826, 119330, 149834, 180338, 210842 |
| 332 | AFG48998 | 26729 | 57233 | 87737, 118241, 148745, 179249, 209753 | 1422 | AGZ59999 | 27819 | 58323 | 88827, 119331, 149835, 180339, 210843 |
| 333 | AFG49012 | 26730 | 57234 | 87738, 118242, 148746, 179250, 209754 | 1423 | AGZ60010 | 27820 | 58324 | 88828, 119332, 149836, 180340, 210844 |
| 334 | AFG49013 | 26731 | 57235 | 87739, 118243, 148747, 179251, 209755 | 1424 | AGZ60021 | 27821 | 58325 | 88829, 119333, 149837, 180341, 210845 |
| 335 | AFH57865 | 26732 | 57236 | 87740, 118244, 148748, 179252, 209756 | 1425 | AGZ60033 | 27822 | 58326 | 88830, 119334, 149838, 180342, 210846 |

FIG. 2 continued

| | | | | | | | | | |
|---|---|---|---|---|---|---|---|---|---|
| 336 | AFH57876 | 26733 | 57237 | 87741, 118245, 148749, 179253, 209757 | 1426 | AGZ60044 | 27823 | 58327 | 88831, 119335, 149839, 180343, 210847 |
| 337 | AFH57942 | 26734 | 57238 | 87742, 118246, 148750, 179254, 209758 | 1427 | AGZ60055 | 27824 | 58328 | 88832, 119336, 149840, 180344, 210848 |
| 338 | AFH57986 | 26735 | 57239 | 87743, 118247, 148751, 179255, 209759 | 1428 | AGZ60066 | 27825 | 58329 | 88833, 119337, 149841, 180345, 210849 |
| 339 | AFH58249 | 26736 | 57240 | 87744, 118248, 148752, 179256, 209760 | 1429 | AGZ60077 | 27826 | 58330 | 88834, 119338, 149842, 180346, 210850 |
| 340 | AFH58260 | 26737 | 57241 | 87745, 118249, 148753, 179257, 209761 | 1430 | AGZ60088 | 27827 | 58331 | 88835, 119339, 149843, 180347, 210851 |
| 341 | AFH58271 | 26738 | 57242 | 87746, 118250, 148754, 179258, 209762 | 1431 | AGZ60099 | 27828 | 58332 | 88836, 119340, 149844, 180348, 210852 |
| 342 | AFH58282 | 26739 | 57243 | 87747, 118251, 148755, 179259, 209763 | 1432 | AGZ60131 | 27829 | 58333 | 88837, 119341, 149845, 180349, 210853 |
| 343 | AFH58293 | 26740 | 57244 | 87748, 118252, 148756, 179260, 209764 | 1433 | AGZ60142 | 27830 | 58334 | 88838, 119342, 149846, 180350, 210854 |
| 344 | AFH58304 | 26741 | 57245 | 87749, 118253, 148757, 179261, 209765 | 1434 | AGZ60160 | 27831 | 58335 | 88839, 119343, 149847, 180351, 210855 |
| 345 | AFH58315 | 26742 | 57246 | 87750, 118254, 148758, 179262, 209766 | 1435 | AGZ60172 | 27832 | 58336 | 88840, 119344, 149848, 180352, 210856 |
| 346 | AFH58326 | 26743 | 57247 | 87751, 118255, 148759, 179263, 209767 | 1436 | AGZ60183 | 27833 | 58337 | 88841, 119345, 149849, 180353, 210857 |
| 347 | AFH58337 | 26744 | 57248 | 87752, 118256, 148760, 179264, 209768 | 1437 | AGZ60194 | 27834 | 58338 | 88842, 119346, 149850, 180354, 210858 |
| 348 | AFH58348 | 26745 | 57249 | 87753, 118257, 148761, 179265, 209769 | 1438 | AGZ60206 | 27835 | 58339 | 88843, 119347, 149851, 180355, 210859 |
| 349 | AFH58370 | 26746 | 57250 | 87754, 118258, 148762, 179266, 209770 | 1439 | AGZ60217 | 27836 | 58340 | 88844, 119348, 149852, 180356, 210860 |
| 350 | AFH58392 | 26747 | 57251 | 87755, 118259, 148763, 179267, 209771 | 1440 | AGZ60268 | 27837 | 58341 | 88845, 119349, 149853, 180357, 210861 |
| 351 | AFH58403 | 26748 | 57252 | 87756, 118260, 148764, 179268, 209772 | 1441 | AHE37993 | 27838 | 58342 | 88846, 119350, 149854, 180358, 210862 |
| 352 | AFH58414 | 26749 | 57253 | 87757, 118261, 148765, 179269, 209773 | 1442 | AHE37994 | 27839 | 58343 | 88847, 119351, 149855, 180359, 210863 |
| 353 | AFH58425 | 26750 | 57254 | 87758, 118262, 148766, 179270, 209774 | 1443 | AHE37995 | 27840 | 58344 | 88848, 119352, 149856, 180360, 210864 |

FIG. 2 continued

| | | | | | | | | | |
|---|---|---|---|---|---|---|---|---|---|
| 354 | AFH58436 | 26751 | 57255 | 87759, 118263, 148767, 179271, 209775 | 1444 | AHE37996 | 27841 | 58345 | 88849, 119353, 149857, 180361, 210865 |
| 355 | AFH58458 | 26752 | 57256 | 87760, 118264, 148768, 179272, 209776 | 1445 | AHE37997 | 27842 | 58346 | 88850, 119354, 149858, 180362, 210866 |
| 356 | AFH58469 | 26753 | 57257 | 87761, 118265, 148769, 179273, 209777 | 1446 | AHE37998 | 27843 | 58347 | 88851, 119355, 149859, 180363, 210867 |
| 357 | AFH58480 | 26754 | 57258 | 87762, 118266, 148770, 179274, 209778 | 1447 | AHE37999 | 27844 | 58348 | 88852, 119356, 149860, 180364, 210868 |
| 358 | AFH58502 | 26755 | 57259 | 87763, 118267, 148771, 179275, 209779 | 1448 | AHE38000 | 27845 | 58349 | 88853, 119357, 149861, 180365, 210869 |
| 359 | AFH58513 | 26756 | 57260 | 87764, 118268, 148772, 179276, 209780 | 1449 | AHE38001 | 27846 | 58350 | 88854, 119358, 149862, 180366, 210870 |
| 360 | AFH58524 | 26757 | 57261 | 87765, 118269, 148773, 179277, 209781 | 1450 | AHE38002 | 27847 | 58351 | 88855, 119359, 149863, 180367, 210871 |
| 361 | AFH58535 | 26758 | 57262 | 87766, 118270, 148774, 179278, 209782 | 1451 | AHE38003 | 27848 | 58352 | 88856, 119360, 149864, 180368, 210872 |
| 362 | AFH58557 | 26759 | 57263 | 87767, 118271, 148775, 179279, 209783 | 1452 | AHE38004 | 27849 | 58353 | 88857, 119361, 149865, 180369, 210873 |
| 363 | AFJ76224 | 26760 | 57264 | 87768, 118272, 148776, 179280, 209784 | 1453 | AHE38005 | 27850 | 58354 | 88858, 119362, 149866, 180370, 210874 |
| 364 | AFJ76235 | 26761 | 57265 | 87769, 118273, 148777, 179281, 209785 | 1454 | AHE38006 | 27851 | 58355 | 88859, 119363, 149867, 180371, 210875 |
| 365 | AFJ76246 | 26762 | 57266 | 87770, 118274, 148778, 179282, 209786 | 1455 | AHE38007 | 27852 | 58356 | 88860, 119364, 149868, 180372, 210876 |
| 366 | AFJ76268 | 26763 | 57267 | 87771, 118275, 148779, 179283, 209787 | 1456 | AHE38008 | 27853 | 58357 | 88861, 119365, 149869, 180373, 210877 |
| 367 | AFJ76301 | 26764 | 57268 | 87772, 118276, 148780, 179284, 209788 | 1457 | AHE38009 | 27854 | 58358 | 88862, 119366, 149870, 180374, 210878 |
| 368 | AFJ76323 | 26765 | 57269 | 87773, 118277, 148781, 179285, 209789 | 1458 | AHE38010 | 27855 | 58359 | 88863, 119367, 149871, 180375, 210879 |
| 369 | AFJ76334 | 26766 | 57270 | 87774, 118278, 148782, 179286, 209790 | 1459 | AHE38012 | 27856 | 58360 | 88864, 119368, 149872, 180376, 210880 |
| 370 | AFJ77327 | 26767 | 57271 | 87775, 118279, 148783, 179287, 209791 | 1460 | AHE38013 | 27857 | 58361 | 88865, 119369, 149873, 180377, 210881 |
| 371 | AFJ77369 | 26768 | 57272 | 87776, 118280, 148784, 179288, 209792 | 1461 | AHE38014 | 27858 | 58362 | 88866, 119370, 149874, 180378, 210882 |

FIG. 2 continued

| | | | | | | | | | |
|---|---|---|---|---|---|---|---|---|---|
| 372 | AFJ77380 | 26769 | 57273 | 87777, 118281, 148785, 179289, 209793 | 1462 | AHE38015 | 27859 | 58363 | 88867, 119371, 149875, 180379, 210883 |
| 373 | AFJ80139 | 26770 | 57274 | 87778, 118282, 148786, 179290, 209794 | 1463 | AHE38016 | 27860 | 58364 | 88868, 119372, 149876, 180380, 210884 |
| 374 | AFJ80150 | 26771 | 57275 | 87779, 118283, 148787, 179291, 209795 | 1464 | AHE38017 | 27861 | 58365 | 88869, 119373, 149877, 180381, 210885 |
| 375 | AFJ80161 | 26772 | 57276 | 87780, 118284, 148788, 179292, 209796 | 1465 | AHE38018 | 27862 | 58366 | 88870, 119374, 149878, 180382, 210886 |
| 376 | AFJ80172 | 26773 | 57277 | 87781, 118285, 148789, 179293, 209797 | 1466 | AHE38019 | 27863 | 58367 | 88871, 119375, 149879, 180383, 210887 |
| 377 | AFJ80183 | 26774 | 57278 | 87782, 118286, 148790, 179294, 209798 | 1467 | AHE38020 | 27864 | 58368 | 88872, 119376, 149880, 180384, 210888 |
| 378 | AFJ80194 | 26775 | 57279 | 87783, 118287, 148791, 179295, 209799 | 1468 | AHE38021 | 27865 | 58369 | 88873, 119377, 149881, 180385, 210889 |
| 379 | AFJ80205 | 26776 | 57280 | 87784, 118288, 148792, 179296, 209800 | 1469 | AHE38022 | 27866 | 58370 | 88874, 119378, 149882, 180386, 210890 |
| 380 | AFJ80216 | 26777 | 57281 | 87785, 118289, 148793, 179297, 209801 | 1470 | AHL91189 | 27867 | 58371 | 88875, 119379, 149883, 180387, 210891 |
| 381 | AFJ80227 | 26778 | 57282 | 87786, 118290, 148794, 179298, 209802 | 1471 | AHL91200 | 27868 | 58372 | 88876, 119380, 149884, 180388, 210892 |
| 382 | AFJ80238 | 26779 | 57283 | 87787, 118291, 148795, 179299, 209803 | 1472 | AHL91211 | 27869 | 58373 | 88877, 119381, 149885, 180389, 210893 |
| 383 | AFJ80656 | 26780 | 57284 | 87788, 118292, 148796, 179300, 209804 | 1473 | AHL91222 | 27870 | 58374 | 88878, 119382, 149886, 180390, 210894 |
| 384 | AFJ80667 | 26781 | 57285 | 87789, 118293, 148797, 179301, 209805 | 1474 | AHL91244 | 27871 | 58375 | 88879, 119383, 149887, 180391, 210895 |
| 385 | AFJ80678 | 26782 | 57286 | 87790, 118294, 148798, 179302, 209806 | 1475 | AHL91255 | 27872 | 58376 | 88880, 119384, 149888, 180392, 210896 |
| 386 | AFJ80689 | 26783 | 57287 | 87791, 118295, 148799, 179303, 209807 | 1476 | AHL91266 | 27873 | 58377 | 88881, 119385, 149889, 180393, 210897 |
| 387 | AFJ80711 | 26784 | 57288 | 87792, 118296, 148800, 179304, 209808 | 1477 | AHL91277 | 27874 | 58378 | 88882, 119386, 149890, 180394, 210898 |
| 388 | AFJ80722 | 26785 | 57289 | 87793, 118297, 148801, 179305, 209809 | 1478 | AHL91299 | 27875 | 58379 | 88883, 119387, 149891, 180395, 210899 |
| 389 | AFJ80733 | 26786 | 57290 | 87794, 118298, 148802, 179306, 209810 | 1479 | AHL91310 | 27876 | 58380 | 88884, 119388, 149892, 180396, 210900 |

FIG. 2 continued

| | | | | | | | | | |
|---|---|---|---|---|---|---|---|---|---|
| 390 | AFJ80744 | 26787 | 57291 | 87795, 118299, 148803, 179307, 209811 | 1480 | AHL91321 | 27877 | 58381 | 88885, 119389, 149893, 180397, 210901 |
| 391 | AFJ80755 | 26788 | 57292 | 87796, 118300, 148804, 179308, 209812 | 1481 | AHL91332 | 27878 | 58382 | 88886, 119390, 149894, 180398, 210902 |
| 392 | AFJ80781 | 26789 | 57293 | 87797, 118301, 148805, 179309, 209813 | 1482 | AHL91343 | 27879 | 58383 | 88887, 119391, 149895, 180399, 210903 |
| 393 | AFJ80792 | 26790 | 57294 | 87798, 118302, 148806, 179310, 209814 | 1483 | AHL91354 | 27880 | 58384 | 88888, 119392, 149896, 180400, 210904 |
| 394 | AFJ80803 | 26791 | 57295 | 87799, 118303, 148807, 179311, 209815 | 1484 | AHL91365 | 27881 | 58385 | 88889, 119393, 149897, 180401, 210905 |
| 395 | AFJ80814 | 26792 | 57296 | 87800, 118304, 148808, 179312, 209816 | 1485 | AHL91376 | 27882 | 58386 | 88890, 119394, 149898, 180402, 210906 |
| 396 | AFJ80825 | 26793 | 57297 | 87801, 118305, 148809, 179313, 209817 | 1486 | AHL91387 | 27883 | 58387 | 88891, 119395, 149899, 180403, 210907 |
| 397 | AFJ80836 | 26794 | 57298 | 87802, 118306, 148810, 179314, 209818 | 1487 | AHL91409 | 27884 | 58388 | 88892, 119396, 149900, 180404, 210908 |
| 398 | AFJ80847 | 26795 | 57299 | 87803, 118307, 148811, 179315, 209819 | 1488 | AHL91431 | 27885 | 58389 | 88893, 119397, 149901, 180405, 210909 |
| 399 | AFJ80858 | 26796 | 57300 | 87804, 118308, 148812, 179316, 209820 | 1489 | AHL91442 | 27886 | 58390 | 88894, 119398, 149902, 180406, 210910 |
| 400 | AFJ80869 | 26797 | 57301 | 87805, 118309, 148813, 179317, 209821 | 1490 | AHL91453 | 27887 | 58391 | 88895, 119399, 149903, 180407, 210911 |
| 401 | AFJ80880 | 26798 | 57302 | 87806, 118310, 148814, 179318, 209822 | 1491 | AHL91464 | 27888 | 58392 | 88896, 119400, 149904, 180408, 210912 |
| 402 | AFJ80891 | 26799 | 57303 | 87807, 118311, 148815, 179319, 209823 | 1492 | AHL91475 | 27889 | 58393 | 88897, 119401, 149905, 180409, 210913 |
| 403 | AFJ80902 | 26800 | 57304 | 87808, 118312, 148816, 179320, 209824 | 1493 | AHL91486 | 27890 | 58394 | 88898, 119402, 149906, 180410, 210914 |
| 404 | AFJ80913 | 26801 | 57305 | 87809, 118313, 148817, 179321, 209825 | 1494 | AHL91497 | 27891 | 58395 | 88899, 119403, 149907, 180411, 210915 |
| 405 | AFJ80924 | 26802 | 57306 | 87810, 118314, 148818, 179322, 209826 | 1495 | AHL91530 | 27892 | 58396 | 88900, 119404, 149908, 180412, 210916 |
| 406 | AFJ80935 | 26803 | 57307 | 87811, 118315, 148819, 179323, 209827 | 1496 | AHL91541 | 27893 | 58397 | 88901, 119405, 149909, 180413, 210917 |
| 407 | AFJ80946 | 26804 | 57308 | 87812, 118316, 148820, 179324, 209828 | 1497 | AHL91552 | 27894 | 58398 | 88902, 119406, 149910, 180414, 210918 |

FIG. 2 continued

| | | | | | | | | | |
|---|---|---|---|---|---|---|---|---|---|
| 408 | AFJ80957 | 26805 | 57309 | 87813, 118317, 148821, 179325, 209829 | 1498 | AHL91574 | 27895 | 58399 | 88903, 119407, 149911, 180415, 210919 |
| 409 | AFJ80968 | 26806 | 57310 | 87814, 118318, 148822, 179326, 209830 | 1499 | AHL91585 | 27896 | 58400 | 88904, 119408, 149912, 180416, 210920 |
| 410 | AFJ80979 | 26807 | 57311 | 87815, 118319, 148823, 179327, 209831 | 1500 | AHL91596 | 27897 | 58401 | 88905, 119409, 149913, 180417, 210921 |
| 411 | AFJ80990 | 26808 | 57312 | 87816, 118320, 148824, 179328, 209832 | 1501 | AHL91607 | 27898 | 58402 | 88906, 119410, 149914, 180418, 210922 |
| 412 | AFJ81001 | 26809 | 57313 | 87817, 118321, 148825, 179329, 209833 | 1502 | AHL91618 | 27899 | 58403 | 88907, 119411, 149915, 180419, 210923 |
| 413 | AFJ84360 | 26810 | 57314 | 87818, 118322, 148826, 179330, 209834 | 1503 | AHL91629 | 27900 | 58404 | 88908, 119412, 149916, 180420, 210924 |
| 414 | AFJ90395 | 26811 | 57315 | 87819, 118323, 148827, 179331, 209835 | 1504 | AHL91640 | 27901 | 58405 | 88909, 119413, 149917, 180421, 210925 |
| 415 | AFJ90406 | 26812 | 57316 | 87820, 118324, 148828, 179332, 209836 | 1505 | AHL91651 | 27902 | 58406 | 88910, 119414, 149918, 180422, 210926 |
| 416 | AFJ90417 | 26813 | 57317 | 87821, 118325, 148829, 179333, 209837 | 1506 | AHL91662 | 27903 | 58407 | 88911, 119415, 149919, 180423, 210927 |
| 417 | AFJ90428 | 26814 | 57318 | 87822, 118326, 148830, 179334, 209838 | 1507 | AHL91673 | 27904 | 58408 | 88912, 119416, 149920, 180424, 210928 |
| 418 | AFJ90450 | 26815 | 57319 | 87823, 118327, 148831, 179335, 209839 | 1508 | AHL91684 | 27905 | 58409 | 88913, 119417, 149921, 180425, 210929 |
| 419 | AFJ91038 | 26816 | 57320 | 87824, 118328, 148832, 179336, 209840 | 1509 | AHL91695 | 27906 | 58410 | 88914, 119418, 149922, 180426, 210930 |
| 420 | AFJ91049 | 26817 | 57321 | 87825, 118329, 148833, 179337, 209841 | 1510 | AHL91706 | 27907 | 58411 | 88915, 119419, 149923, 180427, 210931 |
| 421 | AFJ91060 | 26818 | 57322 | 87826, 118330, 148834, 179338, 209842 | 1511 | AHL91717 | 27908 | 58412 | 88916, 119420, 149924, 180428, 210932 |
| 422 | AFJ91071 | 26819 | 57323 | 87827, 118331, 148835, 179339, 209843 | 1512 | AHL91728 | 27909 | 58413 | 88917, 119421, 149925, 180429, 210933 |
| 423 | AFJ91082 | 26820 | 57324 | 87828, 118332, 148836, 179340, 209844 | 1513 | AHL91739 | 27910 | 58414 | 88918, 119422, 149926, 180430, 210934 |
| 424 | AFJ91093 | 26821 | 57325 | 87829, 118333, 148837, 179341, 209845 | 1514 | AHL91750 | 27911 | 58415 | 88919, 119423, 149927, 180431, 210935 |
| 425 | AFJ91104 | 26822 | 57326 | 87830, 118334, 148838, 179342, 209846 | 1515 | AHL91761 | 27912 | 58416 | 88920, 119424, 149928, 180432, 210936 |

FIG. 2 continued

| | | | | | | | | | |
|---|---|---|---|---|---|---|---|---|---|
| 426 | AFJ91115 | 26823 | 57327 | 87831, 118335, 148839, 179343, 209847 | 1516 | AHL91772 | 27913 | 58417 | 88921, 119425, 149929, 180433, 210937 |
| 427 | AFJ91704 | 26824 | 57328 | 87832, 118336, 148840, 179344, 209848 | 1517 | AHL91783 | 27914 | 58418 | 88922, 119426, 149930, 180434, 210938 |
| 428 | AFK09797 | 26825 | 57329 | 87833, 118337, 148841, 179345, 209849 | 1518 | AHL91794 | 27915 | 58419 | 88923, 119427, 149931, 180435, 210939 |
| 429 | AFN54654 | 26826 | 57330 | 87834, 118338, 148842, 179346, 209850 | 1519 | AHL91805 | 27916 | 58420 | 88924, 119428, 149932, 180436, 210940 |
| 430 | AFN54665 | 26827 | 57331 | 87835, 118339, 148843, 179347, 209851 | 1520 | AHL91816 | 27917 | 58421 | 88925, 119429, 149933, 180437, 210941 |
| 431 | AFN54676 | 26828 | 57332 | 87836, 118340, 148844, 179348, 209852 | 1521 | AHL91827 | 27918 | 58422 | 88926, 119430, 149934, 180438, 210942 |
| 432 | AFN54687 | 26829 | 57333 | 87837, 118341, 148845, 179349, 209853 | 1522 | AHL91838 | 27919 | 58423 | 88927, 119431, 149935, 180439, 210943 |
| 433 | AFN54698 | 26830 | 57334 | 87838, 118342, 148846, 179350, 209854 | 1523 | AHL91849 | 27920 | 58424 | 88928, 119432, 149936, 180440, 210944 |
| 434 | AFN54709 | 26831 | 57335 | 87839, 118343, 148847, 179351, 209855 | 1524 | AHL91860 | 27921 | 58425 | 88929, 119433, 149937, 180441, 210945 |
| 435 | AFN54720 | 26832 | 57336 | 87840, 118344, 148848, 179352, 209856 | 1525 | AHL91871 | 27922 | 58426 | 88930, 119434, 149938, 180442, 210946 |
| 436 | AFN54731 | 26833 | 57337 | 87841, 118345, 148849, 179353, 209857 | 1526 | AHL91882 | 27923 | 58427 | 88931, 119435, 149939, 180443, 210947 |
| 437 | AFN54742 | 26834 | 57338 | 87842, 118346, 148850, 179354, 209858 | 1527 | AHL91904 | 27924 | 58428 | 88932, 119436, 149940, 180444, 210948 |
| 438 | AFN54753 | 26835 | 57339 | 87843, 118347, 148851, 179355, 209859 | 1528 | AHL91915 | 27925 | 58429 | 88933, 119437, 149941, 180445, 210949 |
| 439 | AFN54764 | 26836 | 57340 | 87844, 118348, 148852, 179356, 209860 | 1529 | AHL91926 | 27926 | 58430 | 88934, 119438, 149942, 180446, 210950 |
| 440 | AFN54775 | 26837 | 57341 | 87845, 118349, 148853, 179357, 209861 | 1530 | AHL91937 | 27927 | 58431 | 88935, 119439, 149943, 180447, 210951 |
| 441 | AFN54786 | 26838 | 57342 | 87846, 118350, 148854, 179358, 209862 | 1531 | AHL91948 | 27928 | 58432 | 88936, 119440, 149944, 180448, 210952 |
| 442 | AFN54797 | 26839 | 57343 | 87847, 118351, 148855, 179359, 209863 | 1532 | AHL91959 | 27929 | 58433 | 88937, 119441, 149945, 180449, 210953 |
| 443 | AFN54808 | 26840 | 57344 | 87848, 118352, 148856, 179360, 209864 | 1533 | AHL91970 | 27930 | 58434 | 88938, 119442, 149946, 180450, 210954 |

FIG. 2 continued

| | | | | | | | | | |
|---|---|---|---|---|---|---|---|---|---|
| 444 | AFN54819 | 26841 | 57345 | 87849, 118353, 148857, 179361, 209865 | 1534 | AHL91991 | 27931 | 58435 | 88939, 119443, 149947, 180451, 210955 |
| 445 | AFN54830 | 26842 | 57346 | 87850, 118354, 148858, 179362, 209866 | 1535 | AHL92002 | 27932 | 58436 | 88940, 119444, 149948, 180452, 210956 |
| 446 | AFN54841 | 26843 | 57347 | 87851, 118355, 148859, 179363, 209867 | 1536 | AHL92013 | 27933 | 58437 | 88941, 119445, 149949, 180453, 210957 |
| 447 | AFN54852 | 26844 | 57348 | 87852, 118356, 148860, 179364, 209868 | 1537 | AHL92024 | 27934 | 58438 | 88942, 119446, 149950, 180454, 210958 |
| 448 | AFN54863 | 26845 | 57349 | 87853, 118357, 148861, 179365, 209869 | 1538 | AHL92035 | 27935 | 58439 | 88943, 119447, 149951, 180455, 210959 |
| 449 | AFU34595 | 26846 | 57350 | 87854, 118358, 148862, 179366, 209870 | 1539 | AHL92046 | 27936 | 58440 | 88944, 119448, 149952, 180456, 210960 |
| 450 | AFU34606 | 26847 | 57351 | 87855, 118359, 148863, 179367, 209871 | 1540 | AHL92057 | 27937 | 58441 | 88945, 119449, 149953, 180457, 210961 |
| 451 | AFU34617 | 26848 | 57352 | 87856, 118360, 148864, 179368, 209872 | 1541 | AHL92068 | 27938 | 58442 | 88946, 119450, 149954, 180458, 210962 |
| 452 | AFU34628 | 26849 | 57353 | 87857, 118361, 148865, 179369, 209873 | 1542 | AHL92079 | 27939 | 58443 | 88947, 119451, 149955, 180459, 210963 |
| 453 | AFU34639 | 26850 | 57354 | 87858, 118362, 148866, 179370, 209874 | 1543 | AHL92090 | 27940 | 58444 | 88948, 119452, 149956, 180460, 210964 |
| 454 | AGB08299 | 26851 | 57355 | 87859, 118363, 148867, 179371, 209875 | 1544 | AHL92101 | 27941 | 58445 | 88949, 119453, 149957, 180461, 210965 |
| 455 | AGB08300 | 26852 | 57356 | 87860, 118364, 148868, 179372, 209876 | 1545 | AHL92112 | 27942 | 58446 | 88950, 119454, 149958, 180462, 210966 |
| 456 | AGB97259 | 26853 | 57357 | 87861, 118365, 148869, 179373, 209877 | 1546 | AHL92123 | 27943 | 58447 | 88951, 119455, 149959, 180463, 210967 |
| 457 | AGB97265 | 26854 | 57358 | 87862, 118366, 148870, 179374, 209878 | 1547 | AHL92134 | 27944 | 58448 | 88952, 119456, 149960, 180464, 210968 |
| 458 | AGF44878 | 26855 | 57359 | 87863, 118367, 148871, 179375, 209879 | 1548 | AHL92145 | 27945 | 58449 | 88953, 119457, 149961, 180465, 210969 |
| 459 | AGF44879 | 26856 | 57360 | 87864, 118368, 148872, 179376, 209880 | 1549 | AHL92156 | 27946 | 58450 | 88954, 119458, 149962, 180466, 210970 |
| 460 | AGF44881 | 26857 | 57361 | 87865, 118369, 148873, 179377, 209881 | 1550 | AHL92167 | 27947 | 58451 | 88955, 119459, 149963, 180467, 210971 |
| 461 | AGF44882 | 26858 | 57362 | 87866, 118370, 148874, 179378, 209882 | 1551 | AHL92178 | 27948 | 58452 | 88956, 119460, 149964, 180468, 210972 |

FIG. 2 continued

| | | | | | | | | | |
|---|---|---|---|---|---|---|---|---|---|
| 462 | AGF44883 | 26859 | 57363 | 87867, 118371, 148875, 179379, 209883 | 1552 | AHL92189 | 27949 | 58453 | 88957, 119461, 149965, 180469, 210973 |
| 463 | AGF44884 | 26860 | 57364 | 87868, 118372, 148876, 179380, 209884 | 1553 | AHL92200 | 27950 | 58454 | 88958, 119462, 149966, 180470, 210974 |
| 464 | AGF44886 | 26861 | 57365 | 87869, 118373, 148877, 179381, 209885 | 1554 | AHL92211 | 27951 | 58455 | 88959, 119463, 149967, 180471, 210975 |
| 465 | AGF44887 | 26862 | 57366 | 87870, 118374, 148878, 179382, 209886 | 1555 | AHL92222 | 27952 | 58456 | 88960, 119464, 149968, 180472, 210976 |
| 466 | AGF44888 | 26863 | 57367 | 87871, 118375, 148879, 179383, 209887 | 1556 | AHL92233 | 27953 | 58457 | 88961, 119465, 149969, 180473, 210977 |
| 467 | AGL09834 | 26864 | 57368 | 87872, 118376, 148880, 179384, 209888 | 1557 | AHL92244 | 27954 | 58458 | 88962, 119466, 149970, 180474, 210978 |
| 468 | AGL09835 | 26865 | 57369 | 87873, 118377, 148881, 179385, 209889 | 1558 | AHL92255 | 27955 | 58459 | 88963, 119467, 149971, 180475, 210979 |
| 469 | AGL09836 | 26866 | 57370 | 87874, 118378, 148882, 179386, 209890 | 1559 | AHL92266 | 27956 | 58460 | 88964, 119468, 149972, 180476, 210980 |
| 470 | AGL09837 | 26867 | 57371 | 87875, 118379, 148883, 179387, 209891 | 1560 | AHL92277 | 27957 | 58461 | 88965, 119469, 149973, 180477, 210981 |
| 471 | AGL09838 | 26868 | 57372 | 87876, 118380, 148884, 179388, 209892 | 1561 | AHL92288 | 27958 | 58462 | 88966, 119470, 149974, 180478, 210982 |
| 472 | AGL09839 | 26869 | 57373 | 87877, 118381, 148885, 179389, 209893 | 1562 | AHL92299 | 27959 | 58463 | 88967, 119471, 149975, 180479, 210983 |
| 473 | AGL09840 | 26870 | 57374 | 87878, 118382, 148886, 179390, 209894 | 1563 | AHL92310 | 27960 | 58464 | 88968, 119472, 149976, 180480, 210984 |
| 474 | AGL09841 | 26871 | 57375 | 87879, 118383, 148887, 179391, 209895 | 1564 | AHL92321 | 27961 | 58465 | 88969, 119473, 149977, 180481, 210985 |
| 475 | AGL09842 | 26872 | 57376 | 87880, 118384, 148888, 179392, 209896 | 1565 | AHL92332 | 27962 | 58466 | 88970, 119474, 149978, 180482, 210986 |
| 476 | AGL09843 | 26873 | 57377 | 87881, 118385, 148889, 179393, 209897 | 1566 | AHL92354 | 27963 | 58467 | 88971, 119475, 149979, 180483, 210987 |
| 477 | AGL09844 | 26874 | 57378 | 87882, 118386, 148890, 179394, 209898 | 1567 | AHL92365 | 27964 | 58468 | 88972, 119476, 149980, 180484, 210988 |
| 478 | AGL09845 | 26875 | 57379 | 87883, 118387, 148891, 179395, 209899 | 1568 | AHL92376 | 27965 | 58469 | 88973, 119477, 149981, 180485, 210989 |
| 479 | AGL09846 | 26876 | 57380 | 87884, 118388, 148892, 179396, 209900 | 1569 | AHL92387 | 27966 | 58470 | 88974, 119478, 149982, 180486, 210990 |

FIG. 2 continued

| | | | | | | | | | |
|---|---|---|---|---|---|---|---|---|---|
| 480 | AGL09847 | 26877 | 57381 | 87885, 118389, 148893, 179397, 209901 | 1570 | AHL92398 | 27967 | 58471 | 88975, 119479, 149983, 180487, 210991 |
| 481 | AGL09849 | 26878 | 57382 | 87886, 118390, 148894, 179398, 209902 | 1571 | AHL92409 | 27968 | 58472 | 88976, 119480, 149984, 180488, 210992 |
| 482 | AGL09850 | 26879 | 57383 | 87887, 118391, 148895, 179399, 209903 | 1572 | AHL92420 | 27969 | 58473 | 88977, 119481, 149985, 180489, 210993 |
| 483 | AGL09851 | 26880 | 57384 | 87888, 118392, 148896, 179400, 209904 | 1573 | AHL92431 | 27970 | 58474 | 88978, 119482, 149986, 180490, 210994 |
| 484 | AGL09852 | 26881 | 57385 | 87889, 118393, 148897, 179401, 209905 | 1574 | AHL92442 | 27971 | 58475 | 88979, 119483, 149987, 180491, 210995 |
| 485 | AGL09853 | 26882 | 57386 | 87890, 118394, 148898, 179402, 209906 | 1575 | AHL92453 | 27972 | 58476 | 88980, 119484, 149988, 180492, 210996 |
| 486 | AGL09854 | 26883 | 57387 | 87891, 118395, 148899, 179403, 209907 | 1576 | AHL92464 | 27973 | 58477 | 88981, 119485, 149989, 180493, 210997 |
| 487 | AGL09855 | 26884 | 57388 | 87892, 118396, 148900, 179404, 209908 | 1577 | AHL92475 | 27974 | 58478 | 88982, 119486, 149990, 180494, 210998 |
| 488 | AGL09856 | 26885 | 57389 | 87893, 118397, 148901, 179405, 209909 | 1578 | AHL92486 | 27975 | 58479 | 88983, 119487, 149991, 180495, 210999 |
| 489 | AGL09857 | 26886 | 57390 | 87894, 118398, 148902, 179406, 209910 | 1579 | AHL92497 | 27976 | 58480 | 88984, 119488, 149992, 180496, 211000 |
| 490 | AGL09859 | 26887 | 57391 | 87895, 118399, 148903, 179407, 209911 | 1580 | AHL92508 | 27977 | 58481 | 88985, 119489, 149993, 180497, 211001 |
| 491 | AGL09860 | 26888 | 57392 | 87896, 118400, 148904, 179408, 209912 | 1581 | AHL92519 | 27978 | 58482 | 88986, 119490, 149994, 180498, 211002 |
| 492 | AGL09861 | 26889 | 57393 | 87897, 118401, 148905, 179409, 209913 | 1582 | AHL92530 | 27979 | 58483 | 88987, 119491, 149995, 180499, 211003 |
| 493 | AGL09862 | 26890 | 57394 | 87898, 118402, 148906, 179410, 209914 | 1583 | AHL92541 | 27980 | 58484 | 88988, 119492, 149996, 180500, 211004 |
| 494 | AGL09863 | 26891 | 57395 | 87899, 118403, 148907, 179411, 209915 | 1584 | AHL92563 | 27981 | 58485 | 88989, 119493, 149997, 180501, 211005 |
| 495 | AGL09864 | 26892 | 57396 | 87900, 118404, 148908, 179412, 209916 | 1585 | AHL92574 | 27982 | 58486 | 88990, 119494, 149998, 180502, 211006 |
| 496 | AGL09866 | 26893 | 57397 | 87901, 118405, 148909, 179413, 209917 | 1586 | AHL92585 | 27983 | 58487 | 88991, 119495, 149999, 180503, 211007 |
| 497 | AGL09867 | 26894 | 57398 | 87902, 118406, 148910, 179414, 209918 | 1587 | AHL92596 | 27984 | 58488 | 88992, 119496, 150000, 180504, 211008 |

FIG. 2 continued

| | | | | | | | | | |
|---|---|---|---|---|---|---|---|---|---|
| 498 | AGL09868 | 26895 | 57399 | 87903, 118407, 148911, 179415, 209919 | 1588 | AHL92607 | 27985 | 58489 | 88993, 119497, 150001, 180505, 211009 |
| 499 | AGL09869 | 26896 | 57400 | 87904, 118408, 148912, 179416, 209920 | 1589 | AHL92629 | 27986 | 58490 | 88994, 119498, 150002, 180506, 211010 |
| 500 | AGL09870 | 26897 | 57401 | 87905, 118409, 148913, 179417, 209921 | 1590 | AHL92640 | 27987 | 58491 | 88995, 119499, 150003, 180507, 211011 |
| 501 | AGL09871 | 26898 | 57402 | 87906, 118410, 148914, 179418, 209922 | 1591 | AHL92651 | 27988 | 58492 | 88996, 119500, 150004, 180508, 211012 |
| 502 | AGL09872 | 26899 | 57403 | 87907, 118411, 148915, 179419, 209923 | 1592 | AHL92684 | 27989 | 58493 | 88997, 119501, 150005, 180509, 211013 |
| 503 | AGL09873 | 26900 | 57404 | 87908, 118412, 148916, 179420, 209924 | 1593 | AHL92695 | 27990 | 58494 | 88998, 119502, 150006, 180510, 211014 |
| 504 | AGL09874 | 26901 | 57405 | 87909, 118413, 148917, 179421, 209925 | 1594 | AHL92706 | 27991 | 58495 | 88999, 119503, 150007, 180511, 211015 |
| 505 | AGO02695 | 26902 | 57406 | 87910, 118414, 148918, 179422, 209926 | 1595 | AHL92728 | 27992 | 58496 | 89000, 119504, 150008, 180512, 211016 |
| 506 | AGQ16249 | 26903 | 57407 | 87911, 118415, 148919, 179423, 209927 | 1596 | AHL92739 | 27993 | 58497 | 89001, 119505, 150009, 180513, 211017 |
| 507 | AGQ16250 | 26904 | 57408 | 87912, 118416, 148920, 179424, 209928 | 1597 | AHL92750 | 27994 | 58498 | 89002, 119506, 150010, 180514, 211018 |
| 508 | AGQ16251 | 26905 | 57409 | 87913, 118417, 148921, 179425, 209929 | 1598 | AHL92761 | 27995 | 58499 | 89003, 119507, 150011, 180515, 211019 |
| 509 | AGQ16252 | 26906 | 57410 | 87914, 118418, 148922, 179426, 209930 | 1599 | AHL92772 | 27996 | 58500 | 89004, 119508, 150012, 180516, 211020 |
| 510 | AGQ16253 | 26907 | 57411 | 87915, 118419, 148923, 179427, 209931 | 1600 | AHL92794 | 27997 | 58501 | 89005, 119509, 150013, 180517, 211021 |
| 511 | AGQ16255 | 26908 | 57412 | 87916, 118420, 148924, 179428, 209932 | 1601 | AHL92805 | 27998 | 58502 | 89006, 119510, 150014, 180518, 211022 |
| 512 | AGQ16256 | 26909 | 57413 | 87917, 118421, 148925, 179429, 209933 | 1602 | AHL92816 | 27999 | 58503 | 89007, 119511, 150015, 180519, 211023 |
| 513 | AGQ16257 | 26910 | 57414 | 87918, 118422, 148926, 179430, 209934 | 1603 | AHL92827 | 28000 | 58504 | 89008, 119512, 150016, 180520, 211024 |
| 514 | AGQ16258 | 26911 | 57415 | 87919, 118423, 148927, 179431, 209935 | 1604 | AHL92838 | 28001 | 58505 | 89009, 119513, 150017, 180521, 211025 |
| 515 | AGQ16259 | 26912 | 57416 | 87920, 118424, 148928, 179432, 209936 | 1605 | AHL92849 | 28002 | 58506 | 89010, 119514, 150018, 180522, 211026 |

FIG. 2 continued

| | | | | | | | | | |
|---|---|---|---|---|---|---|---|---|---|
| 516 | AGQ16260 | 26913 | 57417 | 87921, 118425, 148929, 179433, 209937 | 1606 | AHL92860 | 28003 | 58507 | 89011, 119515, 150019, 180523, 211027 |
| 517 | AGQ16261 | 26914 | 57418 | 87922, 118426, 148930, 179434, 209938 | 1607 | AHL92871 | 28004 | 58508 | 89012, 119516, 150020, 180524, 211028 |
| 518 | AGQ16262 | 26915 | 57419 | 87923, 118427, 148931, 179435, 209939 | 1608 | AHL92882 | 28005 | 58509 | 89013, 119517, 150021, 180525, 211029 |
| 519 | AGQ16263 | 26916 | 57420 | 87924, 118428, 148932, 179436, 209940 | 1609 | AHL92893 | 28006 | 58510 | 89014, 119518, 150022, 180526, 211030 |
| 520 | AGQ16264 | 26917 | 57421 | 87925, 118429, 148933, 179437, 209941 | 1610 | AHL92904 | 28007 | 58511 | 89015, 119519, 150023, 180527, 211031 |
| 521 | AGQ16265 | 26918 | 57422 | 87926, 118430, 148934, 179438, 209942 | 1611 | AHL92915 | 28008 | 58512 | 89016, 119520, 150024, 180528, 211032 |
| 522 | AGQ16266 | 26919 | 57423 | 87927, 118431, 148935, 179439, 209943 | 1612 | AHL92926 | 28009 | 58513 | 89017, 119521, 150025, 180529, 211033 |
| 523 | AGQ16267 | 26920 | 57424 | 87928, 118432, 148936, 179440, 209944 | 1613 | AHL92937 | 28010 | 58514 | 89018, 119522, 150026, 180530, 211034 |
| 524 | AGQ16268 | 26921 | 57425 | 87929, 118433, 148937, 179441, 209945 | 1614 | AHL92948 | 28011 | 58515 | 89019, 119523, 150027, 180531, 211035 |
| 525 | AGQ16269 | 26922 | 57426 | 87930, 118434, 148938, 179442, 209946 | 1615 | AHL92959 | 28012 | 58516 | 89020, 119524, 150028, 180532, 211036 |
| 526 | AGQ16270 | 26923 | 57427 | 87931, 118435, 148939, 179443, 209947 | 1616 | AHL92970 | 28013 | 58517 | 89021, 119525, 150029, 180533, 211037 |
| 527 | AGQ16272 | 26924 | 57428 | 87932, 118436, 148940, 179444, 209948 | 1617 | AHL92981 | 28014 | 58518 | 89022, 119526, 150030, 180534, 211038 |
| 528 | AGQ16273 | 26925 | 57429 | 87933, 118437, 148941, 179445, 209949 | 1618 | AHL92992 | 28015 | 58519 | 89023, 119527, 150031, 180535, 211039 |
| 529 | AGQ16274 | 26926 | 57430 | 87934, 118438, 148942, 179446, 209950 | 1619 | AHL93004 | 28016 | 58520 | 89024, 119528, 150032, 180536, 211040 |
| 530 | AGQ16275 | 26927 | 57431 | 87935, 118439, 148943, 179447, 209951 | 1620 | AHL93015 | 28017 | 58521 | 89025, 119529, 150033, 180537, 211041 |
| 531 | AGQ16276 | 26928 | 57432 | 87936, 118440, 148944, 179448, 209952 | 1621 | AHL93026 | 28018 | 58522 | 89026, 119530, 150034, 180538, 211042 |
| 532 | AGQ16277 | 26929 | 57433 | 87937, 118441, 148945, 179449, 209953 | 1622 | AHL93037 | 28019 | 58523 | 89027, 119531, 150035, 180539, 211043 |
| 533 | AGQ16278 | 26930 | 57434 | 87938, 118442, 148946, 179450, 209954 | 1623 | AHL93048 | 28020 | 58524 | 89028, 119532, 150036, 180540, 211044 |

FIG. 2 continued

| | | | | | | | | | |
|---|---|---|---|---|---|---|---|---|---|
| 534 | AGQ16279 | 26931 | 57435 | 87939, 118443, 148947, 179451, 209955 | 1624 | AHL93059 | 28021 | 58525 | 89029, 119533, 150037, 180541, 211045 |
| 535 | AGQ16280 | 26932 | 57436 | 87940, 118444, 148948, 179452, 209956 | 1625 | AHL93070 | 28022 | 58526 | 89030, 119534, 150038, 180542, 211046 |
| 536 | AGQ16281 | 26933 | 57437 | 87941, 118445, 148949, 179453, 209957 | 1626 | AHL93081 | 28023 | 58527 | 89031, 119535, 150039, 180543, 211047 |
| 537 | AGQ16282 | 26934 | 57438 | 87942, 118446, 148950, 179454, 209958 | 1627 | AHL93092 | 28024 | 58528 | 89032, 119536, 150040, 180544, 211048 |
| 538 | AGQ16283 | 26935 | 57439 | 87943, 118447, 148951, 179455, 209959 | 1628 | AHL93103 | 28025 | 58529 | 89033, 119537, 150041, 180545, 211049 |
| 539 | AGQ16284 | 26936 | 57440 | 87944, 118448, 148952, 179456, 209960 | 1629 | AHL93114 | 28026 | 58530 | 89034, 119538, 150042, 180546, 211050 |
| 540 | AGQ16285 | 26937 | 57441 | 87945, 118449, 148953, 179457, 209961 | 1630 | AHL93125 | 28027 | 58531 | 89035, 119539, 150043, 180547, 211051 |
| 541 | AGQ16286 | 26938 | 57442 | 87946, 118450, 148954, 179458, 209962 | 1631 | AHL93136 | 28028 | 58532 | 89036, 119540, 150044, 180548, 211052 |
| 542 | AGQ16287 | 26939 | 57443 | 87947, 118451, 148955, 179459, 209963 | 1632 | AHL93147 | 28029 | 58533 | 89037, 119541, 150045, 180549, 211053 |
| 543 | AGQ16289 | 26940 | 57444 | 87948, 118452, 148956, 179460, 209964 | 1633 | AHL93158 | 28030 | 58534 | 89038, 119542, 150046, 180550, 211054 |
| 544 | AGQ16290 | 26941 | 57445 | 87949, 118453, 148957, 179461, 209965 | 1634 | AHL93169 | 28031 | 58535 | 89039, 119543, 150047, 180551, 211055 |
| 545 | AGQ16291 | 26942 | 57446 | 87950, 118454, 148958, 179462, 209966 | 1635 | AHL93180 | 28032 | 58536 | 89040, 119544, 150048, 180552, 211056 |
| 546 | AGQ16292 | 26943 | 57447 | 87951, 118455, 148959, 179463, 209967 | 1636 | AHL93191 | 28033 | 58537 | 89041, 119545, 150049, 180553, 211057 |
| 547 | AGQ16293 | 26944 | 57448 | 87952, 118456, 148960, 179464, 209968 | 1637 | AHL93202 | 28034 | 58538 | 89042, 119546, 150050, 180554, 211058 |
| 548 | AGQ16294 | 26945 | 57449 | 87953, 118457, 148961, 179465, 209969 | 1638 | AHL93213 | 28035 | 58539 | 89043, 119547, 150051, 180555, 211059 |
| 549 | AGQ16295 | 26946 | 57450 | 87954, 118458, 148962, 179466, 209970 | 1639 | AHL93224 | 28036 | 58540 | 89044, 119548, 150052, 180556, 211060 |
| 550 | AGQ16296 | 26947 | 57451 | 87955, 118459, 148963, 179467, 209971 | 1640 | AHL93235 | 28037 | 58541 | 89045, 119549, 150053, 180557, 211061 |
| 551 | AGQ16297 | 26948 | 57452 | 87956, 118460, 148964, 179468, 209972 | 1641 | AHL93246 | 28038 | 58542 | 89046, 119550, 150054, 180558, 211062 |

FIG. 2 continued

| | | | | | | | | | |
|---|---|---|---|---|---|---|---|---|---|
| 552 | AGQ16298 | 26949 | 57453 | 87957, 118461, 148965, 179469, 209973 | 1642 | AHL93257 | 28039 | 58543 | 89047, 119551, 150055, 180559, 211063 |
| 553 | AGQ16299 | 26950 | 57454 | 87958, 118462, 148966, 179470, 209974 | 1643 | AHL93268 | 28040 | 58544 | 89048, 119552, 150056, 180560, 211064 |
| 554 | AGQ16300 | 26951 | 57455 | 87959, 118463, 148967, 179471, 209975 | 1644 | AHL93279 | 28041 | 58545 | 89049, 119553, 150057, 180561, 211065 |
| 555 | AGQ16301 | 26952 | 57456 | 87960, 118464, 148968, 179472, 209976 | 1645 | AHL93290 | 28042 | 58546 | 89050, 119554, 150058, 180562, 211066 |
| 556 | AGQ16302 | 26953 | 57457 | 87961, 118465, 148969, 179473, 209977 | 1646 | AHL93301 | 28043 | 58547 | 89051, 119555, 150059, 180563, 211067 |
| 557 | AGQ16303 | 26954 | 57458 | 87962, 118466, 148970, 179474, 209978 | 1647 | AHL93312 | 28044 | 58548 | 89052, 119556, 150060, 180564, 211068 |
| 558 | AGQ16305 | 26955 | 57459 | 87963, 118467, 148971, 179475, 209979 | 1648 | AHL93323 | 28045 | 58549 | 89053, 119557, 150061, 180565, 211069 |
| 559 | AGQ16306 | 26956 | 57460 | 87964, 118468, 148972, 179476, 209980 | 1649 | AHL93334 | 28046 | 58550 | 89054, 119558, 150062, 180566, 211070 |
| 560 | AGQ16307 | 26957 | 57461 | 87965, 118469, 148973, 179477, 209981 | 1650 | AHL93345 | 28047 | 58551 | 89055, 119559, 150063, 180567, 211071 |
| 561 | AGQ16308 | 26958 | 57462 | 87966, 118470, 148974, 179478, 209982 | 1651 | AHL93356 | 28048 | 58552 | 89056, 119560, 150064, 180568, 211072 |
| 562 | AGQ16309 | 26959 | 57463 | 87967, 118471, 148975, 179479, 209983 | 1652 | AHL93367 | 28049 | 58553 | 89057, 119561, 150065, 180569, 211073 |
| 563 | AGQ16310 | 26960 | 57464 | 87968, 118472, 148976, 179480, 209984 | 1653 | AHL93378 | 28050 | 58554 | 89058, 119562, 150066, 180570, 211074 |
| 564 | AGQ16311 | 26961 | 57465 | 87969, 118473, 148977, 179481, 209985 | 1654 | AHL93389 | 28051 | 58555 | 89059, 119563, 150067, 180571, 211075 |
| 565 | AGQ16312 | 26962 | 57466 | 87970, 118474, 148978, 179482, 209986 | 1655 | AHL93400 | 28052 | 58556 | 89060, 119564, 150068, 180572, 211076 |
| 566 | AGQ16313 | 26963 | 57467 | 87971, 118475, 148979, 179483, 209987 | 1656 | AHL93411 | 28053 | 58557 | 89061, 119565, 150069, 180573, 211077 |
| 567 | AGQ16314 | 26964 | 57468 | 87972, 118476, 148980, 179484, 209988 | 1657 | AHL93422 | 28054 | 58558 | 89062, 119566, 150070, 180574, 211078 |
| 568 | AGQ16315 | 26965 | 57469 | 87973, 118477, 148981, 179485, 209989 | 1658 | AHL93433 | 28055 | 58559 | 89063, 119567, 150071, 180575, 211079 |
| 569 | AGQ16316 | 26966 | 57470 | 87974, 118478, 148982, 179486, 209990 | 1659 | AHL93444 | 28056 | 58560 | 89064, 119568, 150072, 180576, 211080 |

FIG. 2 continued

| | | | | | | | | | |
|---|---|---|---|---|---|---|---|---|---|
| 570 | AGQ16317 | 26967 | 57471 | 87975, 118479, 148983, 179487, 209991 | 1660 | AHL93455 | 28057 | 58561 | 89065, 119569, 150073, 180577, 211081 |
| 571 | AGQ16318 | 26968 | 57472 | 87976, 118480, 148984, 179488, 209992 | 1661 | AHL93466 | 28058 | 58562 | 89066, 119570, 150074, 180578, 211082 |
| 572 | AGQ16319 | 26969 | 57473 | 87977, 118481, 148985, 179489, 209993 | 1662 | AHL93477 | 28059 | 58563 | 89067, 119571, 150075, 180579, 211083 |
| 573 | AGQ16320 | 26970 | 57474 | 87978, 118482, 148986, 179490, 209994 | 1663 | AHL93488 | 28060 | 58564 | 89068, 119572, 150076, 180580, 211084 |
| 574 | AGQ16321 | 26971 | 57475 | 87979, 118483, 148987, 179491, 209995 | 1664 | AHL93499 | 28061 | 58565 | 89069, 119573, 150077, 180581, 211085 |
| 575 | AGQ16322 | 26972 | 57476 | 87980, 118484, 148988, 179492, 209996 | 1665 | AHL93510 | 28062 | 58566 | 89070, 119574, 150078, 180582, 211086 |
| 576 | AGQ16323 | 26973 | 57477 | 87981, 118485, 148989, 179493, 209997 | 1666 | AHL93521 | 28063 | 58567 | 89071, 119575, 150079, 180583, 211087 |
| 577 | AGQ16324 | 26974 | 57478 | 87982, 118486, 148990, 179494, 209998 | 1667 | AHL93532 | 28064 | 58568 | 89072, 119576, 150080, 180584, 211088 |
| 578 | AGQ16325 | 26975 | 57479 | 87983, 118487, 148991, 179495, 209999 | 1668 | AHL93543 | 28065 | 58569 | 89073, 119577, 150081, 180585, 211089 |
| 579 | AGQ16326 | 26976 | 57480 | 87984, 118488, 148992, 179496, 210000 | 1669 | AHL93554 | 28066 | 58570 | 89074, 119578, 150082, 180586, 211090 |
| 580 | AGQ16327 | 26977 | 57481 | 87985, 118489, 148993, 179497, 210001 | 1670 | AHL93565 | 28067 | 58571 | 89075, 119579, 150083, 180587, 211091 |
| 581 | AGQ16328 | 26978 | 57482 | 87986, 118490, 148994, 179498, 210002 | 1671 | AHL93576 | 28068 | 58572 | 89076, 119580, 150084, 180588, 211092 |
| 582 | AGX15487 | 26979 | 57483 | 87987, 118491, 148995, 179499, 210003 | 1672 | AHL93587 | 28069 | 58573 | 89077, 119581, 150085, 180589, 211093 |
| 583 | AGX15496 | 26980 | 57484 | 87988, 118492, 148996, 179500, 210004 | 1673 | AHL93609 | 28070 | 58574 | 89078, 119582, 150086, 180590, 211094 |
| 584 | AGX15518 | 26981 | 57485 | 87989, 118493, 148997, 179501, 210005 | 1674 | AHL93620 | 28071 | 58575 | 89079, 119583, 150087, 180591, 211095 |
| 585 | AGX15529 | 26982 | 57486 | 87990, 118494, 148998, 179502, 210006 | 1675 | AHL93631 | 28072 | 58576 | 89080, 119584, 150088, 180592, 211096 |
| 586 | AGX15541 | 26983 | 57487 | 87991, 118495, 148999, 179503, 210007 | 1676 | AHL93642 | 28073 | 58577 | 89081, 119585, 150089, 180593, 211097 |
| 587 | AGX15552 | 26984 | 57488 | 87992, 118496, 149000, 179504, 210008 | 1677 | AHL93653 | 28074 | 58578 | 89082, 119586, 150090, 180594, 211098 |

FIG. 2 continued

| | | | | | | | | | |
|---|---|---|---|---|---|---|---|---|---|
| 588 | AGX15563 | 26985 | 57489 | 87993, 118497, 149001, 179505, 210009 | 1678 | AHL93664 | 28075 | 58579 | 89083, 119587, 150091, 180595, 211099 |
| 589 | AGX15574 | 26986 | 57490 | 87994, 118498, 149002, 179506, 210010 | 1679 | AHL93675 | 28076 | 58580 | 89084, 119588, 150092, 180596, 211100 |
| 590 | AGX15607 | 26987 | 57491 | 87995, 118499, 149003, 179507, 210011 | 1680 | AHL93686 | 28077 | 58581 | 89085, 119589, 150093, 180597, 211101 |
| 591 | AGX15629 | 26988 | 57492 | 87996, 118500, 149004, 179508, 210012 | 1681 | AHL93697 | 28078 | 58582 | 89086, 119590, 150094, 180598, 211102 |
| 592 | AGX15651 | 26989 | 57493 | 87997, 118501, 149005, 179509, 210013 | 1682 | AHL93708 | 28079 | 58583 | 89087, 119591, 150095, 180599, 211103 |
| 593 | AGX15675 | 26990 | 57494 | 87998, 118502, 149006, 179510, 210014 | 1683 | AHL93719 | 28080 | 58584 | 89088, 119592, 150096, 180600, 211104 |
| 594 | AGX15686 | 26991 | 57495 | 87999, 118503, 149007, 179511, 210015 | 1684 | AHL93730 | 28081 | 58585 | 89089, 119593, 150097, 180601, 211105 |
| 595 | AGX15697 | 26992 | 57496 | 88000, 118504, 149008, 179512, 210016 | 1685 | AHL93741 | 28082 | 58586 | 89090, 119594, 150098, 180602, 211106 |
| 596 | AGX15708 | 26993 | 57497 | 88001, 118505, 149009, 179513, 210017 | 1686 | AHL93752 | 28083 | 58587 | 89091, 119595, 150099, 180603, 211107 |
| 597 | AGX15719 | 26994 | 57498 | 88002, 118506, 149010, 179514, 210018 | 1687 | AHL93763 | 28084 | 58588 | 89092, 119596, 150100, 180604, 211108 |
| 598 | AGX15730 | 26995 | 57499 | 88003, 118507, 149011, 179515, 210019 | 1688 | AHL93774 | 28085 | 58589 | 89093, 119597, 150101, 180605, 211109 |
| 599 | AGX15741 | 26996 | 57500 | 88004, 118508, 149012, 179516, 210020 | 1689 | AHL93785 | 28086 | 58590 | 89094, 119598, 150102, 180606, 211110 |
| 600 | AGX15753 | 26997 | 57501 | 88005, 118509, 149013, 179517, 210021 | 1690 | AHL93796 | 28087 | 58591 | 89095, 119599, 150103, 180607, 211111 |
| 601 | AGX15764 | 26998 | 57502 | 88006, 118510, 149014, 179518, 210022 | 1691 | AHL93818 | 28088 | 58592 | 89096, 119600, 150104, 180608, 211112 |
| 602 | AGX15775 | 26999 | 57503 | 88007, 118511, 149015, 179519, 210023 | 1692 | AHL93829 | 28089 | 58593 | 89097, 119601, 150105, 180609, 211113 |
| 603 | AGX15786 | 27000 | 57504 | 88008, 118512, 149016, 179520, 210024 | 1693 | AHL93840 | 28090 | 58594 | 89098, 119602, 150106, 180610, 211114 |
| 604 | AGX15797 | 27001 | 57505 | 88009, 118513, 149017, 179521, 210025 | 1694 | AHL93851 | 28091 | 58595 | 89099, 119603, 150107, 180611, 211115 |
| 605 | AGX15808 | 27002 | 57506 | 88010, 118514, 149018, 179522, 210026 | 1695 | AHL93862 | 28092 | 58596 | 89100, 119604, 150108, 180612, 211116 |

FIG. 2 continued

| | | | | | | | | | |
|---|---|---|---|---|---|---|---|---|---|
| 606 | AGX15830 | 27003 | 57507 | 88011, 118515, 149019, 179523, 210027 | 1696 | AHL93873 | 28093 | 58597 | 89101, 119605, 150109, 180613, 211117 |
| 607 | AGX15841 | 27004 | 57508 | 88012, 118516, 149020, 179524, 210028 | 1697 | AHL93884 | 28094 | 58598 | 89102, 119606, 150110, 180614, 211118 |
| 608 | AGX15852 | 27005 | 57509 | 88013, 118517, 149021, 179525, 210029 | 1698 | AHL93895 | 28095 | 58599 | 89103, 119607, 150111, 180615, 211119 |
| 609 | AGX15863 | 27006 | 57510 | 88014, 118518, 149022, 179526, 210030 | 1699 | AHL93906 | 28096 | 58600 | 89104, 119608, 150112, 180616, 211120 |
| 610 | AGX15874 | 27007 | 57511 | 88015, 118519, 149023, 179527, 210031 | 1700 | AHL93917 | 28097 | 58601 | 89105, 119609, 150113, 180617, 211121 |
| 611 | AGX15885 | 27008 | 57512 | 88016, 118520, 149024, 179528, 210032 | 1701 | AHL93928 | 28098 | 58602 | 89106, 119610, 150114, 180618, 211122 |
| 612 | AGX15896 | 27009 | 57513 | 88017, 118521, 149025, 179529, 210033 | 1702 | AHL93939 | 28099 | 58603 | 89107, 119611, 150115, 180619, 211123 |
| 613 | AGX15907 | 27010 | 57514 | 88018, 118522, 149026, 179530, 210034 | 1703 | AHL93950 | 28100 | 58604 | 89108, 119612, 150116, 180620, 211124 |
| 614 | AGX15918 | 27011 | 57515 | 88019, 118523, 149027, 179531, 210035 | 1704 | AHL93961 | 28101 | 58605 | 89109, 119613, 150117, 180621, 211125 |
| 615 | AGX15929 | 27012 | 57516 | 88020, 118524, 149028, 179532, 210036 | 1705 | AHL93972 | 28102 | 58606 | 89110, 119614, 150118, 180622, 211126 |
| 616 | AGX15940 | 27013 | 57517 | 88021, 118525, 149029, 179533, 210037 | 1706 | AHL93983 | 28103 | 58607 | 89111, 119615, 150119, 180623, 211127 |
| 617 | AGX15962 | 27014 | 57518 | 88022, 118526, 149030, 179534, 210038 | 1707 | AHL93994 | 28104 | 58608 | 89112, 119616, 150120, 180624, 211128 |
| 618 | AGX15973 | 27015 | 57519 | 88023, 118527, 149031, 179535, 210039 | 1708 | AHL94005 | 28105 | 58609 | 89113, 119617, 150121, 180625, 211129 |
| 619 | AGX15984 | 27016 | 57520 | 88024, 118528, 149032, 179536, 210040 | 1709 | AHL94016 | 28106 | 58610 | 89114, 119618, 150122, 180626, 211130 |
| 620 | AGX15995 | 27017 | 57521 | 88025, 118529, 149033, 179537, 210041 | 1710 | AHL94027 | 28107 | 58611 | 89115, 119619, 150123, 180627, 211131 |
| 621 | AGX16006 | 27018 | 57522 | 88026, 118530, 149034, 179538, 210042 | 1711 | AHL94038 | 28108 | 58612 | 89116, 119620, 150124, 180628, 211132 |
| 622 | AGX16017 | 27019 | 57523 | 88027, 118531, 149035, 179539, 210043 | 1712 | AHL94049 | 28109 | 58613 | 89117, 119621, 150125, 180629, 211133 |
| 623 | AGX16028 | 27020 | 57524 | 88028, 118532, 149036, 179540, 210044 | 1713 | AHL94060 | 28110 | 58614 | 89118, 119622, 150126, 180630, 211134 |

FIG. 2 continued

| | | | | | | | | | |
|---|---|---|---|---|---|---|---|---|---|
| 624 | AGX16039 | 27021 | 57525 | 88029, 118533, 149037, 179541, 210045 | 1714 | AHL94071 | 28111 | 58615 | 89119, 119623, 150127, 180631, 211135 |
| 625 | AGX16050 | 27022 | 57526 | 88030, 118534, 149038, 179542, 210046 | 1715 | AHL94082 | 28112 | 58616 | 89120, 119624, 150128, 180632, 211136 |
| 626 | AGX16061 | 27023 | 57527 | 88031, 118535, 149039, 179543, 210047 | 1716 | AHL94093 | 28113 | 58617 | 89121, 119625, 150129, 180633, 211137 |
| 627 | AGX16083 | 27024 | 57528 | 88032, 118536, 149040, 179544, 210048 | 1717 | AHL94102 | 28114 | 58618 | 89122, 119626, 150130, 180634, 211138 |
| 628 | AGX16105 | 27025 | 57529 | 88033, 118537, 149041, 179545, 210049 | 1718 | AHL94113 | 28115 | 58619 | 89123, 119627, 150131, 180635, 211139 |
| 629 | AGX16116 | 27026 | 57530 | 88034, 118538, 149042, 179546, 210050 | 1719 | AHL94124 | 28116 | 58620 | 89124, 119628, 150132, 180636, 211140 |
| 630 | AGX16127 | 27027 | 57531 | 88035, 118539, 149043, 179547, 210051 | 1720 | AHL94135 | 28117 | 58621 | 89125, 119629, 150133, 180637, 211141 |
| 631 | AGX16138 | 27028 | 57532 | 88036, 118540, 149044, 179548, 210052 | 1721 | AHL94146 | 28118 | 58622 | 89126, 119630, 150134, 180638, 211142 |
| 632 | AGX16149 | 27029 | 57533 | 88037, 118541, 149045, 179549, 210053 | 1722 | AHL94157 | 28119 | 58623 | 89127, 119631, 150135, 180639, 211143 |
| 633 | AGX16160 | 27030 | 57534 | 88038, 118542, 149046, 179550, 210054 | 1723 | AHL94168 | 28120 | 58624 | 89128, 119632, 150136, 180640, 211144 |
| 634 | AGX16182 | 27031 | 57535 | 88039, 118543, 149047, 179551, 210055 | 1724 | AHL94179 | 28121 | 58625 | 89129, 119633, 150137, 180641, 211145 |
| 635 | AGX16193 | 27032 | 57536 | 88040, 118544, 149048, 179552, 210056 | 1725 | AHL94190 | 28122 | 58626 | 89130, 119634, 150138, 180642, 211146 |
| 636 | AGX16215 | 27033 | 57537 | 88041, 118545, 149049, 179553, 210057 | 1726 | AHL94201 | 28123 | 58627 | 89131, 119635, 150139, 180643, 211147 |
| 637 | AGX16226 | 27034 | 57538 | 88042, 118546, 149050, 179554, 210058 | 1727 | AHL94212 | 28124 | 58628 | 89132, 119636, 150140, 180644, 211148 |
| 638 | AGX16237 | 27035 | 57539 | 88043, 118547, 149051, 179555, 210059 | 1728 | AHL94220 | 28125 | 58629 | 89133, 119637, 150141, 180645, 211149 |
| 639 | AGX16248 | 27036 | 57540 | 88044, 118548, 149052, 179556, 210060 | 1729 | AHL94231 | 28126 | 58630 | 89134, 119638, 150142, 180646, 211150 |
| 640 | AGX16259 | 27037 | 57541 | 88045, 118549, 149053, 179557, 210061 | 1730 | AHL94242 | 28127 | 58631 | 89135, 119639, 150143, 180647, 211151 |
| 641 | AGX16270 | 27038 | 57542 | 88046, 118550, 149054, 179558, 210062 | 1731 | AHL94253 | 28128 | 58632 | 89136, 119640, 150144, 180648, 211152 |

FIG. 2 continued

| | | | | | | | | | |
|---|---|---|---|---|---|---|---|---|---|
| 642 | AGX16281 | 27039 | 57543 | 88047, 118551, 149055, 179559, 210063 | 1732 | AHL94274 | 28129 | 58633 | 89137, 119641, 150145, 180649, 211153 |
| 643 | AGX16292 | 27040 | 57544 | 88048, 118552, 149056, 179560, 210064 | 1733 | AHL94295 | 28130 | 58634 | 89138, 119642, 150146, 180650, 211154 |
| 644 | AGX16303 | 27041 | 57545 | 88049, 118553, 149057, 179561, 210065 | 1734 | AHL94306 | 28131 | 58635 | 89139, 119643, 150147, 180651, 211155 |
| 645 | AGX16314 | 27042 | 57546 | 88050, 118554, 149058, 179562, 210066 | 1735 | AHL94317 | 28132 | 58636 | 89140, 119644, 150148, 180652, 211156 |
| 646 | AGX16325 | 27043 | 57547 | 88051, 118555, 149059, 179563, 210067 | 1736 | AHL94328 | 28133 | 58637 | 89141, 119645, 150149, 180653, 211157 |
| 647 | AGX16336 | 27044 | 57548 | 88052, 118556, 149060, 179564, 210068 | 1737 | AHL94339 | 28134 | 58638 | 89142, 119646, 150150, 180654, 211158 |
| 648 | AGX16347 | 27045 | 57549 | 88053, 118557, 149061, 179565, 210069 | 1738 | AHL94350 | 28135 | 58639 | 89143, 119647, 150151, 180655, 211159 |
| 649 | AGX16358 | 27046 | 57550 | 88054, 118558, 149062, 179566, 210070 | 1739 | AHL94361 | 28136 | 58640 | 89144, 119648, 150152, 180656, 211160 |
| 650 | AGX16369 | 27047 | 57551 | 88055, 118559, 149063, 179567, 210071 | 1740 | AHL94383 | 28137 | 58641 | 89145, 119649, 150153, 180657, 211161 |
| 651 | AGX16380 | 27048 | 57552 | 88056, 118560, 149064, 179568, 210072 | 1741 | AHL94394 | 28138 | 58642 | 89146, 119650, 150154, 180658, 211162 |
| 652 | AGX16391 | 27049 | 57553 | 88057, 118561, 149065, 179569, 210073 | 1742 | AHL94405 | 28139 | 58643 | 89147, 119651, 150155, 180659, 211163 |
| 653 | AGX16402 | 27050 | 57554 | 88058, 118562, 149066, 179570, 210074 | 1743 | AHL94416 | 28140 | 58644 | 89148, 119652, 150156, 180660, 211164 |
| 654 | AGX16413 | 27051 | 57555 | 88059, 118563, 149067, 179571, 210075 | 1744 | AHL94427 | 28141 | 58645 | 89149, 119653, 150157, 180661, 211165 |
| 655 | AGX16423 | 27052 | 57556 | 88060, 118564, 149068, 179572, 210076 | 1745 | AHL94438 | 28142 | 58646 | 89150, 119654, 150158, 180662, 211166 |
| 656 | AGX16434 | 27053 | 57557 | 88061, 118565, 149069, 179573, 210077 | 1746 | AHL94460 | 28143 | 58647 | 89151, 119655, 150159, 180663, 211167 |
| 657 | AGX16445 | 27054 | 57558 | 88062, 118566, 149070, 179574, 210078 | 1747 | AHL94471 | 28144 | 58648 | 89152, 119656, 150160, 180664, 211168 |
| 658 | AGX16456 | 27055 | 57559 | 88063, 118567, 149071, 179575, 210079 | 1748 | AHL94482 | 28145 | 58649 | 89153, 119657, 150161, 180665, 211169 |
| 659 | AGX16467 | 27056 | 57560 | 88064, 118568, 149072, 179576, 210080 | 1749 | AHL94493 | 28146 | 58650 | 89154, 119658, 150162, 180666, 211170 |

FIG. 2 continued

| | | | | | | | | | |
|---|---|---|---|---|---|---|---|---|---|
| 660 | AGX16478 | 27057 | 57561 | 88065, 118569, 149073, 179577, 210081 | 1750 | AHL94504 | 28147 | 58651 | 89155, 119659, 150163, 180667, 211171 |
| 661 | AGX16489 | 27058 | 57562 | 88066, 118570, 149074, 179578, 210082 | 1751 | AHL94515 | 28148 | 58652 | 89156, 119660, 150164, 180668, 211172 |
| 662 | AGX16500 | 27059 | 57563 | 88067, 118571, 149075, 179579, 210083 | 1752 | AHL94526 | 28149 | 58653 | 89157, 119661, 150165, 180669, 211173 |
| 663 | AGX16511 | 27060 | 57564 | 88068, 118572, 149076, 179580, 210084 | 1753 | AHL94537 | 28150 | 58654 | 89158, 119662, 150166, 180670, 211174 |
| 664 | AGX16522 | 27061 | 57565 | 88069, 118573, 149077, 179581, 210085 | 1754 | AHL94548 | 28151 | 58655 | 89159, 119663, 150167, 180671, 211175 |
| 665 | AGX16533 | 27062 | 57566 | 88070, 118574, 149078, 179582, 210086 | 1755 | AHL94559 | 28152 | 58656 | 89160, 119664, 150168, 180672, 211176 |
| 666 | AGX16555 | 27063 | 57567 | 88071, 118575, 149079, 179583, 210087 | 1756 | AHL94570 | 28153 | 58657 | 89161, 119665, 150169, 180673, 211177 |
| 667 | AGX16566 | 27064 | 57568 | 88072, 118576, 149080, 179584, 210088 | 1757 | AHL94581 | 28154 | 58658 | 89162, 119666, 150170, 180674, 211178 |
| 668 | AGX16577 | 27065 | 57569 | 88073, 118577, 149081, 179585, 210089 | 1758 | AHL94592 | 28155 | 58659 | 89163, 119667, 150171, 180675, 211179 |
| 669 | AGX16588 | 27066 | 57570 | 88074, 118578, 149082, 179586, 210090 | 1759 | AHL94603 | 28156 | 58660 | 89164, 119668, 150172, 180676, 211180 |
| 670 | AGX16599 | 27067 | 57571 | 88075, 118579, 149083, 179587, 210091 | 1760 | AHL94614 | 28157 | 58661 | 89165, 119669, 150173, 180677, 211181 |
| 671 | AGX16610 | 27068 | 57572 | 88076, 118580, 149084, 179588, 210092 | 1761 | AHL94624 | 28158 | 58662 | 89166, 119670, 150174, 180678, 211182 |
| 672 | AGX16621 | 27069 | 57573 | 88077, 118581, 149085, 179589, 210093 | 1762 | AHL94646 | 28159 | 58663 | 89167, 119671, 150175, 180679, 211183 |
| 673 | AGX16654 | 27070 | 57574 | 88078, 118582, 149086, 179590, 210094 | 1763 | AHL94657 | 28160 | 58664 | 89168, 119672, 150176, 180680, 211184 |
| 674 | AGX16665 | 27071 | 57575 | 88079, 118583, 149087, 179591, 210095 | 1764 | AHL94668 | 28161 | 58665 | 89169, 119673, 150177, 180681, 211185 |
| 675 | AGX16676 | 27072 | 57576 | 88080, 118584, 149088, 179592, 210096 | 1765 | AHL94679 | 28162 | 58666 | 89170, 119674, 150178, 180682, 211186 |
| 676 | AGX16687 | 27073 | 57577 | 88081, 118585, 149089, 179593, 210097 | 1766 | AHL94690 | 28163 | 58667 | 89171, 119675, 150179, 180683, 211187 |
| 677 | AGX16698 | 27074 | 57578 | 88082, 118586, 149090, 179594, 210098 | 1767 | AHL94701 | 28164 | 58668 | 89172, 119676, 150180, 180684, 211188 |

FIG. 2 continued

| | | | | | | | | | |
|---|---|---|---|---|---|---|---|---|---|
| 678 | AGX16709 | 27075 | 57579 | 88083, 118587, 149091, 179595, 210099 | 1768 | AHL94712 | 28165 | 58669 | 89173, 119677, 150181, 180685, 211189 |
| 679 | AGX16720 | 27076 | 57580 | 88084, 118588, 149092, 179596, 210100 | 1769 | AHL94723 | 28166 | 58670 | 89174, 119678, 150182, 180686, 211190 |
| 680 | AGX16731 | 27077 | 57581 | 88085, 118589, 149093, 179597, 210101 | 1770 | AHL94734 | 28167 | 58671 | 89175, 119679, 150183, 180687, 211191 |
| 681 | AGX16742 | 27078 | 57582 | 88086, 118590, 149094, 179598, 210102 | 1771 | AHL94745 | 28168 | 58672 | 89176, 119680, 150184, 180688, 211192 |
| 682 | AGX16753 | 27079 | 57583 | 88087, 118591, 149095, 179599, 210103 | 1772 | AHL94756 | 28169 | 58673 | 89177, 119681, 150185, 180689, 211193 |
| 683 | AGX16764 | 27080 | 57584 | 88088, 118592, 149096, 179600, 210104 | 1773 | AHL94766 | 28170 | 58674 | 89178, 119682, 150186, 180690, 211194 |
| 684 | AGX16775 | 27081 | 57585 | 88089, 118593, 149097, 179601, 210105 | 1774 | AHL94777 | 28171 | 58675 | 89179, 119683, 150187, 180691, 211195 |
| 685 | AGX16797 | 27082 | 57586 | 88090, 118594, 149098, 179602, 210106 | 1775 | AHL94797 | 28172 | 58676 | 89180, 119684, 150188, 180692, 211196 |
| 686 | AGX16808 | 27083 | 57587 | 88091, 118595, 149099, 179603, 210107 | 1776 | AHL94808 | 28173 | 58677 | 89181, 119685, 150189, 180693, 211197 |
| 687 | AGX16819 | 27084 | 57588 | 88092, 118596, 149100, 179604, 210108 | 1777 | AHL94817 | 28174 | 58678 | 89182, 119686, 150190, 180694, 211198 |
| 688 | AGX16830 | 27085 | 57589 | 88093, 118597, 149101, 179605, 210109 | 1778 | AHL94827 | 28175 | 58679 | 89183, 119687, 150191, 180695, 211199 |
| 689 | AGX16841 | 27086 | 57590 | 88094, 118598, 149102, 179606, 210110 | 1779 | AHL94837 | 28176 | 58680 | 89184, 119688, 150192, 180696, 211200 |
| 690 | AGX16852 | 27087 | 57591 | 88095, 118599, 149103, 179607, 210111 | 1780 | AHL94847 | 28177 | 58681 | 89185, 119689, 150193, 180697, 211201 |
| 691 | AGX16863 | 27088 | 57592 | 88096, 118600, 149104, 179608, 210112 | 1781 | AHL94858 | 28178 | 58682 | 89186, 119690, 150194, 180698, 211202 |
| 692 | AGX16874 | 27089 | 57593 | 88097, 118601, 149105, 179609, 210113 | 1782 | AHL94869 | 28179 | 58683 | 89187, 119691, 150195, 180699, 211203 |
| 693 | AGX16885 | 27090 | 57594 | 88098, 118602, 149106, 179610, 210114 | 1783 | AHL94880 | 28180 | 58684 | 89188, 119692, 150196, 180700, 211204 |
| 694 | AGX16896 | 27091 | 57595 | 88099, 118603, 149107, 179611, 210115 | 1784 | AHL94889 | 28181 | 58685 | 89189, 119693, 150197, 180701, 211205 |
| 695 | AGX16907 | 27092 | 57596 | 88100, 118604, 149108, 179612, 210116 | 1785 | AHL94900 | 28182 | 58686 | 89190, 119694, 150198, 180702, 211206 |

FIG. 2 continued

| | | | | | | | | | |
|---|---|---|---|---|---|---|---|---|---|
| 696 | AGX16918 | 27093 | 57597 | 88101, 118605, 149109, 179613, 210117 | 1786 | AHL94911 | 28183 | 58687 | 89191, 119695, 150199, 180703, 211207 |
| 697 | AGX16940 | 27094 | 57598 | 88102, 118606, 149110, 179614, 210118 | 1787 | AHL94922 | 28184 | 58688 | 89192, 119696, 150200, 180704, 211208 |
| 698 | AGX16951 | 27095 | 57599 | 88103, 118607, 149111, 179615, 210119 | 1788 | AHL94933 | 28185 | 58689 | 89193, 119697, 150201, 180705, 211209 |
| 699 | AGX16962 | 27096 | 57600 | 88104, 118608, 149112, 179616, 210120 | 1789 | AHL94944 | 28186 | 58690 | 89194, 119698, 150202, 180706, 211210 |
| 700 | AGX16973 | 27097 | 57601 | 88105, 118609, 149113, 179617, 210121 | 1790 | AHL94955 | 28187 | 58691 | 89195, 119699, 150203, 180707, 211211 |
| 701 | AGX16995 | 27098 | 57602 | 88106, 118610, 149114, 179618, 210122 | 1791 | AHL94965 | 28188 | 58692 | 89196, 119700, 150204, 180708, 211212 |
| 702 | AGX17006 | 27099 | 57603 | 88107, 118611, 149115, 179619, 210123 | 1792 | AHL94975 | 28189 | 58693 | 89197, 119701, 150205, 180709, 211213 |
| 703 | AGX17017 | 27100 | 57604 | 88108, 118612, 149116, 179620, 210124 | 1793 | AHM00986 | 28190 | 58694 | 89198, 119702, 150206, 180710, 211214 |
| 704 | AGX17028 | 27101 | 57605 | 88109, 118613, 149117, 179621, 210125 | 1794 | AHM00997 | 28191 | 58695 | 89199, 119703, 150207, 180711, 211215 |
| 705 | AGX17039 | 27102 | 57606 | 88110, 118614, 149118, 179622, 210126 | 1795 | AHM01008 | 28192 | 58696 | 89200, 119704, 150208, 180712, 211216 |
| 706 | AGX17050 | 27103 | 57607 | 88111, 118615, 149119, 179623, 210127 | 1796 | AHM01019 | 28193 | 58697 | 89201, 119705, 150209, 180713, 211217 |
| 707 | AGX17061 | 27104 | 57608 | 88112, 118616, 149120, 179624, 210128 | 1797 | AHM01030 | 28194 | 58698 | 89202, 119706, 150210, 180714, 211218 |
| 708 | AGX17072 | 27105 | 57609 | 88113, 118617, 149121, 179625, 210129 | 1798 | AHM01041 | 28195 | 58699 | 89203, 119707, 150211, 180715, 211219 |
| 709 | AGX17083 | 27106 | 57610 | 88114, 118618, 149122, 179626, 210130 | 1799 | AHM01052 | 28196 | 58700 | 89204, 119708, 150212, 180716, 211220 |
| 710 | AGX17094 | 27107 | 57611 | 88115, 118619, 149123, 179627, 210131 | 1800 | AHM01063 | 28197 | 58701 | 89205, 119709, 150213, 180717, 211221 |
| 711 | AGX17105 | 27108 | 57612 | 88116, 118620, 149124, 179628, 210132 | 1801 | AHM01074 | 28198 | 58702 | 89206, 119710, 150214, 180718, 211222 |
| 712 | AGX17116 | 27109 | 57613 | 88117, 118621, 149125, 179629, 210133 | 1802 | AHM01096 | 28199 | 58703 | 89207, 119711, 150215, 180719, 211223 |
| 713 | AGX17127 | 27110 | 57614 | 88118, 118622, 149126, 179630, 210134 | 1803 | AHM01107 | 28200 | 58704 | 89208, 119712, 150216, 180720, 211224 |

FIG. 2 continued

| | | | | | | | | | |
|---|---|---|---|---|---|---|---|---|---|
| 714 | AGX17138 | 27111 | 57615 | 88119, 118623, 149127, 179631, 210135 | 1804 | AHM01118 | 28201 | 58705 | 89209, 119713, 150217, 180721, 211225 |
| 715 | AGX17149 | 27112 | 57616 | 88120, 118624, 149128, 179632, 210136 | 1805 | AHM01129 | 28202 | 58706 | 89210, 119714, 150218, 180722, 211226 |
| 716 | AGX17160 | 27113 | 57617 | 88121, 118625, 149129, 179633, 210137 | 1806 | AHM01140 | 28203 | 58707 | 89211, 119715, 150219, 180723, 211227 |
| 717 | AGX17171 | 27114 | 57618 | 88122, 118626, 149130, 179634, 210138 | 1807 | AHM01151 | 28204 | 58708 | 89212, 119716, 150220, 180724, 211228 |
| 718 | AGX17182 | 27115 | 57619 | 88123, 118627, 149131, 179635, 210139 | 1808 | AHM01162 | 28205 | 58709 | 89213, 119717, 150221, 180725, 211229 |
| 719 | AGX17193 | 27116 | 57620 | 88124, 118628, 149132, 179636, 210140 | 1809 | AHM01173 | 28206 | 58710 | 89214, 119718, 150222, 180726, 211230 |
| 720 | AGX17204 | 27117 | 57621 | 88125, 118629, 149133, 179637, 210141 | 1810 | AHM01184 | 28207 | 58711 | 89215, 119719, 150223, 180727, 211231 |
| 721 | AGX17215 | 27118 | 57622 | 88126, 118630, 149134, 179638, 210142 | 1811 | AHM01195 | 28208 | 58712 | 89216, 119720, 150224, 180728, 211232 |
| 722 | AGX17226 | 27119 | 57623 | 88127, 118631, 149135, 179639, 210143 | 1812 | AHM01206 | 28209 | 58713 | 89217, 119721, 150225, 180729, 211233 |
| 723 | AGX17237 | 27120 | 57624 | 88128, 118632, 149136, 179640, 210144 | 1813 | AHM01217 | 28210 | 58714 | 89218, 119722, 150226, 180730, 211234 |
| 724 | AGX17248 | 27121 | 57625 | 88129, 118633, 149137, 179641, 210145 | 1814 | AHM01228 | 28211 | 58715 | 89219, 119723, 150227, 180731, 211235 |
| 725 | AGX17270 | 27122 | 57626 | 88130, 118634, 149138, 179642, 210146 | 1815 | AHM01239 | 28212 | 58716 | 89220, 119724, 150228, 180732, 211236 |
| 726 | AGX17281 | 27123 | 57627 | 88131, 118635, 149139, 179643, 210147 | 1816 | AHM01250 | 28213 | 58717 | 89221, 119725, 150229, 180733, 211237 |
| 727 | AGX17292 | 27124 | 57628 | 88132, 118636, 149140, 179644, 210148 | 1817 | AHM01261 | 28214 | 58718 | 89222, 119726, 150230, 180734, 211238 |
| 728 | AGX17303 | 27125 | 57629 | 88133, 118637, 149141, 179645, 210149 | 1818 | AHM01272 | 28215 | 58719 | 89223, 119727, 150231, 180735, 211239 |
| 729 | AGX17314 | 27126 | 57630 | 88134, 118638, 149142, 179646, 210150 | 1819 | AHM01283 | 28216 | 58720 | 89224, 119728, 150232, 180736, 211240 |
| 730 | AGX17325 | 27127 | 57631 | 88135, 118639, 149143, 179647, 210151 | 1820 | AHM01294 | 28217 | 58721 | 89225, 119729, 150233, 180737, 211241 |
| 731 | AGX17336 | 27128 | 57632 | 88136, 118640, 149144, 179648, 210152 | 1821 | AHM01305 | 28218 | 58722 | 89226, 119730, 150234, 180738, 211242 |

FIG. 2 continued

| | | | | | | | | | |
|---|---|---|---|---|---|---|---|---|---|
| 732 | AGX17347 | 27129 | 57633 | 88137, 118641, 149145, 179649, 210153 | 1822 | AHM01316 | 28219 | 58723 | 89227, 119731, 150235, 180739, 211243 |
| 733 | AGX17358 | 27130 | 57634 | 88138, 118642, 149146, 179650, 210154 | 1823 | AHM01327 | 28220 | 58724 | 89228, 119732, 150236, 180740, 211244 |
| 734 | AGX17369 | 27131 | 57635 | 88139, 118643, 149147, 179651, 210155 | 1824 | AHM01338 | 28221 | 58725 | 89229, 119733, 150237, 180741, 211245 |
| 735 | AGX17380 | 27132 | 57636 | 88140, 118644, 149148, 179652, 210156 | 1825 | AHM01349 | 28222 | 58726 | 89230, 119734, 150238, 180742, 211246 |
| 736 | AGX17391 | 27133 | 57637 | 88141, 118645, 149149, 179653, 210157 | 1826 | AHM01360 | 28223 | 58727 | 89231, 119735, 150239, 180743, 211247 |
| 737 | AGX17400 | 27134 | 57638 | 88142, 118646, 149150, 179654, 210158 | 1827 | AHM01371 | 28224 | 58728 | 89232, 119736, 150240, 180744, 211248 |
| 738 | AGX17411 | 27135 | 57639 | 88143, 118647, 149151, 179655, 210159 | 1828 | AHM01382 | 28225 | 58729 | 89233, 119737, 150241, 180745, 211249 |
| 739 | AGX17422 | 27136 | 57640 | 88144, 118648, 149152, 179656, 210160 | 1829 | AHM01393 | 28226 | 58730 | 89234, 119738, 150242, 180746, 211250 |
| 740 | AGX17433 | 27137 | 57641 | 88145, 118649, 149153, 179657, 210161 | 1830 | AHM01404 | 28227 | 58731 | 89235, 119739, 150243, 180747, 211251 |
| 741 | AGX17444 | 27138 | 57642 | 88146, 118650, 149154, 179658, 210162 | 1831 | AHM01415 | 28228 | 58732 | 89236, 119740, 150244, 180748, 211252 |
| 742 | AGX17455 | 27139 | 57643 | 88147, 118651, 149155, 179659, 210163 | 1832 | AHM01426 | 28229 | 58733 | 89237, 119741, 150245, 180749, 211253 |
| 743 | AGX17466 | 27140 | 57644 | 88148, 118652, 149156, 179660, 210164 | 1833 | AHM01437 | 28230 | 58734 | 89238, 119742, 150246, 180750, 211254 |
| 744 | AGX17477 | 27141 | 57645 | 88149, 118653, 149157, 179661, 210165 | 1834 | AHM01448 | 28231 | 58735 | 89239, 119743, 150247, 180751, 211255 |
| 745 | AGX17488 | 27142 | 57646 | 88150, 118654, 149158, 179662, 210166 | 1835 | AHM01459 | 28232 | 58736 | 89240, 119744, 150248, 180752, 211256 |
| 746 | AGX17499 | 27143 | 57647 | 88151, 118655, 149159, 179663, 210167 | 1836 | AHM01470 | 28233 | 58737 | 89241, 119745, 150249, 180753, 211257 |
| 747 | AGX17510 | 27144 | 57648 | 88152, 118656, 149160, 179664, 210168 | 1837 | AHM01481 | 28234 | 58738 | 89242, 119746, 150250, 180754, 211258 |
| 748 | AGX17521 | 27145 | 57649 | 88153, 118657, 149161, 179665, 210169 | 1838 | AHM01492 | 28235 | 58739 | 89243, 119747, 150251, 180755, 211259 |
| 749 | AGX17532 | 27146 | 57650 | 88154, 118658, 149162, 179666, 210170 | 1839 | AHM01503 | 28236 | 58740 | 89244, 119748, 150252, 180756, 211260 |

FIG. 2 continued

| | | | | | | | | | |
|---|---|---|---|---|---|---|---|---|---|
| 750 | AGX17543 | 27147 | 57651 | 88155, 118659, 149163, 179667, 210171 | 1840 | AHM01514 | 28237 | 58741 | 89245, 119749, 150253, 180757, 211261 |
| 751 | AGX17554 | 27148 | 57652 | 88156, 118660, 149164, 179668, 210172 | 1841 | AHM01525 | 28238 | 58742 | 89246, 119750, 150254, 180758, 211262 |
| 752 | AGX17565 | 27149 | 57653 | 88157, 118661, 149165, 179669, 210173 | 1842 | AHM01536 | 28239 | 58743 | 89247, 119751, 150255, 180759, 211263 |
| 753 | AGX17576 | 27150 | 57654 | 88158, 118662, 149166, 179670, 210174 | 1843 | AHM01547 | 28240 | 58744 | 89248, 119752, 150256, 180760, 211264 |
| 754 | AGX17598 | 27151 | 57655 | 88159, 118663, 149167, 179671, 210175 | 1844 | AHM01558 | 28241 | 58745 | 89249, 119753, 150257, 180761, 211265 |
| 755 | AGX17609 | 27152 | 57656 | 88160, 118664, 149168, 179672, 210176 | 1845 | AHV83951 | 28242 | 58746 | 89250, 119754, 150258, 180762, 211266 |
| 756 | AGX17620 | 27153 | 57657 | 88161, 118665, 149169, 179673, 210177 | 1846 | AHV83952 | 28243 | 58747 | 89251, 119755, 150259, 180763, 211267 |
| 757 | AGX17631 | 27154 | 57658 | 88162, 118666, 149170, 179674, 210178 | 1847 | AHZ36697 | 28244 | 58748 | 89252, 119756, 150260, 180764, 211268 |
| 758 | AGX17642 | 27155 | 57659 | 88163, 118667, 149171, 179675, 210179 | 1848 | AHZ36708 | 28245 | 58749 | 89253, 119757, 150261, 180765, 211269 |
| 759 | AGX17653 | 27156 | 57660 | 88164, 118668, 149172, 179676, 210180 | 1849 | AHZ36719 | 28246 | 58750 | 89254, 119758, 150262, 180766, 211270 |
| 760 | AGX17664 | 27157 | 57661 | 88165, 118669, 149173, 179677, 210181 | 1850 | AHZ36730 | 28247 | 58751 | 89255, 119759, 150263, 180767, 211271 |
| 761 | AGX17675 | 27158 | 57662 | 88166, 118670, 149174, 179678, 210182 | 1851 | AHZ36752 | 28248 | 58752 | 89256, 119760, 150264, 180768, 211272 |
| 762 | AGX17686 | 27159 | 57663 | 88167, 118671, 149175, 179679, 210183 | 1852 | AHZ36763 | 28249 | 58753 | 89257, 119761, 150265, 180769, 211273 |
| 763 | AGX17697 | 27160 | 57664 | 88168, 118672, 149176, 179680, 210184 | 1853 | AHZ36774 | 28250 | 58754 | 89258, 119762, 150266, 180770, 211274 |
| 764 | AGX17708 | 27161 | 57665 | 88169, 118673, 149177, 179681, 210185 | 1854 | AHZ36785 | 28251 | 58755 | 89259, 119763, 150267, 180771, 211275 |
| 765 | AGX17719 | 27162 | 57666 | 88170, 118674, 149178, 179682, 210186 | 1855 | AHZ36796 | 28252 | 58756 | 89260, 119764, 150268, 180772, 211276 |
| 766 | AGX17730 | 27163 | 57667 | 88171, 118675, 149179, 179683, 210187 | 1856 | AHZ36807 | 28253 | 58757 | 89261, 119765, 150269, 180773, 211277 |
| 767 | AGX17741 | 27164 | 57668 | 88172, 118676, 149180, 179684, 210188 | 1857 | AHZ36818 | 28254 | 58758 | 89262, 119766, 150270, 180774, 211278 |

FIG. 2 continued

| | | | | | | | | | |
|---|---|---|---|---|---|---|---|---|---|
| 768 | AGX17752 | 27165 | 57669 | 88173, 118677, 149181, 179685, 210189 | 1858 | AHZ36829 | 28255 | 58759 | 89263, 119767, 150271, 180775, 211279 |
| 769 | AGX17774 | 27166 | 57670 | 88174, 118678, 149182, 179686, 210190 | 1859 | AHZ36840 | 28256 | 58760 | 89264, 119768, 150272, 180776, 211280 |
| 770 | AGX17785 | 27167 | 57671 | 88175, 118679, 149183, 179687, 210191 | 1860 | AHZ36851 | 28257 | 58761 | 89265, 119769, 150273, 180777, 211281 |
| 771 | AGX17796 | 27168 | 57672 | 88176, 118680, 149184, 179688, 210192 | 1861 | AHZ36862 | 28258 | 58762 | 89266, 119770, 150274, 180778, 211282 |
| 772 | AGX17807 | 27169 | 57673 | 88177, 118681, 149185, 179689, 210193 | 1862 | AHZ36873 | 28259 | 58763 | 89267, 119771, 150275, 180779, 211283 |
| 773 | AGX17818 | 27170 | 57674 | 88178, 118682, 149186, 179690, 210194 | 1863 | AHZ36884 | 28260 | 58764 | 89268, 119772, 150276, 180780, 211284 |
| 774 | AGX17829 | 27171 | 57675 | 88179, 118683, 149187, 179691, 210195 | 1864 | AHZ36895 | 28261 | 58765 | 89269, 119773, 150277, 180781, 211285 |
| 775 | AGX17840 | 27172 | 57676 | 88180, 118684, 149188, 179692, 210196 | 1865 | AHZ36906 | 28262 | 58766 | 89270, 119774, 150278, 180782, 211286 |
| 776 | AGX17851 | 27173 | 57677 | 88181, 118685, 149189, 179693, 210197 | 1866 | AHZ36928 | 28263 | 58767 | 89271, 119775, 150279, 180783, 211287 |
| 777 | AGX17862 | 27174 | 57678 | 88182, 118686, 149190, 179694, 210198 | 1867 | AHZ36939 | 28264 | 58768 | 89272, 119776, 150280, 180784, 211288 |
| 778 | AGX17873 | 27175 | 57679 | 88183, 118687, 149191, 179695, 210199 | 1868 | AHZ36950 | 28265 | 58769 | 89273, 119777, 150281, 180785, 211289 |
| 779 | AGX17884 | 27176 | 57680 | 88184, 118688, 149192, 179696, 210200 | 1869 | AHZ36961 | 28266 | 58770 | 89274, 119778, 150282, 180786, 211290 |
| 780 | AGX17895 | 27177 | 57681 | 88185, 118689, 149193, 179697, 210201 | 1870 | AHZ36972 | 28267 | 58771 | 89275, 119779, 150283, 180787, 211291 |
| 781 | AGX17906 | 27178 | 57682 | 88186, 118690, 149194, 179698, 210202 | 1871 | AHZ36983 | 28268 | 58772 | 89276, 119780, 150284, 180788, 211292 |
| 782 | AGX17917 | 27179 | 57683 | 88187, 118691, 149195, 179699, 210203 | 1872 | AHZ37005 | 28269 | 58773 | 89277, 119781, 150285, 180789, 211293 |
| 783 | AGX17928 | 27180 | 57684 | 88188, 118692, 149196, 179700, 210204 | 1873 | AHZ37016 | 28270 | 58774 | 89278, 119782, 150286, 180790, 211294 |
| 784 | AGX17939 | 27181 | 57685 | 88189, 118693, 149197, 179701, 210205 | 1874 | AHZ37027 | 28271 | 58775 | 89279, 119783, 150287, 180791, 211295 |
| 785 | AGX17950 | 27182 | 57686 | 88190, 118694, 149198, 179702, 210206 | 1875 | AHZ37038 | 28272 | 58776 | 89280, 119784, 150288, 180792, 211296 |

FIG. 2 continued

| | | | | | | | | | |
|---|---|---|---|---|---|---|---|---|---|
| 786 | AGX17961 | 27183 | 57687 | 88191, 118695, 149199, 179703, 210207 | 1876 | AHZ37049 | 28273 | 58777 | 89281, 119785, 150289, 180793, 211297 |
| 787 | AGX17972 | 27184 | 57688 | 88192, 118696, 149200, 179704, 210208 | 1877 | AHZ37060 | 28274 | 58778 | 89282, 119786, 150290, 180794, 211298 |
| 788 | AGX17983 | 27185 | 57689 | 88193, 118697, 149201, 179705, 210209 | 1878 | AHZ37071 | 28275 | 58779 | 89283, 119787, 150291, 180795, 211299 |
| 789 | AGX17994 | 27186 | 57690 | 88194, 118698, 149202, 179706, 210210 | 1879 | AHZ37082 | 28276 | 58780 | 89284, 119788, 150292, 180796, 211300 |
| 790 | AGX18005 | 27187 | 57691 | 88195, 118699, 149203, 179707, 210211 | 1880 | AHZ37093 | 28277 | 58781 | 89285, 119789, 150293, 180797, 211301 |
| 791 | AGX18016 | 27188 | 57692 | 88196, 118700, 149204, 179708, 210212 | 1881 | AHZ37104 | 28278 | 58782 | 89286, 119790, 150294, 180798, 211302 |
| 792 | AGX18027 | 27189 | 57693 | 88197, 118701, 149205, 179709, 210213 | 1882 | AHZ41770 | 28279 | 58783 | 89287, 119791, 150295, 180799, 211303 |
| 793 | AGX18038 | 27190 | 57694 | 88198, 118702, 149206, 179710, 210214 | 1883 | AHZ41781 | 28280 | 58784 | 89288, 119792, 150296, 180800, 211304 |
| 794 | AGX18049 | 27191 | 57695 | 88199, 118703, 149207, 179711, 210215 | 1884 | AHZ41792 | 28281 | 58785 | 89289, 119793, 150297, 180801, 211305 |
| 795 | AGX18060 | 27192 | 57696 | 88200, 118704, 149208, 179712, 210216 | 1885 | AHZ41803 | 28282 | 58786 | 89290, 119794, 150298, 180802, 211306 |
| 796 | AGX18071 | 27193 | 57697 | 88201, 118705, 149209, 179713, 210217 | 1886 | AHZ41814 | 28283 | 58787 | 89291, 119795, 150299, 180803, 211307 |
| 797 | AGX18082 | 27194 | 57698 | 88202, 118706, 149210, 179714, 210218 | 1887 | AHZ41825 | 28284 | 58788 | 89292, 119796, 150300, 180804, 211308 |
| 798 | AGX18093 | 27195 | 57699 | 88203, 118707, 149211, 179715, 210219 | 1888 | AHZ41836 | 28285 | 58789 | 89293, 119797, 150301, 180805, 211309 |
| 799 | AGX18104 | 27196 | 57700 | 88204, 118708, 149212, 179716, 210220 | 1889 | AHZ41847 | 28286 | 58790 | 89294, 119798, 150302, 180806, 211310 |
| 800 | AGX18115 | 27197 | 57701 | 88205, 118709, 149213, 179717, 210221 | 1890 | AHZ41858 | 28287 | 58791 | 89295, 119799, 150303, 180807, 211311 |
| 801 | AGX18126 | 27198 | 57702 | 88206, 118710, 149214, 179718, 210222 | 1891 | AHZ41869 | 28288 | 58792 | 89296, 119800, 150304, 180808, 211312 |
| 802 | AGX18137 | 27199 | 57703 | 88207, 118711, 149215, 179719, 210223 | 1892 | AIC73844 | 28289 | 58793 | 89297, 119801, 150305, 180809, 211313 |
| 803 | AGX18148 | 27200 | 57704 | 88208, 118712, 149216, 179720, 210224 | 1893 | AIC73845 | 28290 | 58794 | 89298, 119802, 150306, 180810, 211314 |

FIG. 2 continued

| | | | | | | | | | |
|---|---|---|---|---|---|---|---|---|---|
| 804 | AGX18159 | 27201 | 57705 | 88209, 118713, 149217, 179721, 210225 | 1894 | AIC73846 | 28291 | 58795 | 89299, 119803, 150307, 180811, 211315 |
| 805 | AGX18170 | 27202 | 57706 | 88210, 118714, 149218, 179722, 210226 | 1895 | AIC73847 | 28292 | 58796 | 89300, 119804, 150308, 180812, 211316 |
| 806 | AGX18181 | 27203 | 57707 | 88211, 118715, 149219, 179723, 210227 | 1896 | AIC73848 | 28293 | 58797 | 89301, 119805, 150309, 180813, 211317 |
| 807 | AGX18192 | 27204 | 57708 | 88212, 118716, 149220, 179724, 210228 | 1897 | AIC73849 | 28294 | 58798 | 89302, 119806, 150310, 180814, 211318 |
| 808 | AGX18203 | 27205 | 57709 | 88213, 118717, 149221, 179725, 210229 | 1898 | AIC73850 | 28295 | 58799 | 89303, 119807, 150311, 180815, 211319 |
| 809 | AGX18214 | 27206 | 57710 | 88214, 118718, 149222, 179726, 210230 | 1899 | AIC73851 | 28296 | 58800 | 89304, 119808, 150312, 180816, 211320 |
| 810 | AGX18225 | 27207 | 57711 | 88215, 118719, 149223, 179727, 210231 | 1900 | AIC73852 | 28297 | 58801 | 89305, 119809, 150313, 180817, 211321 |
| 811 | AGX18236 | 27208 | 57712 | 88216, 118720, 149224, 179728, 210232 | 1901 | AIC73853 | 28298 | 58802 | 89306, 119810, 150314, 180818, 211322 |
| 812 | AGX18247 | 27209 | 57713 | 88217, 118721, 149225, 179729, 210233 | 1902 | AIC73855 | 28299 | 58803 | 89307, 119811, 150315, 180819, 211323 |
| 813 | AGX18258 | 27210 | 57714 | 88218, 118722, 149226, 179730, 210234 | 1903 | AIC73856 | 28300 | 58804 | 89308, 119812, 150316, 180820, 211324 |
| 814 | AGX18280 | 27211 | 57715 | 88219, 118723, 149227, 179731, 210235 | 1904 | AIC73857 | 28301 | 58805 | 89309, 119813, 150317, 180821, 211325 |
| 815 | AGX18291 | 27212 | 57716 | 88220, 118724, 149228, 179732, 210236 | 1905 | AIC73859 | 28302 | 58806 | 89310, 119814, 150318, 180822, 211326 |
| 816 | AGX18302 | 27213 | 57717 | 88221, 118725, 149229, 179733, 210237 | 1906 | AIC73860 | 28303 | 58807 | 89311, 119815, 150319, 180823, 211327 |
| 817 | AGX18313 | 27214 | 57718 | 88222, 118726, 149230, 179734, 210238 | 1907 | AIC73861 | 28304 | 58808 | 89312, 119816, 150320, 180824, 211328 |
| 818 | AGX18324 | 27215 | 57719 | 88223, 118727, 149231, 179735, 210239 | 1908 | AIC73862 | 28305 | 58809 | 89313, 119817, 150321, 180825, 211329 |
| 819 | AGX18335 | 27216 | 57720 | 88224, 118728, 149232, 179736, 210240 | 1909 | AIC73863 | 28306 | 58810 | 89314, 119818, 150322, 180826, 211330 |
| 820 | AGX18346 | 27217 | 57721 | 88225, 118729, 149233, 179737, 210241 | 1910 | AIC73864 | 28307 | 58811 | 89315, 119819, 150323, 180827, 211331 |
| 821 | AGX18357 | 27218 | 57722 | 88226, 118730, 149234, 179738, 210242 | 1911 | AIC73865 | 28308 | 58812 | 89316, 119820, 150324, 180828, 211332 |

FIG. 2 continued

| | | | | | | | | | |
|---|---|---|---|---|---|---|---|---|---|
| 822 | AGX18368 | 27219 | 57723 | 88227, 118731, 149235, 179739, 210243 | 1912 | AIC73867 | 28309 | 58813 | 89317, 119821, 150325, 180829, 211333 |
| 823 | AGX18379 | 27220 | 57724 | 88228, 118732, 149236, 179740, 210244 | 1913 | AIC73868 | 28310 | 58814 | 89318, 119822, 150326, 180830, 211334 |
| 824 | AGX18390 | 27221 | 57725 | 88229, 118733, 149237, 179741, 210245 | 1914 | AIC73869 | 28311 | 58815 | 89319, 119823, 150327, 180831, 211335 |
| 825 | AGX18401 | 27222 | 57726 | 88230, 118734, 149238, 179742, 210246 | 1915 | AIC73870 | 28312 | 58816 | 89320, 119824, 150328, 180832, 211336 |
| 826 | AGX18412 | 27223 | 57727 | 88231, 118735, 149239, 179743, 210247 | 1916 | AIC73871 | 28313 | 58817 | 89321, 119825, 150329, 180833, 211337 |
| 827 | AGX18423 | 27224 | 57728 | 88232, 118736, 149240, 179744, 210248 | 1917 | AIC73872 | 28314 | 58818 | 89322, 119826, 150330, 180834, 211338 |
| 828 | AGX18424 | 27225 | 57729 | 88233, 118737, 149241, 179745, 210249 | 1918 | AIC73873 | 28315 | 58819 | 89323, 119827, 150331, 180835, 211339 |
| 829 | AGX18435 | 27226 | 57730 | 88234, 118738, 149242, 179746, 210250 | 1919 | AIC73874 | 28316 | 58820 | 89324, 119828, 150332, 180836, 211340 |
| 830 | AGX18446 | 27227 | 57731 | 88235, 118739, 149243, 179747, 210251 | 1920 | AIC73875 | 28317 | 58821 | 89325, 119829, 150333, 180837, 211341 |
| 831 | AGX18457 | 27228 | 57732 | 88236, 118740, 149244, 179748, 210252 | 1921 | AIC73876 | 28318 | 58822 | 89326, 119830, 150334, 180838, 211342 |
| 832 | AGX18468 | 27229 | 57733 | 88237, 118741, 149245, 179749, 210253 | 1922 | AIC73877 | 28319 | 58823 | 89327, 119831, 150335, 180839, 211343 |
| 833 | AGX18479 | 27230 | 57734 | 88238, 118742, 149246, 179750, 210254 | 1923 | AIC73878 | 28320 | 58824 | 89328, 119832, 150336, 180840, 211344 |
| 834 | AGX18490 | 27231 | 57735 | 88239, 118743, 149247, 179751, 210255 | 1924 | AIC73879 | 28321 | 58825 | 89329, 119833, 150337, 180841, 211345 |
| 835 | AGX18512 | 27232 | 57736 | 88240, 118744, 149248, 179752, 210256 | 1925 | AIC73880 | 28322 | 58826 | 89330, 119834, 150338, 180842, 211346 |
| 836 | AGX18523 | 27233 | 57737 | 88241, 118745, 149249, 179753, 210257 | 1926 | AIC73881 | 28323 | 58827 | 89331, 119835, 150339, 180843, 211347 |
| 837 | AGX18534 | 27234 | 57738 | 88242, 118746, 149250, 179754, 210258 | 1927 | AIC73882 | 28324 | 58828 | 89332, 119836, 150340, 180844, 211348 |
| 838 | AGX18545 | 27235 | 57739 | 88243, 118747, 149251, 179755, 210259 | 1928 | AIC73883 | 28325 | 58829 | 89333, 119837, 150341, 180845, 211349 |
| 839 | AGX18556 | 27236 | 57740 | 88244, 118748, 149252, 179756, 210260 | 1929 | AIC73884 | 28326 | 58830 | 89334, 119838, 150342, 180846, 211350 |

FIG. 2 continued

| | | | | | | | | | |
|---|---|---|---|---|---|---|---|---|---|
| 840 | AGX18567 | 27237 | 57741 | 88245, 118749, 149253, 179757, 210261 | 1930 | AIC73885 | 28327 | 58831 | 89335, 119839, 150343, 180847, 211351 |
| 841 | AGX18578 | 27238 | 57742 | 88246, 118750, 149254, 179758, 210262 | 1931 | AIC73886 | 28328 | 58832 | 89336, 119840, 150344, 180848, 211352 |
| 842 | AGX18589 | 27239 | 57743 | 88247, 118751, 149255, 179759, 210263 | 1932 | AIC73887 | 28329 | 58833 | 89337, 119841, 150345, 180849, 211353 |
| 843 | AGX18600 | 27240 | 57744 | 88248, 118752, 149256, 179760, 210264 | 1933 | AIC73888 | 28330 | 58834 | 89338, 119842, 150346, 180850, 211354 |
| 844 | AGX18611 | 27241 | 57745 | 88249, 118753, 149257, 179761, 210265 | 1934 | AIC73889 | 28331 | 58835 | 89339, 119843, 150347, 180851, 211355 |
| 845 | AGX18622 | 27242 | 57746 | 88250, 118754, 149258, 179762, 210266 | 1935 | AIC73890 | 28332 | 58836 | 89340, 119844, 150348, 180852, 211356 |
| 846 | AGX18633 | 27243 | 57747 | 88251, 118755, 149259, 179763, 210267 | 1936 | AIC73892 | 28333 | 58837 | 89341, 119845, 150349, 180853, 211357 |
| 847 | AGX18644 | 27244 | 57748 | 88252, 118756, 149260, 179764, 210268 | 1937 | AIC73893 | 28334 | 58838 | 89342, 119846, 150350, 180854, 211358 |
| 848 | AGX18655 | 27245 | 57749 | 88253, 118757, 149261, 179765, 210269 | 1938 | AIC73894 | 28335 | 58839 | 89343, 119847, 150351, 180855, 211359 |
| 849 | AGX18666 | 27246 | 57750 | 88254, 118758, 149262, 179766, 210270 | 1939 | AIC73895 | 28336 | 58840 | 89344, 119848, 150352, 180856, 211360 |
| 850 | AGX18677 | 27247 | 57751 | 88255, 118759, 149263, 179767, 210271 | 1940 | AIC73896 | 28337 | 58841 | 89345, 119849, 150353, 180857, 211361 |
| 851 | AGX18688 | 27248 | 57752 | 88256, 118760, 149264, 179768, 210272 | 1941 | AIC73897 | 28338 | 58842 | 89346, 119850, 150354, 180858, 211362 |
| 852 | AGX18699 | 27249 | 57753 | 88257, 118761, 149265, 179769, 210273 | 1942 | AIC73898 | 28339 | 58843 | 89347, 119851, 150355, 180859, 211363 |
| 853 | AGX18710 | 27250 | 57754 | 88258, 118762, 149266, 179770, 210274 | 1943 | AIC73899 | 28340 | 58844 | 89348, 119852, 150356, 180860, 211364 |
| 854 | AGX18721 | 27251 | 57755 | 88259, 118763, 149267, 179771, 210275 | 1944 | AIC73900 | 28341 | 58845 | 89349, 119853, 150357, 180861, 211365 |
| 855 | AGX18732 | 27252 | 57756 | 88260, 118764, 149268, 179772, 210276 | 1945 | AIC73902 | 28342 | 58846 | 89350, 119854, 150358, 180862, 211366 |
| 856 | AGX18743 | 27253 | 57757 | 88261, 118765, 149269, 179773, 210277 | 1946 | AIC73903 | 28343 | 58847 | 89351, 119855, 150359, 180863, 211367 |
| 857 | AGX18754 | 27254 | 57758 | 88262, 118766, 149270, 179774, 210278 | 1947 | AIC73904 | 28344 | 58848 | 89352, 119856, 150360, 180864, 211368 |

FIG. 2 continued

| | | | | | | | | | |
|---|---|---|---|---|---|---|---|---|---|
| 858 | AGX18765 | 27255 | 57759 | 88263, 118767, 149271, 179775, 210279 | 1948 | AIC73905 | 28345 | 58849 | 89353, 119857, 150361, 180865, 211369 |
| 859 | AGX18776 | 27256 | 57760 | 88264, 118768, 149272, 179776, 210280 | 1949 | AIC73906 | 28346 | 58850 | 89354, 119858, 150362, 180866, 211370 |
| 860 | AGX18787 | 27257 | 57761 | 88265, 118769, 149273, 179777, 210281 | 1950 | AIC73907 | 28347 | 58851 | 89355, 119859, 150363, 180867, 211371 |
| 861 | AGX18798 | 27258 | 57762 | 88266, 118770, 149274, 179778, 210282 | 1951 | AIC73908 | 28348 | 58852 | 89356, 119860, 150364, 180868, 211372 |
| 862 | AGX18809 | 27259 | 57763 | 88267, 118771, 149275, 179779, 210283 | 1952 | AIC73909 | 28349 | 58853 | 89357, 119861, 150365, 180869, 211373 |
| 863 | AGX18820 | 27260 | 57764 | 88268, 118772, 149276, 179780, 210284 | 1953 | AIC73910 | 28350 | 58854 | 89358, 119862, 150366, 180870, 211374 |
| 864 | AGX18831 | 27261 | 57765 | 88269, 118773, 149277, 179781, 210285 | 1954 | AIC73911 | 28351 | 58855 | 89359, 119863, 150367, 180871, 211375 |
| 865 | AGX18842 | 27262 | 57766 | 88270, 118774, 149278, 179782, 210286 | 1955 | AIC73912 | 28352 | 58856 | 89360, 119864, 150368, 180872, 211376 |
| 866 | AGX18853 | 27263 | 57767 | 88271, 118775, 149279, 179783, 210287 | 1956 | AIC73913 | 28353 | 58857 | 89361, 119865, 150369, 180873, 211377 |
| 867 | AGX18864 | 27264 | 57768 | 88272, 118776, 149280, 179784, 210288 | 1957 | AIC73914 | 28354 | 58858 | 89362, 119866, 150370, 180874, 211378 |
| 868 | AGX18875 | 27265 | 57769 | 88273, 118777, 149281, 179785, 210289 | 1958 | AIC73915 | 28355 | 58859 | 89363, 119867, 150371, 180875, 211379 |
| 869 | AGX18886 | 27266 | 57770 | 88274, 118778, 149282, 179786, 210290 | 1959 | AIC73916 | 28356 | 58860 | 89364, 119868, 150372, 180876, 211380 |
| 870 | AGX18897 | 27267 | 57771 | 88275, 118779, 149283, 179787, 210291 | 1960 | AIC73917 | 28357 | 58861 | 89365, 119869, 150373, 180877, 211381 |
| 871 | AGX18908 | 27268 | 57772 | 88276, 118780, 149284, 179788, 210292 | 1961 | AIC73918 | 28358 | 58862 | 89366, 119870, 150374, 180878, 211382 |
| 872 | AGX18919 | 27269 | 57773 | 88277, 118781, 149285, 179789, 210293 | 1962 | AIC73919 | 28359 | 58863 | 89367, 119871, 150375, 180879, 211383 |
| 873 | AGX18930 | 27270 | 57774 | 88278, 118782, 149286, 179790, 210294 | 1963 | AIC73920 | 28360 | 58864 | 89368, 119872, 150376, 180880, 211384 |
| 874 | AGX18941 | 27271 | 57775 | 88279, 118783, 149287, 179791, 210295 | 1964 | AIC73921 | 28361 | 58865 | 89369, 119873, 150377, 180881, 211385 |
| 875 | AGX18952 | 27272 | 57776 | 88280, 118784, 149288, 179792, 210296 | 1965 | AIC73922 | 28362 | 58866 | 89370, 119874, 150378, 180882, 211386 |

FIG. 2 continued

| | | | | | | | | | |
|---|---|---|---|---|---|---|---|---|---|
| 876 | AGX18963 | 27273 | 57777 | 88281, 118785, 149289, 179793, 210297 | 1966 | AIC73924 | 28363 | 58867 | 89371, 119875, 150379, 180883, 211387 |
| 877 | AGX18974 | 27274 | 57778 | 88282, 118786, 149290, 179794, 210298 | 1967 | AIC73925 | 28364 | 58868 | 89372, 119876, 150380, 180884, 211388 |
| 878 | AGX18985 | 27275 | 57779 | 88283, 118787, 149291, 179795, 210299 | 1968 | AIC73926 | 28365 | 58869 | 89373, 119877, 150381, 180885, 211389 |
| 879 | AGX18996 | 27276 | 57780 | 88284, 118788, 149292, 179796, 210300 | 1969 | AIL94977 | 28366 | 58870 | 89374, 119878, 150382, 180886, 211390 |
| 880 | AGX19007 | 27277 | 57781 | 88285, 118789, 149293, 179797, 210301 | 1970 | AIL94988 | 28367 | 58871 | 89375, 119879, 150383, 180887, 211391 |
| 881 | AGX19018 | 27278 | 57782 | 88286, 118790, 149294, 179798, 210302 | 1971 | AIL94999 | 28368 | 58872 | 89376, 119880, 150384, 180888, 211392 |
| 882 | AGX19029 | 27279 | 57783 | 88287, 118791, 149295, 179799, 210303 | 1972 | AIL95010 | 28369 | 58873 | 89377, 119881, 150385, 180889, 211393 |
| 883 | AGX19040 | 27280 | 57784 | 88288, 118792, 149296, 179800, 210304 | 1973 | AIL95021 | 28370 | 58874 | 89378, 119882, 150386, 180890, 211394 |
| 884 | AGX19051 | 27281 | 57785 | 88289, 118793, 149297, 179801, 210305 | 1974 | AIL95032 | 28371 | 58875 | 89379, 119883, 150387, 180891, 211395 |
| 885 | AGX19062 | 27282 | 57786 | 88290, 118794, 149298, 179802, 210306 | 1975 | AIL95043 | 28372 | 58876 | 89380, 119884, 150388, 180892, 211396 |
| 886 | AGX19073 | 27283 | 57787 | 88291, 118795, 149299, 179803, 210307 | 1976 | AIL95054 | 28373 | 58877 | 89381, 119885, 150389, 180893, 211397 |
| 887 | AGX19084 | 27284 | 57788 | 88292, 118796, 149300, 179804, 210308 | 1977 | AIL95065 | 28374 | 58878 | 89382, 119886, 150390, 180894, 211398 |
| 888 | AGX19095 | 27285 | 57789 | 88293, 118797, 149301, 179805, 210309 | 1978 | AIL95076 | 28375 | 58879 | 89383, 119887, 150391, 180895, 211399 |
| 889 | AGX19106 | 27286 | 57790 | 88294, 118798, 149302, 179806, 210310 | 1979 | AIL95087 | 28376 | 58880 | 89384, 119888, 150392, 180896, 211400 |
| 890 | AGX19117 | 27287 | 57791 | 88295, 118799, 149303, 179807, 210311 | 1980 | AIL95098 | 28377 | 58881 | 89385, 119889, 150393, 180897, 211401 |
| 891 | AGX19128 | 27288 | 57792 | 88296, 118800, 149304, 179808, 210312 | 1981 | AIL95109 | 28378 | 58882 | 89386, 119890, 150394, 180898, 211402 |
| 892 | AGX19139 | 27289 | 57793 | 88297, 118801, 149305, 179809, 210313 | 1982 | AIL95120 | 28379 | 58883 | 89387, 119891, 150395, 180899, 211403 |
| 893 | AGX19150 | 27290 | 57794 | 88298, 118802, 149306, 179810, 210314 | 1983 | AKA54644 | 28380 | 58884 | 89388, 119892, 150396, 180900, 211404 |

FIG. 2 continued

| | | | | | | | | | |
|---|---|---|---|---|---|---|---|---|---|
| 894 | AGX19161 | 27291 | 57795 | 88299, 118803, 149307, 179811, 210315 | 1984 | AKA54645 | 28381 | 58885 | 89389, 119893, 150397, 180901, 211405 |
| 895 | AGX19172 | 27292 | 57796 | 88300, 118804, 149308, 179812, 210316 | 1985 | AKA54646 | 28382 | 58886 | 89390, 119894, 150398, 180902, 211406 |
| 896 | AGX19183 | 27293 | 57797 | 88301, 118805, 149309, 179813, 210317 | 1986 | AKA54647 | 28383 | 58887 | 89391, 119895, 150399, 180903, 211407 |
| 897 | AGX19194 | 27294 | 57798 | 88302, 118806, 149310, 179814, 210318 | 1987 | AKA54648 | 28384 | 58888 | 89392, 119896, 150400, 180904, 211408 |
| 898 | AGX19205 | 27295 | 57799 | 88303, 118807, 149311, 179815, 210319 | 1988 | AKA54649 | 28385 | 58889 | 89393, 119897, 150401, 180905, 211409 |
| 899 | AGX19216 | 27296 | 57800 | 88304, 118808, 149312, 179816, 210320 | 1989 | AKU40581 | 28386 | 58890 | 89394, 119898, 150402, 180906, 211410 |
| 900 | AGX19227 | 27297 | 57801 | 88305, 118809, 149313, 179817, 210321 | 1990 | AKU40592 | 28387 | 58891 | 89395, 119899, 150403, 180907, 211411 |
| 901 | AGX19238 | 27298 | 57802 | 88306, 118810, 149314, 179818, 210322 | 1991 | AKU40603 | 28388 | 58892 | 89396, 119900, 150404, 180908, 211412 |
| 902 | AGX19249 | 27299 | 57803 | 88307, 118811, 149315, 179819, 210323 | 1992 | AKU40614 | 28389 | 58893 | 89397, 119901, 150405, 180909, 211413 |
| 903 | AGX19260 | 27300 | 57804 | 88308, 118812, 149316, 179820, 210324 | 1993 | AKU40625 | 28390 | 58894 | 89398, 119902, 150406, 180910, 211414 |
| 904 | AGX19271 | 27301 | 57805 | 88309, 118813, 149317, 179821, 210325 | 1994 | AKU40636 | 28391 | 58895 | 89399, 119903, 150407, 180911, 211415 |
| 905 | AGX19282 | 27302 | 57806 | 88310, 118814, 149318, 179822, 210326 | 1995 | AKU40647 | 28392 | 58896 | 89400, 119904, 150408, 180912, 211416 |
| 906 | AGX19304 | 27303 | 57807 | 88311, 118815, 149319, 179823, 210327 | 1996 | AKU40658 | 28393 | 58897 | 89401, 119905, 150409, 180913, 211417 |
| 907 | AGX19315 | 27304 | 57808 | 88312, 118816, 149320, 179824, 210328 | 1997 | AKU40669 | 28394 | 58898 | 89402, 119906, 150410, 180914, 211418 |
| 908 | AGX19326 | 27305 | 57809 | 88313, 118817, 149321, 179825, 210329 | 1998 | AKU40680 | 28395 | 58899 | 89403, 119907, 150411, 180915, 211419 |
| 909 | AGX19337 | 27306 | 57810 | 88314, 118818, 149322, 179826, 210330 | 1999 | AKU40691 | 28396 | 58900 | 89404, 119908, 150412, 180916, 211420 |
| 910 | AGX19348 | 27307 | 57811 | 88315, 118819, 149323, 179827, 210331 | 2000 | AKU40702 | 28397 | 58901 | 89405, 119909, 150413, 180917, 211421 |
| 911 | AGX19359 | 27308 | 57812 | 88316, 118820, 149324, 179828, 210332 | 2001 | AKU40713 | 28398 | 58902 | 89406, 119910, 150414, 180918, 211422 |

FIG. 2 continued

| | | | | | | | | | |
|---|---|---|---|---|---|---|---|---|---|
| 912 | AGX19370 | 27309 | 57813 | 88317, 118821, 149325, 179829, 210333 | 2002 | AKU40724 | 28399 | 58903 | 89407, 119911, 150415, 180919, 211423 |
| 913 | AGX19381 | 27310 | 57814 | 88318, 118822, 149326, 179830, 210334 | 2003 | AKU40735 | 28400 | 58904 | 89408, 119912, 150416, 180920, 211424 |
| 914 | AGX19392 | 27311 | 57815 | 88319, 118823, 149327, 179831, 210335 | 2004 | AKU40746 | 28401 | 58905 | 89409, 119913, 150417, 180921, 211425 |
| 915 | AGX19403 | 27312 | 57816 | 88320, 118824, 149328, 179832, 210336 | 2005 | AKU40757 | 28402 | 58906 | 89410, 119914, 150418, 180922, 211426 |
| 916 | AGX19414 | 27313 | 57817 | 88321, 118825, 149329, 179833, 210337 | 2006 | AKU40768 | 28403 | 58907 | 89411, 119915, 150419, 180923, 211427 |
| 917 | AGX19425 | 27314 | 57818 | 88322, 118826, 149330, 179834, 210338 | 2007 | AKU40779 | 28404 | 58908 | 89412, 119916, 150420, 180924, 211428 |
| 918 | AGX19436 | 27315 | 57819 | 88323, 118827, 149331, 179835, 210339 | 2008 | AKU40790 | 28405 | 58909 | 89413, 119917, 150421, 180925, 211429 |
| 919 | AGX19447 | 27316 | 57820 | 88324, 118828, 149332, 179836, 210340 | 2009 | AKU40801 | 28406 | 58910 | 89414, 119918, 150422, 180926, 211430 |
| 920 | AGX19458 | 27317 | 57821 | 88325, 118829, 149333, 179837, 210341 | 2010 | AKU40812 | 28407 | 58911 | 89415, 119919, 150423, 180927, 211431 |
| 921 | AGX19469 | 27318 | 57822 | 88326, 118830, 149334, 179838, 210342 | 2011 | AKU40823 | 28408 | 58912 | 89416, 119920, 150424, 180928, 211432 |
| 922 | AGX19480 | 27319 | 57823 | 88327, 118831, 149335, 179839, 210343 | 2012 | AKU40834 | 28409 | 58913 | 89417, 119921, 150425, 180929, 211433 |
| 923 | AGX19491 | 27320 | 57824 | 88328, 118832, 149336, 179840, 210344 | 2013 | AKU40845 | 28410 | 58914 | 89418, 119922, 150426, 180930, 211434 |
| 924 | AGX19502 | 27321 | 57825 | 88329, 118833, 149337, 179841, 210345 | 2014 | AKU40856 | 28411 | 58915 | 89419, 119923, 150427, 180931, 211435 |
| 925 | AGX19513 | 27322 | 57826 | 88330, 118834, 149338, 179842, 210346 | 2015 | AKU40867 | 28412 | 58916 | 89420, 119924, 150428, 180932, 211436 |
| 926 | AGX19524 | 27323 | 57827 | 88331, 118835, 149339, 179843, 210347 | 2016 | AKU40878 | 28413 | 58917 | 89421, 119925, 150429, 180933, 211437 |
| 927 | AGX19535 | 27324 | 57828 | 88332, 118836, 149340, 179844, 210348 | 2017 | AKU40889 | 28414 | 58918 | 89422, 119926, 150430, 180934, 211438 |
| 928 | AGX19546 | 27325 | 57829 | 88333, 118837, 149341, 179845, 210349 | 2018 | AKU40900 | 28415 | 58919 | 89423, 119927, 150431, 180935, 211439 |
| 929 | AGX19557 | 27326 | 57830 | 88334, 118838, 149342, 179846, 210350 | 2019 | AKU40911 | 28416 | 58920 | 89424, 119928, 150432, 180936, 211440 |

FIG. 2 continued

| | | | | | | | | | |
|---|---|---|---|---|---|---|---|---|---|
| 930 | AGX19568 | 27327 | 57831 | 88335, 118839, 149343, 179847, 210351 | 2020 | AKU40922 | 28417 | 58921 | 89425, 119929, 150433, 180937, 211441 |
| 931 | AGX19579 | 27328 | 57832 | 88336, 118840, 149344, 179848, 210352 | 2021 | AKU40933 | 28418 | 58922 | 89426, 119930, 150434, 180938, 211442 |
| 932 | AGX19590 | 27329 | 57833 | 88337, 118841, 149345, 179849, 210353 | 2022 | AKU40944 | 28419 | 58923 | 89427, 119931, 150435, 180939, 211443 |
| 933 | AGX19601 | 27330 | 57834 | 88338, 118842, 149346, 179850, 210354 | 2023 | AKU40955 | 28420 | 58924 | 89428, 119932, 150436, 180940, 211444 |
| 934 | AGX19612 | 27331 | 57835 | 88339, 118843, 149347, 179851, 210355 | 2024 | AKU40966 | 28421 | 58925 | 89429, 119933, 150437, 180941, 211445 |
| 935 | AGX19623 | 27332 | 57836 | 88340, 118844, 149348, 179852, 210356 | 2025 | AKU40977 | 28422 | 58926 | 89430, 119934, 150438, 180942, 211446 |
| 936 | AGX19634 | 27333 | 57837 | 88341, 118845, 149349, 179853, 210357 | 2026 | AKU40987 | 28423 | 58927 | 89431, 119935, 150439, 180943, 211447 |
| 937 | AGX19645 | 27334 | 57838 | 88342, 118846, 149350, 179854, 210358 | 2027 | AKU40998 | 28424 | 58928 | 89432, 119936, 150440, 180944, 211448 |
| 938 | AGX19656 | 27335 | 57839 | 88343, 118847, 149351, 179855, 210359 | 2028 | AKU41009 | 28425 | 58929 | 89433, 119937, 150441, 180945, 211449 |
| 939 | AGX19667 | 27336 | 57840 | 88344, 118848, 149352, 179856, 210360 | 2029 | AKU41020 | 28426 | 58930 | 89434, 119938, 150442, 180946, 211450 |
| 940 | AGX19678 | 27337 | 57841 | 88345, 118849, 149353, 179857, 210361 | 2030 | ALA08485 | 28427 | 58931 | 89435, 119939, 150443, 180947, 211451 |
| 941 | AGX19700 | 27338 | 57842 | 88346, 118850, 149354, 179858, 210362 | 2031 | ALA08486 | 28428 | 58932 | 89436, 119940, 150444, 180948, 211452 |
| 942 | AGX19711 | 27339 | 57843 | 88347, 118851, 149355, 179859, 210363 | 2032 | ALA08487 | 28429 | 58933 | 89437, 119941, 150445, 180949, 211453 |
| 943 | AGX19722 | 27340 | 57844 | 88348, 118852, 149356, 179860, 210364 | 2033 | ALA08564 | 28430 | 58934 | 89438, 119942, 150446, 180950, 211454 |
| 944 | AGX19733 | 27341 | 57845 | 88349, 118853, 149357, 179861, 210365 | 2034 | ALA08565 | 28431 | 58935 | 89439, 119943, 150447, 180951, 211455 |
| 945 | AGX19744 | 27342 | 57846 | 88350, 118854, 149358, 179862, 210366 | 2035 | ALA08566 | 28432 | 58936 | 89440, 119944, 150448, 180952, 211456 |
| 946 | AGX19755 | 27343 | 57847 | 88351, 118855, 149359, 179863, 210367 | 2036 | ALA08567 | 28433 | 58937 | 89441, 119945, 150449, 180953, 211457 |
| 947 | AGX19766 | 27344 | 57848 | 88352, 118856, 149360, 179864, 210368 | 2037 | ALA08568 | 28434 | 58938 | 89442, 119946, 150450, 180954, 211458 |

FIG. 2 continued

| | | | | | | | | | |
|---|---|---|---|---|---|---|---|---|---|
| 948 | AGX19788 | 27345 | 57849 | 88353, 118857, 149361, 179865, 210369 | 2038 | ALA08569 | 28435 | 58939 | 89443, 119947, 150451, 180955, 211459 |
| 949 | AGX19799 | 27346 | 57850 | 88354, 118858, 149362, 179866, 210370 | 2039 | ALA08689 | 28436 | 58940 | 89444, 119948, 150452, 180956, 211460 |
| 950 | AGX19810 | 27347 | 57851 | 88355, 118859, 149363, 179867, 210371 | 2040 | ALA08690 | 28437 | 58941 | 89445, 119949, 150453, 180957, 211461 |
| 951 | AGX19821 | 27348 | 57852 | 88356, 118860, 149364, 179868, 210372 | 2041 | ALE31766 | 28438 | 58942 | 89446, 119950, 150454, 180958, 211462 |
| 952 | AGX19832 | 27349 | 57853 | 88357, 118861, 149365, 179869, 210373 | 2042 | ALE31768 | 28439 | 58943 | 89447, 119951, 150455, 180959, 211463 |
| 953 | AGX19843 | 27350 | 57854 | 88358, 118862, 149366, 179870, 210374 | 2043 | ALE31770 | 28440 | 58944 | 89448, 119952, 150456, 180960, 211464 |
| 954 | AGX19854 | 27351 | 57855 | 88359, 118863, 149367, 179871, 210375 | 2044 | ALE31772 | 28441 | 58945 | 89449, 119953, 150457, 180961, 211465 |
| 955 | AGX19865 | 27352 | 57856 | 88360, 118864, 149368, 179872, 210376 | 2045 | ALE31773 | 28442 | 58946 | 89450, 119954, 150458, 180962, 211466 |
| 956 | AGX19876 | 27353 | 57857 | 88361, 118865, 149369, 179873, 210377 | 2046 | ALE31884 | 28443 | 58947 | 89451, 119955, 150459, 180963, 211467 |
| 957 | AGX19887 | 27354 | 57858 | 88362, 118866, 149370, 179874, 210378 | 2047 | ALE31885 | 28444 | 58948 | 89452, 119956, 150460, 180964, 211468 |
| 958 | AGX19898 | 27355 | 57859 | 88363, 118867, 149371, 179875, 210379 | 2048 | ALE31886 | 28445 | 58949 | 89453, 119957, 150461, 180965, 211469 |
| 959 | AGX19909 | 27356 | 57860 | 88364, 118868, 149372, 179876, 210380 | 2049 | ALE31887 | 28446 | 58950 | 89454, 119958, 150462, 180966, 211470 |
| 960 | AGX19920 | 27357 | 57861 | 88365, 118869, 149373, 179877, 210381 | 2050 | ALE31982 | 28447 | 58951 | 89455, 119959, 150463, 180967, 211471 |
| 961 | AGX19931 | 27358 | 57862 | 88366, 118870, 149374, 179878, 210382 | 2051 | ALE31983 | 28448 | 58952 | 89456, 119960, 150464, 180968, 211472 |
| 962 | AGX19942 | 27359 | 57863 | 88367, 118871, 149375, 179879, 210383 | 2052 | ALE31984 | 28449 | 58953 | 89457, 119961, 150465, 180969, 211473 |
| 963 | AGX19953 | 27360 | 57864 | 88368, 118872, 149376, 179880, 210384 | 2053 | ALE31985 | 28450 | 58954 | 89458, 119962, 150466, 180970, 211474 |
| 964 | AGX19964 | 27361 | 57865 | 88369, 118873, 149377, 179881, 210385 | 2054 | ALE31986 | 28451 | 58955 | 89459, 119963, 150467, 180971, 211475 |
| 965 | AGX19975 | 27362 | 57866 | 88370, 118874, 149378, 179882, 210386 | 2055 | ALE31988 | 28452 | 58956 | 89460, 119964, 150468, 180972, 211476 |

FIG. 2 continued

| | | | | | | | | | |
|---|---|---|---|---|---|---|---|---|---|
| 966 | AGX19986 | 27363 | 57867 | 88371, 118875, 149379, 179883, 210387 | 2056 | ALE31989 | 28453 | 58957 | 89461, 119965, 150469, 180973, 211477 |
| 967 | AGX19997 | 27364 | 57868 | 88372, 118876, 149380, 179884, 210388 | 2057 | ALE31990 | 28454 | 58958 | 89462, 119966, 150470, 180974, 211478 |
| 968 | AGX20008 | 27365 | 57869 | 88373, 118877, 149381, 179885, 210389 | 2058 | ALE31991 | 28455 | 58959 | 89463, 119967, 150471, 180975, 211479 |
| 969 | AGX20019 | 27366 | 57870 | 88374, 118878, 149382, 179886, 210390 | 2059 | ALE31992 | 28456 | 58960 | 89464, 119968, 150472, 180976, 211480 |
| 970 | AGX20030 | 27367 | 57871 | 88375, 118879, 149383, 179887, 210391 | 2060 | ALE31993 | 28457 | 58961 | 89465, 119969, 150473, 180977, 211481 |
| 971 | AGX20041 | 27368 | 57872 | 88376, 118880, 149384, 179888, 210392 | 2061 | ALE31994 | 28458 | 58962 | 89466, 119970, 150474, 180978, 211482 |
| 972 | AGX20052 | 27369 | 57873 | 88377, 118881, 149385, 179889, 210393 | 2062 | ALN39719 | 28459 | 58963 | 89467, 119971, 150475, 180979, 211483 |
| 973 | AGX20063 | 27370 | 57874 | 88378, 118882, 149386, 179890, 210394 | 2063 | ALN39720 | 28460 | 58964 | 89468, 119972, 150476, 180980, 211484 |
| 974 | AGX20074 | 27371 | 57875 | 88379, 118883, 149387, 179891, 210395 | 2064 | ALN39721 | 28461 | 58965 | 89469, 119973, 150477, 180981, 211485 |
| 975 | AGX20085 | 27372 | 57876 | 88380, 118884, 149388, 179892, 210396 | 2065 | ALN39723 | 28462 | 58966 | 89470, 119974, 150478, 180982, 211486 |
| 976 | AGX20096 | 27373 | 57877 | 88381, 118885, 149389, 179893, 210397 | 2066 | ALN39724 | 28463 | 58967 | 89471, 119975, 150479, 180983, 211487 |
| 977 | AGX20107 | 27374 | 57878 | 88382, 118886, 149390, 179894, 210398 | 2067 | ALN39725 | 28464 | 58968 | 89472, 119976, 150480, 180984, 211488 |
| 978 | AGX20118 | 27375 | 57879 | 88383, 118887, 149391, 179895, 210399 | 2068 | ALN39726 | 28465 | 58969 | 89473, 119977, 150481, 180985, 211489 |
| 979 | AGX20129 | 27376 | 57880 | 88384, 118888, 149392, 179896, 210400 | 2069 | ALN39727 | 28466 | 58970 | 89474, 119978, 150482, 180986, 211490 |
| 980 | AGX20140 | 27377 | 57881 | 88385, 118889, 149393, 179897, 210401 | 2070 | ALN39728 | 28467 | 58971 | 89475, 119979, 150483, 180987, 211491 |
| 981 | AGX20151 | 27378 | 57882 | 88386, 118890, 149394, 179898, 210402 | 2071 | ALN39729 | 28468 | 58972 | 89476, 119980, 150484, 180988, 211492 |
| 982 | AGX20162 | 27379 | 57883 | 88387, 118891, 149395, 179899, 210403 | 2072 | ALN39730 | 28469 | 58973 | 89477, 119981, 150485, 180989, 211493 |
| 983 | AGX20173 | 27380 | 57884 | 88388, 118892, 149396, 179900, 210404 | 2073 | ALN39732 | 28470 | 58974 | 89478, 119982, 150486, 180990, 211494 |

FIG. 2 continued

| | | | | | | | | | |
|---|---|---|---|---|---|---|---|---|---|
| 984 | AGX20184 | 27381 | 57885 | 88389, 118893, 149397, 179901, 210405 | 2074 | ALN39733 | 28471 | 58975 | 89479, 119983, 150487, 180991, 211495 |
| 985 | AGX20195 | 27382 | 57886 | 88390, 118894, 149398, 179902, 210406 | 2075 | ALN39751 | 28472 | 58976 | 89480, 119984, 150488, 180992, 211496 |
| 986 | AGX20206 | 27383 | 57887 | 88391, 118895, 149399, 179903, 210407 | 2076 | ALN39752 | 28473 | 58977 | 89481, 119985, 150489, 180993, 211497 |
| 987 | AGX20217 | 27384 | 57888 | 88392, 118896, 149400, 179904, 210408 | 2077 | ALN39753 | 28474 | 58978 | 89482, 119986, 150490, 180994, 211498 |
| 988 | AGX20228 | 27385 | 57889 | 88393, 118897, 149401, 179905, 210409 | 2078 | ALN39754 | 28475 | 58979 | 89483, 119987, 150491, 180995, 211499 |
| 989 | AGX20239 | 27386 | 57890 | 88394, 118898, 149402, 179906, 210410 | 2079 | ALN39755 | 28476 | 58980 | 89484, 119988, 150492, 180996, 211500 |
| 990 | AGX20250 | 27387 | 57891 | 88395, 118899, 149403, 179907, 210411 | 2080 | ALN39756 | 28477 | 58981 | 89485, 119989, 150493, 180997, 211501 |
| 991 | AGX20261 | 27388 | 57892 | 88396, 118900, 149404, 179908, 210412 | 2081 | ALN39757 | 28478 | 58982 | 89486, 119990, 150494, 180998, 211502 |
| 992 | AGX20272 | 27389 | 57893 | 88397, 118901, 149405, 179909, 210413 | 2082 | ALN39758 | 28479 | 58983 | 89487, 119991, 150495, 180999, 211503 |
| 993 | AGX20283 | 27390 | 57894 | 88398, 118902, 149406, 179910, 210414 | 2083 | ALN39759 | 28480 | 58984 | 89488, 119992, 150496, 181000, 211504 |
| 994 | AGX20294 | 27391 | 57895 | 88399, 118903, 149407, 179911, 210415 | 2084 | ALN39760 | 28481 | 58985 | 89489, 119993, 150497, 181001, 211505 |
| 995 | AGX20305 | 27392 | 57896 | 88400, 118904, 149408, 179912, 210416 | 2085 | ALN39761 | 28482 | 58986 | 89490, 119994, 150498, 181002, 211506 |
| 996 | AGX20316 | 27393 | 57897 | 88401, 118905, 149409, 179913, 210417 | 2086 | ALN39762 | 28483 | 58987 | 89491, 119995, 150499, 181003, 211507 |
| 997 | AGX20327 | 27394 | 57898 | 88402, 118906, 149410, 179914, 210418 | 2087 | ALN39763 | 28484 | 58988 | 89492, 119996, 150500, 181004, 211508 |
| 998 | AGX20338 | 27395 | 57899 | 88403, 118907, 149411, 179915, 210419 | 2088 | ALN39764 | 28485 | 58989 | 89493, 119997, 150501, 181005, 211509 |
| 999 | AGX20349 | 27396 | 57900 | 88404, 118908, 149412, 179916, 210420 | 2089 | ALN39765 | 28486 | 58990 | 89494, 119998, 150502, 181006, 211510 |
| 1000 | AGX20360 | 27397 | 57901 | 88405, 118909, 149413, 179917, 210421 | 2090 | ALN39766 | 28487 | 58991 | 89495, 119999, 150503, 181007, 211511 |
| 1001 | AGX20371 | 27398 | 57902 | 88406, 118910, 149414, 179918, 210422 | 2091 | ALN39767 | 28488 | 58992 | 89496, 120000, 150504, 181008, 211512 |

FIG. 2 continued

| | | | | | | | | | |
|---|---|---|---|---|---|---|---|---|---|
| 1002 | AGX20382 | 27399 | 57903 | 88407, 118911, 149415, 179919, 210423 | 2092 | ALN39768 | 28489 | 58993 | 89497, 120001, 150505, 181009, 211513 |
| 1003 | AGX20393 | 27400 | 57904 | 88408, 118912, 149416, 179920, 210424 | 2093 | ALN39769 | 28490 | 58994 | 89498, 120002, 150506, 181010, 211514 |
| 1004 | AGX20404 | 27401 | 57905 | 88409, 118913, 149417, 179921, 210425 | 2094 | ALN39770 | 28491 | 58995 | 89499, 120003, 150507, 181011, 211515 |
| 1005 | AGX20415 | 27402 | 57906 | 88410, 118914, 149418, 179922, 210426 | 2095 | ALN39771 | 28492 | 58996 | 89500, 120004, 150508, 181012, 211516 |
| 1006 | AGX20426 | 27403 | 57907 | 88411, 118915, 149419, 179923, 210427 | 2096 | ALN39773 | 28493 | 58997 | 89501, 120005, 150509, 181013, 211517 |
| 1007 | AGX20437 | 27404 | 57908 | 88412, 118916, 149420, 179924, 210428 | 2097 | ALN39774 | 28494 | 58998 | 89502, 120006, 150510, 181014, 211518 |
| 1008 | AGX20448 | 27405 | 57909 | 88413, 118917, 149421, 179925, 210429 | 2098 | ALN39775 | 28495 | 58999 | 89503, 120007, 150511, 181015, 211519 |
| 1009 | AGX20459 | 27406 | 57910 | 88414, 118918, 149422, 179926, 210430 | 2099 | ALN39776 | 28496 | 59000 | 89504, 120008, 150512, 181016, 211520 |
| 1010 | AGX20470 | 27407 | 57911 | 88415, 118919, 149423, 179927, 210431 | 2100 | ALN39778 | 28497 | 59001 | 89505, 120009, 150513, 181017, 211521 |
| 1011 | AGX20481 | 27408 | 57912 | 88416, 118920, 149424, 179928, 210432 | 2101 | ALN39779 | 28498 | 59002 | 89506, 120010, 150514, 181018, 211522 |
| 1012 | AGX20492 | 27409 | 57913 | 88417, 118921, 149425, 179929, 210433 | 2102 | ALN39780 | 28499 | 59003 | 89507, 120011, 150515, 181019, 211523 |
| 1013 | AGX20503 | 27410 | 57914 | 88418, 118922, 149426, 179930, 210434 | 2103 | ALN39781 | 28500 | 59004 | 89508, 120012, 150516, 181020, 211524 |
| 1014 | AGX20514 | 27411 | 57915 | 88419, 118923, 149427, 179931, 210435 | 2104 | ALN39782 | 28501 | 59005 | 89509, 120013, 150517, 181021, 211525 |
| 1015 | AGX20525 | 27412 | 57916 | 88420, 118924, 149428, 179932, 210436 | 2105 | ALN39783 | 28502 | 59006 | 89510, 120014, 150518, 181022, 211526 |
| 1016 | AGX20536 | 27413 | 57917 | 88421, 118925, 149429, 179933, 210437 | 2106 | ALN39784 | 28503 | 59007 | 89511, 120015, 150519, 181023, 211527 |
| 1017 | AGX20547 | 27414 | 57918 | 88422, 118926, 149430, 179934, 210438 | 2107 | ALN39785 | 28504 | 59008 | 89512, 120016, 150520, 181024, 211528 |
| 1018 | AGX20558 | 27415 | 57919 | 88423, 118927, 149431, 179935, 210439 | 2108 | ALN39786 | 28505 | 59009 | 89513, 120017, 150521, 181025, 211529 |
| 1019 | AGX20569 | 27416 | 57920 | 88424, 118928, 149432, 179936, 210440 | 2109 | ALN39787 | 28506 | 59010 | 89514, 120018, 150522, 181026, 211530 |

FIG. 2 continued

| | | | | | | | | | |
|---|---|---|---|---|---|---|---|---|---|
| 1020 | AGX20580 | 27417 | 57921 | 88425, 118929, 149433, 179937, 210441 | 2110 | ALN39788 | 28507 | 59011 | 89515, 120019, 150523, 181027, 211531 |
| 1021 | AGX20591 | 27418 | 57922 | 88426, 118930, 149434, 179938, 210442 | 2111 | ALN39790 | 28508 | 59012 | 89516, 120020, 150524, 181028, 211532 |
| 1022 | AGX20602 | 27419 | 57923 | 88427, 118931, 149435, 179939, 210443 | 2112 | ALN39791 | 28509 | 59013 | 89517, 120021, 150525, 181029, 211533 |
| 1023 | AGX20613 | 27420 | 57924 | 88428, 118932, 149436, 179940, 210444 | 2113 | ALN39792 | 28510 | 59014 | 89518, 120022, 150526, 181030, 211534 |
| 1024 | AGX20624 | 27421 | 57925 | 88429, 118933, 149437, 179941, 210445 | 2114 | ALN39793 | 28511 | 59015 | 89519, 120023, 150527, 181031, 211535 |
| 1025 | AGX20635 | 27422 | 57926 | 88430, 118934, 149438, 179942, 210446 | 2115 | ALN39794 | 28512 | 59016 | 89520, 120024, 150528, 181032, 211536 |
| 1026 | AGX20646 | 27423 | 57927 | 88431, 118935, 149439, 179943, 210447 | 2116 | ALN39795 | 28513 | 59017 | 89521, 120025, 150529, 181033, 211537 |
| 1027 | AGX20668 | 27424 | 57928 | 88432, 118936, 149440, 179944, 210448 | 2117 | ALN39796 | 28514 | 59018 | 89522, 120026, 150530, 181034, 211538 |
| 1028 | AGX20679 | 27425 | 57929 | 88433, 118937, 149441, 179945, 210449 | 2118 | ALN39797 | 28515 | 59019 | 89523, 120027, 150531, 181035, 211539 |
| 1029 | AGX20690 | 27426 | 57930 | 88434, 118938, 149442, 179946, 210450 | 2119 | ALN39798 | 28516 | 59020 | 89524, 120028, 150532, 181036, 211540 |
| 1030 | AGX20701 | 27427 | 57931 | 88435, 118939, 149443, 179947, 210451 | 2120 | ALN39799 | 28517 | 59021 | 89525, 120029, 150533, 181037, 211541 |
| 1031 | AGX20712 | 27428 | 57932 | 88436, 118940, 149444, 179948, 210452 | 2121 | ALN39800 | 28518 | 59022 | 89526, 120030, 150534, 181038, 211542 |
| 1032 | AGX20723 | 27429 | 57933 | 88437, 118941, 149445, 179949, 210453 | 2122 | ALN39801 | 28519 | 59023 | 89527, 120031, 150535, 181039, 211543 |
| 1033 | AGX20734 | 27430 | 57934 | 88438, 118942, 149446, 179950, 210454 | 2123 | ALN39802 | 28520 | 59024 | 89528, 120032, 150536, 181040, 211544 |
| 1034 | AGX20745 | 27431 | 57935 | 88439, 118943, 149447, 179951, 210455 | 2124 | ALN39803 | 28521 | 59025 | 89529, 120033, 150537, 181041, 211545 |
| 1035 | AGX20756 | 27432 | 57936 | 88440, 118944, 149448, 179952, 210456 | 2125 | ALN39804 | 28522 | 59026 | 89530, 120034, 150538, 181042, 211546 |
| 1036 | AGX20767 | 27433 | 57937 | 88441, 118945, 149449, 179953, 210457 | 2126 | ALN39805 | 28523 | 59027 | 89531, 120035, 150539, 181043, 211547 |
| 1037 | AGX20778 | 27434 | 57938 | 88442, 118946, 149450, 179954, 210458 | 2127 | ACN29380 | 28524 | 59028 | 89532, 120036, 150540, 181044, 211548 |

FIG. 2 continued

| | | | | | | | | | |
|---|---|---|---|---|---|---|---|---|---|
| 1038 | AGX20789 | 27435 | 57939 | 88443, 118947, 149451, 179955, 210459 | 2128 | EPI498048 | 28525 | 59029 | 89533, 120037, 150541, 181045, 211549 |
| 1039 | AGX20800 | 27436 | 57940 | 88444, 118948, 149452, 179956, 210460 | 2129 | ANC28539 | 28526 | 59030 | 89534, 120038, 150542, 181046, 211550 |
| 1040 | AGX20811 | 27437 | 57941 | 88445, 118949, 149453, 179957, 210461 | 2130 | EPI827073 | 28527 | 59031 | 89535, 120039, 150543, 181047, 211551 |
| 1041 | AGX20822 | 27438 | 57942 | 88446, 118950, 149454, 179958, 210462 | 2131 | EPI244699 | 28528 | 59032 | 89536, 120040, 150544, 181048, 211552 |
| 1042 | AGX20833 | 27439 | 57943 | 88447, 118951, 149455, 179959, 210463 | 2132 | EPI244702 | 28529 | 59033 | 89537, 120041, 150545, 181049, 211553 |
| 1043 | AGX20844 | 27440 | 57944 | 88448, 118952, 149456, 179960, 210464 | 2133 | EPI540671 | 28530 | 59034 | 89538, 120042, 150546, 181050, 211554 |
| 1044 | AGX20855 | 27441 | 57945 | 88449, 118953, 149457, 179961, 210465 | 2134 | EPI573303 | 28531 | 59035 | 89539, 120043, 150547, 181051, 211555 |
| 1045 | AGX20866 | 27442 | 57946 | 88450, 118954, 149458, 179962, 210466 | 2135 | EPI829466 | 28532 | 59036 | 89540, 120044, 150548, 181052, 211556 |
| 1046 | AGX20877 | 27443 | 57947 | 88451, 118955, 149459, 179963, 210467 | 2136 | EPI684429 | 28533 | 59037 | 89541, 120045, 150549, 181053, 211557 |
| 1047 | AGX20888 | 27444 | 57948 | 88452, 118956, 149460, 179964, 210468 | 2137 | AFH58447 | 28534 | 59038 | 89542, 120046, 150550, 181054, 211558 |
| 1048 | AGX20899 | 27445 | 57949 | 88453, 118957, 149461, 179965, 210469 | 2138 | EPI173279 | 28535 | 59039 | 89543, 120047, 150551, 181055, 211559 |
| 1049 | AGX20910 | 27446 | 57950 | 88454, 118958, 149462, 179966, 210470 | 2139 | EPI163726 | 28536 | 59040 | 89544, 120048, 150552, 181056, 211560 |
| 1050 | AGX20921 | 27447 | 57951 | 88455, 118959, 149463, 179967, 210471 | 2140 | EPI636340 | 28537 | 59041 | 89545, 120049, 150553, 181057, 211561 |
| 1051 | AGX20932 | 27448 | 57952 | 88456, 118960, 149464, 179968, 210472 | 2141 | EPI645995 | 28538 | 59042 | 89546, 120050, 150554, 181058, 211562 |
| 1052 | AGX20943 | 27449 | 57953 | 88457, 118961, 149465, 179969, 210473 | 2142 | EPI539769 | 28539 | 59043 | 89547, 120051, 150555, 181059, 211563 |
| 1053 | AGX20954 | 27450 | 57954 | 88458, 118962, 149466, 179970, 210474 | 2143 | EPI551249 | 28540 | 59044 | 89548, 120052, 150556, 181060, 211564 |
| 1054 | AGX20965 | 27451 | 57955 | 88459, 118963, 149467, 179971, 210475 | 2144 | EPI544259 | 28541 | 59045 | 89549, 120053, 150557, 181061, 211565 |
| 1055 | AGX20976 | 27452 | 57956 | 88460, 118964, 149468, 179972, 210476 | 2145 | EPI592699 | 28542 | 59046 | 89550, 120054, 150558, 181062, 211566 |

FIG. 2 continued

| | | | | | | | | | |
|---|---|---|---|---|---|---|---|---|---|
| 1056 | AGX20987 | 27453 | 57957 | 88461, 118965, 149469, 179973, 210477 | 2146 | EPI592707 | 28543 | 59047 | 89551, 120055, 150559, 181063, 211567 |
| 1057 | AGX20998 | 27454 | 57958 | 88462, 118966, 149470, 179974, 210478 | 2147 | EPI693094 | 28544 | 59048 | 89552, 120056, 150560, 181064, 211568 |
| 1058 | AGX21009 | 27455 | 57959 | 88463, 118967, 149471, 179975, 210479 | 2148 | EPI678796 | 28545 | 59049 | 89553, 120057, 150561, 181065, 211569 |
| 1059 | AGX21020 | 27456 | 57960 | 88464, 118968, 149472, 179976, 210480 | 2149 | EPI721064 | 28546 | 59050 | 89554, 120058, 150562, 181066, 211570 |
| 1060 | AGX21031 | 27457 | 57961 | 88465, 118969, 149473, 179977, 210481 | 2150 | EPI328904 | 28547 | 59051 | 89555, 120059, 150563, 181067, 211571 |
| 1061 | AGX21042 | 27458 | 57962 | 88466, 118970, 149474, 179978, 210482 | 2151 | EPI543191 | 28548 | 59052 | 89556, 120060, 150564, 181068, 211572 |
| 1062 | AGX21053 | 27459 | 57963 | 88467, 118971, 149475, 179979, 210483 | 2152 | EPI500359 | 28549 | 59053 | 89557, 120061, 150565, 181069, 211573 |
| 1063 | AGX21064 | 27460 | 57964 | 88468, 118972, 149476, 179980, 210484 | 2153 | EPI543185 | 28550 | 59054 | 89558, 120062, 150566, 181070, 211574 |
| 1064 | AGX21075 | 27461 | 57965 | 88469, 118973, 149477, 179981, 210485 | 2154 | EPI536447 | 28551 | 59055 | 89559, 120063, 150567, 181071, 211575 |
| 1065 | AGX21084 | 27462 | 57966 | 88470, 118974, 149478, 179982, 210486 | 2155 | NP_056660 | 28552 | 59056 | 89560, 120064, 150568, 181072, 211576 |
| 1066 | AGX21095 | 27463 | 57967 | 88471, 118975, 149479, 179983, 210487 | 2156 | ABG85167 | 28553 | 59057 | 89561, 120065, 150569, 181073, 211577 |
| 1067 | AGX21106 | 27464 | 57968 | 88472, 118976, 149480, 179984, 210488 | 2157 | EPI376346 | 28554 | 59058 | 89562, 120066, 150570, 181074, 211578 |
| 1068 | AGX21117 | 27465 | 57969 | 88473, 118977, 149481, 179985, 210489 | 2158 | EPI368425 | 28555 | 59059 | 89563, 120067, 150571, 181075, 211579 |
| 1069 | AGX21128 | 27466 | 57970 | 88474, 118978, 149482, 179986, 210490 | 2159 | ACH53430 | 28556 | 59060 | 89564, 120068, 150572, 181076, 211580 |
| 1070 | AGX21139 | 27467 | 57971 | 88475, 118979, 149483, 179987, 210491 | 2160 | EPI331151 | 28557 | 59061 | 89565, 120069, 150573, 181077, 211581 |
| 1071 | AGX21150 | 27468 | 57972 | 88476, 118980, 149484, 179988, 210492 | 2161 | EPI356777 | 28558 | 59062 | 89566, 120070, 150574, 181078, 211582 |
| 1072 | AGX21161 | 27469 | 57973 | 88477, 118981, 149485, 179989, 210493 | 2162 | CY018349 | 28559 | 59063 | 89567, 120071, 150575, 181079, 211583 |
| 1073 | AGX21172 | 27470 | 57974 | 88478, 118982, 149486, 179990, 210494 | 2163 | AY581945 | 28560 | 59064 | 89568, 120072, 150576, 181080, 211584 |

FIG. 2 continued

| | | | | | | | | | |
|---|---|---|---|---|---|---|---|---|---|
| 1074 | AGX21183 | 27471 | 57975 | 88479, 118983, 149487, 179991, 210495 | 2164 | EPI541351 | 28561 | 59065 | 89569, 120073, 150577, 181081, 211585 |
| 1075 | AGX21194 | 27472 | 57976 | 88480, 118984, 149488, 179992, 210496 | 2165 | EPI541760 | 28562 | 59066 | 89570, 120074, 150578, 181082, 211586 |
| 1076 | AGX21205 | 27473 | 57977 | 88481, 118985, 149489, 179993, 210497 | 2166 | EPI477397 | 28563 | 59067 | 89571, 120075, 150579, 181083, 211587 |
| 1077 | AGX21216 | 27474 | 57978 | 88482, 118986, 149490, 179994, 210498 | 2167 | EPI492571 | 28564 | 59068 | 89572, 120076, 150580, 181084, 211588 |
| 1078 | AGX21227 | 27475 | 57979 | 88483, 118987, 149491, 179995, 210499 | 2168 | EPI498340 | 28565 | 59069 | 89573, 120077, 150581, 181085, 211589 |
| 1079 | AGX21238 | 27476 | 57980 | 88484, 118988, 149492, 179996, 210500 | 2169 | EPI516490 | 28566 | 59070 | 89574, 120078, 150582, 181086, 211590 |
| 1080 | AGX21249 | 27477 | 57981 | 88485, 118989, 149493, 179997, 210501 | 2170 | EPI538119 | 28567 | 59071 | 89575, 120079, 150583, 181087, 211591 |
| 1081 | AGX21260 | 27478 | 57982 | 88486, 118990, 149494, 179998, 210502 | 2171 | EPI538125 | 28568 | 59072 | 89576, 120080, 150584, 181088, 211592 |
| 1082 | AGX21271 | 27479 | 57983 | 88487, 118991, 149495, 179999, 210503 | 2172 | EPI556422 | 28569 | 59073 | 89577, 120081, 150585, 181089, 211593 |
| 1083 | AGX21282 | 27480 | 57984 | 88488, 118992, 149496, 180000, 210504 | 2173 | EPI614608 | 28570 | 59074 | 89578, 120082, 150586, 181090, 211594 |
| 1084 | AGX21293 | 27481 | 57985 | 88489, 118993, 149497, 180001, 210505 | 2174 | EPI614610 | 28571 | 59075 | 89579, 120083, 150587, 181091, 211595 |
| 1085 | AGX21304 | 27482 | 57986 | 88490, 118994, 149498, 180002, 210506 | 2175 | AAA43697 | 28572 | 59076 | 89580, 120084, 150588, 181092, 211596 |
| 1086 | AGX21315 | 27483 | 57987 | 88491, 118995, 149499, 180003, 210507 | 2176 | EPI271545 | 28573 | 59077 | 89581, 120085, 150589, 181093, 211597 |
| 1087 | AGX21326 | 27484 | 57988 | 88492, 118996, 149500, 180004, 210508 | 2177 | AGB08329 | 28574 | 59078 | 89582, 120086, 150590, 181094, 211598 |
| 1088 | AGX21337 | 27485 | 57989 | 88493, 118997, 149501, 180005, 210509 | 2178 | EPI294880 | 28575 | 59079 | 89583, 120087, 150591, 181095, 211599 |
| 1089 | AGX21348 | 27486 | 57990 | 88494, 118998, 149502, 180006, 210510 | 2179 | CY018765 | 28576 | 59080 | 89584, 120088, 150592, 181096, 211600 |
| 1090 | AGX21359 | 27487 | 57991 | 88495, 118999, 149503, 180007, 210511 | | | | | |

FIG. 2 continued

| | column 1 | column 2 | column 3 | column 4 | | column 1 | column 2 | column 3 | column 4 |
|---|---|---|---|---|---|---|---|---|---|
| Row | NCBI, Genbank or EpiFlu Accession No. | A | B | C | Row | NCBI, Genbank or EpiFlu Accession No. | A | B | C |
| 1 | AAA43084 | 14032 | 44536 | 75040, 105544, 136048, 166552, 197056 | 6184 | ADW09288 | 20215 | 50719 | 81223, 111727, 142231, 172735, 203239 |
| 2 | AAA43397 | 14033 | 44537 | 75041, 105545, 136049, 166553, 197057 | 6185 | ADW09299 | 20216 | 50720 | 81224, 111728, 142232, 172736, 203240 |
| 3 | AAA43412 | 14034 | 44538 | 75042, 105546, 136050, 166554, 197058 | 6186 | ADW09310 | 20217 | 50721 | 81225, 111729, 142233, 172737, 203241 |
| 4 | AAG01743 | 14035 | 44539 | 75043, 105547, 136051, 166555, 197059 | 6187 | ADW09330 | 20218 | 50722 | 81226, 111730, 142234, 172738, 203242 |
| 5 | AAG01759 | 14036 | 44540 | 75044, 105548, 136052, 166556, 197060 | 6188 | ADW10475 | 20219 | 50723 | 81227, 111731, 142235, 172739, 203243 |
| 6 | AAG01777 | 14037 | 44541 | 75045, 105549, 136053, 166557, 197061 | 6189 | ADW10486 | 20220 | 50724 | 81228, 111732, 142236, 172740, 203244 |
| 7 | AAG01786 | 14038 | 44542 | 75046, 105550, 136054, 166558, 197062 | 6190 | ADW10497 | 20221 | 50725 | 81229, 111733, 142237, 172741, 203245 |
| 8 | AAK71688 | 14039 | 44543 | 75047, 105551, 136055, 166559, 197063 | 6191 | ADW10508 | 20222 | 50726 | 81230, 111734, 142238, 172742, 203246 |
| 9 | AAN01169 | 14040 | 44544 | 75048, 105552, 136056, 166560, 197064 | 6192 | ADW10519 | 20223 | 50727 | 81231, 111735, 142239, 172743, 203247 |
| 10 | AAN01170 | 14041 | 44545 | 75049, 105553, 136057, 166561, 197065 | 6193 | ADW10530 | 20224 | 50728 | 81232, 111736, 142240, 172744, 203248 |
| 11 | AAN01171 | 14042 | 44546 | 75050, 105554, 136058, 166562, 197066 | 6194 | ADW10541 | 20225 | 50729 | 81233, 111737, 142241, 172745, 203249 |

FIG. 3

| | | | | | | | | | |
|---|---|---|---|---|---|---|---|---|---|
| 12 | AAN01172 | 14043 | 44547 | 75051, 105555, 136059, 166563, 197067 | 6195 | ADW10552 | 20226 | 50730 | 81234, 111738, 142242, 172746, 203250 |
| 13 | AAN01173 | 14044 | 44548 | 75052, 105556, 136060, 166564, 197068 | 6196 | ADW10563 | 20227 | 50731 | 81235, 111739, 142243, 172747, 203251 |
| 14 | AAN01174 | 14045 | 44549 | 75053, 105557, 136061, 166565, 197069 | 6197 | ADW10574 | 20228 | 50732 | 81236, 111740, 142244, 172748, 203252 |
| 15 | AAN01175 | 14046 | 44550 | 75054, 105558, 136062, 166566, 197070 | 6198 | ADW10585 | 20229 | 50733 | 81237, 111741, 142245, 172749, 203253 |
| 16 | AAN01176 | 14047 | 44551 | 75055, 105559, 136063, 166567, 197071 | 6199 | ADW10596 | 20230 | 50734 | 81238, 111742, 142246, 172750, 203254 |
| 17 | AAN01177 | 14048 | 44552 | 75056, 105560, 136064, 166568, 197072 | 6200 | ADW10607 | 20231 | 50735 | 81239, 111743, 142247, 172751, 203255 |
| 18 | AAN01178 | 14049 | 44553 | 75057, 105561, 136065, 166569, 197073 | 6201 | ADW10618 | 20232 | 50736 | 81240, 111744, 142248, 172752, 203256 |
| 19 | AAN01179 | 14050 | 44554 | 75058, 105562, 136066, 166570, 197074 | 6202 | ADW10629 | 20233 | 50737 | 81241, 111745, 142249, 172753, 203257 |
| 20 | AAN01180 | 14051 | 44555 | 75059, 105563, 136067, 166571, 197075 | 6203 | ADW10724 | 20234 | 50738 | 81242, 111746, 142250, 172754, 203258 |
| 21 | AAN01181 | 14052 | 44556 | 75060, 105564, 136068, 166572, 197076 | 6204 | ADW10735 | 20235 | 50739 | 81243, 111747, 142251, 172755, 203259 |
| 22 | AAN01182 | 14053 | 44557 | 75061, 105565, 136069, 166573, 197077 | 6205 | ADW10746 | 20236 | 50740 | 81244, 111748, 142252, 172756, 203260 |
| 23 | AAN01183 | 14054 | 44558 | 75062, 105566, 136070, 166574, 197078 | 6206 | ADW10757 | 20237 | 50741 | 81245, 111749, 142253, 172757, 203261 |
| 24 | AAN01184 | 14055 | 44559 | 75063, 105567, 136071, 166575, 197079 | 6207 | ADW10768 | 20238 | 50742 | 81246, 111750, 142254, 172758, 203262 |
| 25 | AAN01185 | 14056 | 44560 | 75064, 105568, 136072, 166576, 197080 | 6208 | ADW10779 | 20239 | 50743 | 81247, 111751, 142255, 172759, 203263 |
| 26 | AAN01186 | 14057 | 44561 | 75065, 105569, 136073, 166577, 197081 | 6209 | ADW10790 | 20240 | 50744 | 81248, 111752, 142256, 172760, 203264 |
| 27 | AAN01187 | 14058 | 44562 | 75066, 105570, 136074, 166578, 197082 | 6210 | ADW10801 | 20241 | 50745 | 81249, 111753, 142257, 172761, 203265 |
| 28 | AAN01188 | 14059 | 44563 | 75067, 105571, 136075, 166579, 197083 | 6211 | ADW10812 | 20242 | 50746 | 81250, 111754, 142258, 172762, 203266 |
| 29 | AAN64883 | 14060 | 44564 | 75068, 105572, 136076, 166580, 197084 | 6212 | ADW10823 | 20243 | 50747 | 81251, 111755, 142259, 172763, 203267 |

FIG. 3 continued

| | | | | | | | | | |
|---|---|---|---|---|---|---|---|---|---|
| 30 | AAN64884 | 14061 | 44565 | 75069, 105573, 136077, 166581, 197085 | 6213 | ADW10834 | 20244 | 50748 | 81252, 111756, 142260, 172764, 203268 |
| 31 | AAN64885 | 14062 | 44566 | 75070, 105574, 136078, 166582, 197086 | 6214 | ADW10845 | 20245 | 50749 | 81253, 111757, 142261, 172765, 203269 |
| 32 | AAN64886 | 14063 | 44567 | 75071, 105575, 136079, 166583, 197087 | 6215 | ADW10856 | 20246 | 50750 | 81254, 111758, 142262, 172766, 203270 |
| 33 | AAN64887 | 14064 | 44568 | 75072, 105576, 136080, 166584, 197088 | 6216 | ADW10867 | 20247 | 50751 | 81255, 111759, 142263, 172767, 203271 |
| 34 | AAN64888 | 14065 | 44569 | 75073, 105577, 136081, 166585, 197089 | 6217 | ADW10878 | 20248 | 50752 | 81256, 111760, 142264, 172768, 203272 |
| 35 | AAN64889 | 14066 | 44570 | 75074, 105578, 136082, 166586, 197090 | 6218 | ADW10889 | 20249 | 50753 | 81257, 111761, 142265, 172769, 203273 |
| 36 | AAN64890 | 14067 | 44571 | 75075, 105579, 136083, 166587, 197091 | 6219 | ADW10900 | 20250 | 50754 | 81258, 111762, 142266, 172770, 203274 |
| 37 | AAN64891 | 14068 | 44572 | 75076, 105580, 136084, 166588, 197092 | 6220 | ADW11155 | 20251 | 50755 | 81259, 111763, 142267, 172771, 203275 |
| 38 | AAO46212 | 14069 | 44573 | 75077, 105581, 136085, 166589, 197093 | 6221 | ADW23530 | 20252 | 50756 | 81260, 111764, 142268, 172772, 203276 |
| 39 | AAO46213 | 14070 | 44574 | 75078, 105582, 136086, 166590, 197094 | 6222 | ADW54483 | 20253 | 50757 | 81261, 111765, 142269, 172773, 203277 |
| 40 | AAO46214 | 14071 | 44575 | 75079, 105583, 136087, 166591, 197095 | 6223 | ADW54494 | 20254 | 50758 | 81262, 111766, 142270, 172774, 203278 |
| 41 | AAO46215 | 14072 | 44576 | 75080, 105584, 136088, 166592, 197096 | 6224 | ADW54514 | 20255 | 50759 | 81263, 111767, 142271, 172775, 203279 |
| 42 | AAO46216 | 14073 | 44577 | 75081, 105585, 136089, 166593, 197097 | 6225 | ADW54522 | 20256 | 50760 | 81264, 111768, 142272, 172776, 203280 |
| 43 | AAO46217 | 14074 | 44578 | 75082, 105586, 136090, 166594, 197098 | 6226 | ADW65826 | 20257 | 50761 | 81265, 111769, 142273, 172777, 203281 |
| 44 | AAO46218 | 14075 | 44579 | 75083, 105587, 136091, 166595, 197099 | 6227 | ADW80519 | 20258 | 50762 | 81266, 111770, 142274, 172778, 203282 |
| 45 | AAO46220 | 14076 | 44580 | 75084, 105588, 136092, 166596, 197100 | 6228 | ADW82127 | 20259 | 50763 | 81267, 111771, 142275, 172779, 203283 |
| 46 | AAO46221 | 14077 | 44581 | 75085, 105589, 136093, 166597, 197101 | 6229 | ADW82138 | 20260 | 50764 | 81268, 111772, 142276, 172780, 203284 |
| 47 | AAO46223 | 14078 | 44582 | 75086, 105590, 136094, 166598, 197102 | 6230 | ADW82149 | 20261 | 50765 | 81269, 111773, 142277, 172781, 203285 |

FIG. 3 continued

| | | | | | | | | | |
|---|---|---|---|---|---|---|---|---|---|
| 48 | AA046224 | 14079 | 44583 | 75087, 105591, 136095, 166599, 197103 | 6231 | ADW82158 | 20262 | 50766 | 81270, 111774, 142278, 172782, 203286 |
| 49 | AA046225 | 14080 | 44584 | 75088, 105592, 136096, 166600, 197104 | 6232 | ADW82169 | 20263 | 50767 | 81271, 111775, 142279, 172783, 203287 |
| 50 | AA046226 | 14081 | 44585 | 75089, 105593, 136097, 166601, 197105 | 6233 | ADW82180 | 20264 | 50768 | 81272, 111776, 142280, 172784, 203288 |
| 51 | AA046229 | 14082 | 44586 | 75090, 105594, 136098, 166602, 197106 | 6234 | ADW82191 | 20265 | 50769 | 81273, 111777, 142281, 172785, 203289 |
| 52 | AA046230 | 14083 | 44587 | 75091, 105595, 136099, 166603, 197107 | 6235 | ADW82201 | 20266 | 50770 | 81274, 111778, 142282, 172786, 203290 |
| 53 | AA046231 | 14084 | 44588 | 75092, 105596, 136100, 166604, 197108 | 6236 | ADW82211 | 20267 | 50771 | 81275, 111779, 142283, 172787, 203291 |
| 54 | AA046232 | 14085 | 44589 | 75093, 105597, 136101, 166605, 197109 | 6237 | ADW82221 | 20268 | 50772 | 81276, 111780, 142284, 172788, 203292 |
| 55 | AA046233 | 14086 | 44590 | 75094, 105598, 136102, 166606, 197110 | 6238 | ADW82231 | 20269 | 50773 | 81277, 111781, 142285, 172789, 203293 |
| 56 | AA046235 | 14087 | 44591 | 75095, 105599, 136103, 166607, 197111 | 6239 | ADW82241 | 20270 | 50774 | 81278, 111782, 142286, 172790, 203294 |
| 57 | AA046236 | 14088 | 44592 | 75096, 105600, 136104, 166608, 197112 | 6240 | ADW82251 | 20271 | 50775 | 81279, 111783, 142287, 172791, 203295 |
| 58 | AA046237 | 14089 | 44593 | 75097, 105601, 136105, 166609, 197113 | 6241 | ADW82261 | 20272 | 50776 | 81280, 111784, 142288, 172792, 203296 |
| 59 | AA046238 | 14090 | 44594 | 75098, 105602, 136106, 166610, 197114 | 6242 | ADW82271 | 20273 | 50777 | 81281, 111785, 142289, 172793, 203297 |
| 60 | AA046241 | 14091 | 44595 | 75099, 105603, 136107, 166611, 197115 | 6243 | ADW95306 | 20274 | 50778 | 81282, 111786, 142290, 172794, 203298 |
| 61 | AA046245 | 14092 | 44596 | 75100, 105604, 136108, 166612, 197116 | 6244 | ADW95313 | 20275 | 50779 | 81283, 111787, 142291, 172795, 203299 |
| 62 | AA046246 | 14093 | 44597 | 75101, 105605, 136109, 166613, 197117 | 6245 | ADW95320 | 20276 | 50780 | 81284, 111788, 142292, 172796, 203300 |
| 63 | AA046247 | 14094 | 44598 | 75102, 105606, 136110, 166614, 197118 | 6246 | ADW95327 | 20277 | 50781 | 81285, 111789, 142293, 172797, 203301 |
| 64 | AA046462 | 14095 | 44599 | 75103, 105607, 136111, 166615, 197119 | 6247 | ADW95333 | 20278 | 50782 | 81286, 111790, 142294, 172798, 203302 |
| 65 | AA046463 | 14096 | 44600 | 75104, 105608, 136112, 166616, 197120 | 6248 | ADX20813 | 20279 | 50783 | 81287, 111791, 142295, 172799, 203303 |

FIG. 3 continued

| | | | | | | | | | |
|---|---|---|---|---|---|---|---|---|---|
| 66 | AA046464 | 14097 | 44601 | 75105, 105609, 136113, 166617, 197121 | 6249 | ADX20814 | 20280 | 50784 | 81288, 111792, 142296, 172800, 203304 |
| 67 | AA046465 | 14098 | 44602 | 75106, 105610, 136114, 166618, 197122 | 6250 | ADX21091 | 20281 | 50785 | 81289, 111793, 142297, 172801, 203305 |
| 68 | AA046466 | 14099 | 44603 | 75107, 105611, 136115, 166619, 197123 | 6251 | ADX21101 | 20282 | 50786 | 81290, 111794, 142298, 172802, 203306 |
| 69 | AA046467 | 14100 | 44604 | 75108, 105612, 136116, 166620, 197124 | 6252 | ADX36112 | 20283 | 50787 | 81291, 111795, 142299, 172803, 203307 |
| 70 | AA046468 | 14101 | 44605 | 75109, 105613, 136117, 166621, 197125 | 6253 | ADX87386 | 20284 | 50788 | 81292, 111796, 142300, 172804, 203308 |
| 71 | AA046469 | 14102 | 44606 | 75110, 105614, 136118, 166622, 197126 | 6254 | ADX96270 | 20285 | 50789 | 81293, 111797, 142301, 172805, 203309 |
| 72 | AA046471 | 14103 | 44607 | 75111, 105615, 136119, 166623, 197127 | 6255 | ADX96280 | 20286 | 50790 | 81294, 111798, 142302, 172806, 203310 |
| 73 | AA046472 | 14104 | 44608 | 75112, 105616, 136120, 166624, 197128 | 6256 | ADX96290 | 20287 | 50791 | 81295, 111799, 142303, 172807, 203311 |
| 74 | AA046473 | 14105 | 44609 | 75113, 105617, 136121, 166625, 197129 | 6257 | ADX96300 | 20288 | 50792 | 81296, 111800, 142304, 172808, 203312 |
| 75 | AA046474 | 14106 | 44610 | 75114, 105618, 136122, 166626, 197130 | 6258 | ADX96310 | 20289 | 50793 | 81297, 111801, 142305, 172809, 203313 |
| 76 | AA046475 | 14107 | 44611 | 75115, 105619, 136123, 166627, 197131 | 6259 | ADX96330 | 20290 | 50794 | 81298, 111802, 142306, 172810, 203314 |
| 77 | AA046476 | 14108 | 44612 | 75116, 105620, 136124, 166628, 197132 | 6260 | ADX96339 | 20291 | 50795 | 81299, 111803, 142307, 172811, 203315 |
| 78 | AA046477 | 14109 | 44613 | 75117, 105621, 136125, 166629, 197133 | 6261 | ADX96349 | 20292 | 50796 | 81300, 111804, 142308, 172812, 203316 |
| 79 | AA046478 | 14110 | 44614 | 75118, 105622, 136126, 166630, 197134 | 6262 | ADX96359 | 20293 | 50797 | 81301, 111805, 142309, 172813, 203317 |
| 80 | AA046479 | 14111 | 44615 | 75119, 105623, 136127, 166631, 197135 | 6263 | ADX96369 | 20294 | 50798 | 81302, 111806, 142310, 172814, 203318 |
| 81 | AA046481 | 14112 | 44616 | 75120, 105624, 136128, 166632, 197136 | 6264 | ADX96380 | 20295 | 50799 | 81303, 111807, 142311, 172815, 203319 |
| 82 | AA046482 | 14113 | 44617 | 75121, 105625, 136129, 166633, 197137 | 6265 | ADX96390 | 20296 | 50800 | 81304, 111808, 142312, 172816, 203320 |
| 83 | AA046483 | 14114 | 44618 | 75122, 105626, 136130, 166634, 197138 | 6266 | ADX96400 | 20297 | 50801 | 81305, 111809, 142313, 172817, 203321 |

FIG. 3 continued

| | | | | | | | | | |
|---|---|---|---|---|---|---|---|---|---|
| 84 | AAO46485 | 14115 | 44619 | 75123, 105627, 136131, 166635, 197139 | 6267 | ADX96410 | 20298 | 50802 | 81306, 111810, 142314, 172818, 203322 |
| 85 | AAO46486 | 14116 | 44620 | 75124, 105628, 136132, 166636, 197140 | 6268 | ADX96419 | 20299 | 50803 | 81307, 111811, 142315, 172819, 203323 |
| 86 | AAO46489 | 14117 | 44621 | 75125, 105629, 136133, 166637, 197141 | 6269 | ADX96429 | 20300 | 50804 | 81308, 111812, 142316, 172820, 203324 |
| 87 | AAO46491 | 14118 | 44622 | 75126, 105630, 136134, 166638, 197142 | 6270 | ADX96449 | 20301 | 50805 | 81309, 111813, 142317, 172821, 203325 |
| 88 | AAO46492 | 14119 | 44623 | 75127, 105631, 136135, 166639, 197143 | 6271 | ADX96469 | 20302 | 50806 | 81310, 111814, 142318, 172822, 203326 |
| 89 | AAO88264 | 14120 | 44624 | 75128, 105632, 136136, 166640, 197144 | 6272 | ADX96489 | 20303 | 50807 | 81311, 111815, 142319, 172823, 203327 |
| 90 | AAQ10334 | 14121 | 44625 | 75129, 105633, 136137, 166641, 197145 | 6273 | ADX96499 | 20304 | 50808 | 81312, 111816, 142320, 172824, 203328 |
| 91 | AAQ10335 | 14122 | 44626 | 75130, 105634, 136138, 166642, 197146 | 6274 | ADX96509 | 20305 | 50809 | 81313, 111817, 142321, 172825, 203329 |
| 92 | AAQ10336 | 14123 | 44627 | 75131, 105635, 136139, 166643, 197147 | 6275 | ADX96519 | 20306 | 50810 | 81314, 111818, 142322, 172826, 203330 |
| 93 | AAQ10337 | 14124 | 44628 | 75132, 105636, 136140, 166644, 197148 | 6276 | ADX96529 | 20307 | 50811 | 81315, 111819, 142323, 172827, 203331 |
| 94 | AAQ10339 | 14125 | 44629 | 75133, 105637, 136141, 166645, 197149 | 6277 | ADX96539 | 20308 | 50812 | 81316, 111820, 142324, 172828, 203332 |
| 95 | AAQ10341 | 14126 | 44630 | 75134, 105638, 136142, 166646, 197150 | 6278 | ADX96549 | 20309 | 50813 | 81317, 111821, 142325, 172829, 203333 |
| 96 | AAQ10343 | 14127 | 44631 | 75135, 105639, 136143, 166647, 197151 | 6279 | ADX96559 | 20310 | 50814 | 81318, 111822, 142326, 172830, 203334 |
| 97 | AAQ10344 | 14128 | 44632 | 75136, 105640, 136144, 166648, 197152 | 6280 | ADX96569 | 20311 | 50815 | 81319, 111823, 142327, 172831, 203335 |
| 98 | AAR11366 | 14129 | 44633 | 75137, 105641, 136145, 166649, 197153 | 6281 | ADX96579 | 20312 | 50816 | 81320, 111824, 142328, 172832, 203336 |
| 99 | AAS89005 | 14130 | 44634 | 75138, 105642, 136146, 166650, 197154 | 6282 | ADX96589 | 20313 | 50817 | 81321, 111825, 142329, 172833, 203337 |
| 100 | AAS89006 | 14131 | 44635 | 75139, 105643, 136147, 166651, 197155 | 6283 | ADX96599 | 20314 | 50818 | 81322, 111826, 142330, 172834, 203338 |
| 101 | AAT38822 | 14132 | 44636 | 75140, 105644, 136148, 166652, 197156 | 6284 | ADX96609 | 20315 | 50819 | 81323, 111827, 142331, 172835, 203339 |

FIG. 3 continued

| | | | | | | | | | |
|---|---|---|---|---|---|---|---|---|---|
| 102 | AAV65827 | 14133 | 44637 | 75141, 105645, 136149, 166653, 197157 | 6285 | ADX96619 | 20316 | 50820 | 81324, 111828, 142332, 172836, 203340 |
| 103 | AAX11488 | 14134 | 44638 | 75142, 105646, 136150, 166654, 197158 | 6286 | ADX96629 | 20317 | 50821 | 81325, 111829, 142333, 172837, 203341 |
| 104 | AAX11508 | 14135 | 44639 | 75143, 105647, 136151, 166655, 197159 | 6287 | ADX96639 | 20318 | 50822 | 81326, 111830, 142334, 172838, 203342 |
| 105 | AAX11538 | 14136 | 44640 | 75144, 105648, 136152, 166656, 197160 | 6288 | ADX96649 | 20319 | 50823 | 81327, 111831, 142335, 172839, 203343 |
| 106 | AAX11548 | 14137 | 44641 | 75145, 105649, 136153, 166657, 197161 | 6289 | ADX96659 | 20320 | 50824 | 81328, 111832, 142336, 172840, 203344 |
| 107 | AAX11558 | 14138 | 44642 | 75146, 105650, 136154, 166658, 197162 | 6290 | ADX96669 | 20321 | 50825 | 81329, 111833, 142337, 172841, 203345 |
| 108 | AAX11568 | 14139 | 44643 | 75147, 105651, 136155, 166659, 197163 | 6291 | ADX96679 | 20322 | 50826 | 81330, 111834, 142338, 172842, 203346 |
| 109 | AAX11578 | 14140 | 44644 | 75148, 105652, 136156, 166660, 197164 | 6292 | ADX96689 | 20323 | 50827 | 81331, 111835, 142339, 172843, 203347 |
| 110 | AAX11588 | 14141 | 44645 | 75149, 105653, 136157, 166661, 197165 | 6293 | ADX96699 | 20324 | 50828 | 81332, 111836, 142340, 172844, 203348 |
| 111 | AAX11598 | 14142 | 44646 | 75150, 105654, 136158, 166662, 197166 | 6294 | ADX96709 | 20325 | 50829 | 81333, 111837, 142341, 172845, 203349 |
| 112 | AAX11608 | 14143 | 44647 | 75151, 105655, 136159, 166663, 197167 | 6295 | ADX96719 | 20326 | 50830 | 81334, 111838, 142342, 172846, 203350 |
| 113 | AAX11618 | 14144 | 44648 | 75152, 105656, 136160, 166664, 197168 | 6296 | ADX96729 | 20327 | 50831 | 81335, 111839, 142343, 172847, 203351 |
| 114 | AAX12744 | 14145 | 44649 | 75153, 105657, 136161, 166665, 197169 | 6297 | ADX96739 | 20328 | 50832 | 81336, 111840, 142344, 172848, 203352 |
| 115 | AAX12754 | 14146 | 44650 | 75154, 105658, 136162, 166666, 197170 | 6298 | ADX96749 | 20329 | 50833 | 81337, 111841, 142345, 172849, 203353 |
| 116 | AAX12774 | 14147 | 44651 | 75155, 105659, 136163, 166667, 197171 | 6299 | ADX96759 | 20330 | 50834 | 81338, 111842, 142346, 172850, 203354 |
| 117 | AAX12804 | 14148 | 44652 | 75156, 105660, 136164, 166668, 197172 | 6300 | ADX96769 | 20331 | 50835 | 81339, 111843, 142347, 172851, 203355 |
| 118 | AAX12814 | 14149 | 44653 | 75157, 105661, 136165, 166669, 197173 | 6301 | ADX96779 | 20332 | 50836 | 81340, 111844, 142348, 172852, 203356 |
| 119 | AAX34064 | 14150 | 44654 | 75158, 105662, 136166, 166670, 197174 | 6302 | ADX96789 | 20333 | 50837 | 81341, 111845, 142349, 172853, 203357 |

FIG. 3 continued

| | | | | | | | | | |
|---|---|---|---|---|---|---|---|---|---|
| 120 | AAX35824 | 14151 | 44655 | 75159, 105663, 136167, 166671, 197175 | 6303 | ADX96799 | 20334 | 50838 | 81342, 111846, 142350, 172854, 203358 |
| 121 | AAX35834 | 14152 | 44656 | 75160, 105664, 136168, 166672, 197176 | 6304 | ADX96809 | 20335 | 50839 | 81343, 111847, 142351, 172855, 203359 |
| 122 | AAX35844 | 14153 | 44657 | 75161, 105665, 136169, 166673, 197177 | 6305 | ADX96819 | 20336 | 50840 | 81344, 111848, 142352, 172856, 203360 |
| 123 | AAX35854 | 14154 | 44658 | 75162, 105666, 136170, 166674, 197178 | 6306 | ADX96829 | 20337 | 50841 | 81345, 111849, 142353, 172857, 203361 |
| 124 | AAX35864 | 14155 | 44659 | 75163, 105667, 136171, 166675, 197179 | 6307 | ADX96839 | 20338 | 50842 | 81346, 111850, 142354, 172858, 203362 |
| 125 | AAX47538 | 14156 | 44660 | 75164, 105668, 136172, 166676, 197180 | 6308 | ADX96849 | 20339 | 50843 | 81347, 111851, 142355, 172859, 203363 |
| 126 | AAX56383 | 14157 | 44661 | 75165, 105669, 136173, 166677, 197181 | 6309 | ADX96859 | 20340 | 50844 | 81348, 111852, 142356, 172860, 203364 |
| 127 | AAX56393 | 14158 | 44662 | 75166, 105670, 136174, 166678, 197182 | 6310 | ADX96869 | 20341 | 50845 | 81349, 111853, 142357, 172861, 203365 |
| 128 | AAX56413 | 14159 | 44663 | 75167, 105671, 136175, 166679, 197183 | 6311 | ADX96879 | 20342 | 50846 | 81350, 111854, 142358, 172862, 203366 |
| 129 | AAX56423 | 14160 | 44664 | 75168, 105672, 136176, 166680, 197184 | 6312 | ADX96899 | 20343 | 50847 | 81351, 111855, 142359, 172863, 203367 |
| 130 | AAX56433 | 14161 | 44665 | 75169, 105673, 136177, 166681, 197185 | 6313 | ADX96909 | 20344 | 50848 | 81352, 111856, 142360, 172864, 203368 |
| 131 | AAX56443 | 14162 | 44666 | 75170, 105674, 136178, 166682, 197186 | 6314 | ADX96919 | 20345 | 50849 | 81353, 111857, 142361, 172865, 203369 |
| 132 | AAX56473 | 14163 | 44667 | 75171, 105675, 136179, 166683, 197187 | 6315 | ADX96929 | 20346 | 50850 | 81354, 111858, 142362, 172866, 203370 |
| 133 | AAX56483 | 14164 | 44668 | 75172, 105676, 136180, 166684, 197188 | 6316 | ADX96939 | 20347 | 50851 | 81355, 111859, 142363, 172867, 203371 |
| 134 | AAX56503 | 14165 | 44669 | 75173, 105677, 136181, 166685, 197189 | 6317 | ADX96949 | 20348 | 50852 | 81356, 111860, 142364, 172868, 203372 |
| 135 | AAX56513 | 14166 | 44670 | 75174, 105678, 136182, 166686, 197190 | 6318 | ADX96959 | 20349 | 50853 | 81357, 111861, 142365, 172869, 203373 |
| 136 | AAX56533 | 14167 | 44671 | 75175, 105679, 136183, 166687, 197191 | 6319 | ADX96969 | 20350 | 50854 | 81358, 111862, 142366, 172870, 203374 |
| 137 | AAX56543 | 14168 | 44672 | 75176, 105680, 136184, 166688, 197192 | 6320 | ADX96979 | 20351 | 50855 | 81359, 111863, 142367, 172871, 203375 |

FIG. 3 continued

| | | | | | | | | | |
|---|---|---|---|---|---|---|---|---|---|
| 138 | AAX56553 | 14169 | 44673 | 75177, 105681, 136185, 166689, 197193 | 6321 | ADX96989 | 20352 | 50856 | 81360, 111864, 142368, 172872, 203376 |
| 139 | AAX56563 | 14170 | 44674 | 75178, 105682, 136186, 166690, 197194 | 6322 | ADX96999 | 20353 | 50857 | 81361, 111865, 142369, 172873, 203377 |
| 140 | AAX56573 | 14171 | 44675 | 75179, 105683, 136187, 166691, 197195 | 6323 | ADX97009 | 20354 | 50858 | 81362, 111866, 142370, 172874, 203378 |
| 141 | AAX56583 | 14172 | 44676 | 75180, 105684, 136188, 166692, 197196 | 6324 | ADX97020 | 20355 | 50859 | 81363, 111867, 142371, 172875, 203379 |
| 142 | AAX56593 | 14173 | 44677 | 75181, 105685, 136189, 166693, 197197 | 6325 | ADX97030 | 20356 | 50860 | 81364, 111868, 142372, 172876, 203380 |
| 143 | AAX56603 | 14174 | 44678 | 75182, 105686, 136190, 166694, 197198 | 6326 | ADX98643 | 20357 | 50861 | 81365, 111869, 142373, 172877, 203381 |
| 144 | AAX57647 | 14175 | 44679 | 75183, 105687, 136191, 166695, 197199 | 6327 | ADX98653 | 20358 | 50862 | 81366, 111870, 142374, 172878, 203382 |
| 145 | AAX57657 | 14176 | 44680 | 75184, 105688, 136192, 166696, 197200 | 6328 | ADX98668 | 20359 | 50863 | 81367, 111871, 142375, 172879, 203383 |
| 146 | AAX57667 | 14177 | 44681 | 75185, 105689, 136193, 166697, 197201 | 6329 | ADX98678 | 20360 | 50864 | 81368, 111872, 142376, 172880, 203384 |
| 147 | AAX57677 | 14178 | 44682 | 75186, 105690, 136194, 166698, 197202 | 6330 | ADX98698 | 20361 | 50865 | 81369, 111873, 142377, 172881, 203385 |
| 148 | AAX57687 | 14179 | 44683 | 75187, 105691, 136195, 166699, 197203 | 6331 | ADX98708 | 20362 | 50866 | 81370, 111874, 142378, 172882, 203386 |
| 149 | AAX57697 | 14180 | 44684 | 75188, 105692, 136196, 166700, 197204 | 6332 | ADX98722 | 20363 | 50867 | 81371, 111875, 142379, 172883, 203387 |
| 150 | AAX57707 | 14181 | 44685 | 75189, 105693, 136197, 166701, 197205 | 6333 | ADX98732 | 20364 | 50868 | 81372, 111876, 142380, 172884, 203388 |
| 151 | AAX57717 | 14182 | 44686 | 75190, 105694, 136198, 166702, 197206 | 6334 | ADX98742 | 20365 | 50869 | 81373, 111877, 142381, 172885, 203389 |
| 152 | AAX57726 | 14183 | 44687 | 75191, 105695, 136199, 166703, 197207 | 6335 | ADX98751 | 20366 | 50870 | 81374, 111878, 142382, 172886, 203390 |
| 153 | AAX57737 | 14184 | 44688 | 75192, 105696, 136200, 166704, 197208 | 6336 | ADX98761 | 20367 | 50871 | 81375, 111879, 142383, 172887, 203391 |
| 154 | AAX57747 | 14185 | 44689 | 75193, 105697, 136201, 166705, 197209 | 6337 | ADX98770 | 20368 | 50872 | 81376, 111880, 142384, 172888, 203392 |
| 155 | AAX57757 | 14186 | 44690 | 75194, 105698, 136202, 166706, 197210 | 6338 | ADX98780 | 20369 | 50873 | 81377, 111881, 142385, 172889, 203393 |

FIG. 3 continued

| | | | | | | | | | |
|---|---|---|---|---|---|---|---|---|---|
| 156 | AAX57767 | 14187 | 44691 | 75195, 105699, 136203, 166707, 197211 | 6339 | ADX98788 | 20370 | 50874 | 81378, 111882, 142386, 172890, 203394 |
| 157 | AAX57777 | 14188 | 44692 | 75196, 105700, 136204, 166708, 197212 | 6340 | ADX98809 | 20371 | 50875 | 81379, 111883, 142387, 172891, 203395 |
| 158 | AAX57787 | 14189 | 44693 | 75197, 105701, 136205, 166709, 197213 | 6341 | ADX98821 | 20372 | 50876 | 81380, 111884, 142388, 172892, 203396 |
| 159 | AAX57797 | 14190 | 44694 | 75198, 105702, 136206, 166710, 197214 | 6342 | ADX98846 | 20373 | 50877 | 81381, 111885, 142389, 172893, 203397 |
| 160 | AAX57807 | 14191 | 44695 | 75199, 105703, 136207, 166711, 197215 | 6343 | ADX98856 | 20374 | 50878 | 81382, 111886, 142390, 172894, 203398 |
| 161 | AAX57817 | 14192 | 44696 | 75200, 105704, 136208, 166712, 197216 | 6344 | ADX98863 | 20375 | 50879 | 81383, 111887, 142391, 172895, 203399 |
| 162 | AAX57837 | 14193 | 44697 | 75201, 105705, 136209, 166713, 197217 | 6345 | ADX98873 | 20376 | 50880 | 81384, 111888, 142392, 172896, 203400 |
| 163 | AAX57847 | 14194 | 44698 | 75202, 105706, 136210, 166714, 197218 | 6346 | ADX98883 | 20377 | 50881 | 81385, 111889, 142393, 172897, 203401 |
| 164 | AAX57857 | 14195 | 44699 | 75203, 105707, 136211, 166715, 197219 | 6347 | ADX98893 | 20378 | 50882 | 81386, 111890, 142394, 172898, 203402 |
| 165 | AAX57867 | 14196 | 44700 | 75204, 105708, 136212, 166716, 197220 | 6348 | ADX98903 | 20379 | 50883 | 81387, 111891, 142395, 172899, 203403 |
| 166 | AAX57877 | 14197 | 44701 | 75205, 105709, 136213, 166717, 197221 | 6349 | ADX98913 | 20380 | 50884 | 81388, 111892, 142396, 172900, 203404 |
| 167 | AAX57887 | 14198 | 44702 | 75206, 105710, 136214, 166718, 197222 | 6350 | ADX98923 | 20381 | 50885 | 81389, 111893, 142397, 172901, 203405 |
| 168 | AAX57897 | 14199 | 44703 | 75207, 105711, 136215, 166719, 197223 | 6351 | ADX98933 | 20382 | 50886 | 81390, 111894, 142398, 172902, 203406 |
| 169 | AAX57907 | 14200 | 44704 | 75208, 105712, 136216, 166720, 197224 | 6352 | ADX98943 | 20383 | 50887 | 81391, 111895, 142399, 172903, 203407 |
| 170 | AAX57917 | 14201 | 44705 | 75209, 105713, 136217, 166721, 197225 | 6353 | ADX98953 | 20384 | 50888 | 81392, 111896, 142400, 172904, 203408 |
| 171 | AAX57927 | 14202 | 44706 | 75210, 105714, 136218, 166722, 197226 | 6354 | ADX98963 | 20385 | 50889 | 81393, 111897, 142401, 172905, 203409 |
| 172 | AAX57937 | 14203 | 44707 | 75211, 105715, 136219, 166723, 197227 | 6355 | ADX98973 | 20386 | 50890 | 81394, 111898, 142402, 172906, 203410 |
| 173 | AAX57947 | 14204 | 44708 | 75212, 105716, 136220, 166724, 197228 | 6356 | ADX98983 | 20387 | 50891 | 81395, 111899, 142403, 172907, 203411 |

FIG. 3 continued

| | | | | | | | | | |
|---|---|---|---|---|---|---|---|---|---|
| 174 | AAX76626 | 14205 | 44709 | 75213, 105717, 136221, 166725, 197229 | 6357 | ADX98993 | 20388 | 50892 | 81396, 111900, 142404, 172908, 203412 |
| 175 | AAX76646 | 14206 | 44710 | 75214, 105718, 136222, 166726, 197230 | 6358 | ADX99003 | 20389 | 50893 | 81397, 111901, 142405, 172909, 203413 |
| 176 | AAX76656 | 14207 | 44711 | 75215, 105719, 136223, 166727, 197231 | 6359 | ADX99584 | 20390 | 50894 | 81398, 111902, 142406, 172910, 203414 |
| 177 | AAX76666 | 14208 | 44712 | 75216, 105720, 136224, 166728, 197232 | 6360 | ADX99595 | 20391 | 50895 | 81399, 111903, 142407, 172911, 203415 |
| 178 | AAX76696 | 14209 | 44713 | 75217, 105721, 136225, 166729, 197233 | 6361 | ADX99606 | 20392 | 50896 | 81400, 111904, 142408, 172912, 203416 |
| 179 | AAX76736 | 14210 | 44714 | 75218, 105722, 136226, 166730, 197234 | 6362 | ADX99617 | 20393 | 50897 | 81401, 111905, 142409, 172913, 203417 |
| 180 | AAX76766 | 14211 | 44715 | 75219, 105723, 136227, 166731, 197235 | 6363 | ADX99628 | 20394 | 50898 | 81402, 111906, 142410, 172914, 203418 |
| 181 | AAY18089 | 14212 | 44716 | 75220, 105724, 136228, 166732, 197236 | 6364 | ADX99639 | 20395 | 50899 | 81403, 111907, 142411, 172915, 203419 |
| 182 | AAY18099 | 14213 | 44717 | 75221, 105725, 136229, 166733, 197237 | 6365 | ADX99650 | 20396 | 50900 | 81404, 111908, 142412, 172916, 203420 |
| 183 | AAY18109 | 14214 | 44718 | 75222, 105726, 136230, 166734, 197238 | 6366 | ADX99672 | 20397 | 50901 | 81405, 111909, 142413, 172917, 203421 |
| 184 | AAY18119 | 14215 | 44719 | 75223, 105727, 136231, 166735, 197239 | 6367 | ADX99683 | 20398 | 50902 | 81406, 111910, 142414, 172918, 203422 |
| 185 | AAY18129 | 14216 | 44720 | 75224, 105728, 136232, 166736, 197240 | 6368 | ADX99694 | 20399 | 50903 | 81407, 111911, 142415, 172919, 203423 |
| 186 | AAY18139 | 14217 | 44721 | 75225, 105729, 136233, 166737, 197241 | 6369 | ADX99705 | 20400 | 50904 | 81408, 111912, 142416, 172920, 203424 |
| 187 | AAY18149 | 14218 | 44722 | 75226, 105730, 136234, 166738, 197242 | 6370 | ADX99846 | 20401 | 50905 | 81409, 111913, 142417, 172921, 203425 |
| 188 | AAY18159 | 14219 | 44723 | 75227, 105731, 136235, 166739, 197243 | 6371 | ADX99857 | 20402 | 50906 | 81410, 111914, 142418, 172922, 203426 |
| 189 | AAY18179 | 14220 | 44724 | 75228, 105732, 136236, 166740, 197244 | 6372 | ADX99868 | 20403 | 50907 | 81411, 111915, 142419, 172923, 203427 |
| 190 | AAY18189 | 14221 | 44725 | 75229, 105733, 136237, 166741, 197245 | 6373 | ADX99879 | 20404 | 50908 | 81412, 111916, 142420, 172924, 203428 |
| 191 | AAY18199 | 14222 | 44726 | 75230, 105734, 136238, 166742, 197246 | 6374 | ADX99890 | 20405 | 50909 | 81413, 111917, 142421, 172925, 203429 |

FIG. 3 continued

| | | | | | | | | | |
|---|---|---|---|---|---|---|---|---|---|
| 192 | AAY18588 | 14223 | 44727 | 75231, 105735, 136239, 166743, 197247 | 6375 | ADX99901 | 20406 | 50910 | 81414, 111918, 142422, 172926, 203430 |
| 193 | AAY18614 | 14224 | 44728 | 75232, 105736, 136240, 166744, 197248 | 6376 | ADX99912 | 20407 | 50911 | 81415, 111919, 142423, 172927, 203431 |
| 194 | AAY27846 | 14225 | 44729 | 75233, 105737, 136241, 166745, 197249 | 6377 | ADX99923 | 20408 | 50912 | 81416, 111920, 142424, 172928, 203432 |
| 195 | AAY27856 | 14226 | 44730 | 75234, 105738, 136242, 166746, 197250 | 6378 | ADX99934 | 20409 | 50913 | 81417, 111921, 142425, 172929, 203433 |
| 196 | AAY27866 | 14227 | 44731 | 75235, 105739, 136243, 166747, 197251 | 6379 | ADX99956 | 20410 | 50914 | 81418, 111922, 142426, 172930, 203434 |
| 197 | AAY27962 | 14228 | 44732 | 75236, 105740, 136244, 166748, 197252 | 6380 | ADX99967 | 20411 | 50915 | 81419, 111923, 142427, 172931, 203435 |
| 198 | AAY27997 | 14229 | 44733 | 75237, 105741, 136245, 166749, 197253 | 6381 | ADX99978 | 20412 | 50916 | 81420, 111924, 142428, 172932, 203436 |
| 199 | AAY28007 | 14230 | 44734 | 75238, 105742, 136246, 166750, 197254 | 6382 | ADX99989 | 20413 | 50917 | 81421, 111925, 142429, 172933, 203437 |
| 200 | AAY28017 | 14231 | 44735 | 75239, 105743, 136247, 166751, 197255 | 6383 | ADY00001 | 20414 | 50918 | 81422, 111926, 142430, 172934, 203438 |
| 201 | AAY28268 | 14232 | 44736 | 75240, 105744, 136248, 166752, 197256 | 6384 | ADY00012 | 20415 | 50919 | 81423, 111927, 142431, 172935, 203439 |
| 202 | AAY28278 | 14233 | 44737 | 75241, 105745, 136249, 166753, 197257 | 6385 | ADY00023 | 20416 | 50920 | 81424, 111928, 142432, 172936, 203440 |
| 203 | AAY28288 | 14234 | 44738 | 75242, 105746, 136250, 166754, 197258 | 6386 | ADY04729 | 20417 | 50921 | 81425, 111929, 142433, 172937, 203441 |
| 204 | AAY28298 | 14235 | 44739 | 75243, 105747, 136251, 166755, 197259 | 6387 | ADY11828 | 20418 | 50922 | 81426, 111930, 142434, 172938, 203442 |
| 205 | AAY28308 | 14236 | 44740 | 75244, 105748, 136252, 166756, 197260 | 6388 | ADY11839 | 20419 | 50923 | 81427, 111931, 142435, 172939, 203443 |
| 206 | AAY28318 | 14237 | 44741 | 75245, 105749, 136253, 166757, 197261 | 6389 | ADY17657 | 20420 | 50924 | 81428, 111932, 142436, 172940, 203444 |
| 207 | AAY28338 | 14238 | 44742 | 75246, 105750, 136254, 166758, 197262 | 6390 | ADY17668 | 20421 | 50925 | 81429, 111933, 142437, 172941, 203445 |
| 208 | AAY28348 | 14239 | 44743 | 75247, 105751, 136255, 166759, 197263 | 6391 | ADY17679 | 20422 | 50926 | 81430, 111934, 142438, 172942, 203446 |
| 209 | AAY28358 | 14240 | 44744 | 75248, 105752, 136256, 166760, 197264 | 6392 | ADY17690 | 20423 | 50927 | 81431, 111935, 142439, 172943, 203447 |

FIG. 3 continued

| | | | | | | | | | |
|---|---|---|---|---|---|---|---|---|---|
| 210 | AAY28388 | 14241 | 44745 | 75249, 105753, 136257, 166761, 197265 | 6393 | ADY17701 | 20424 | 50928 | 81432, 111936, 142440, 172944, 203448 |
| 211 | AAY28398 | 14242 | 44746 | 75250, 105754, 136258, 166762, 197266 | 6394 | ADY38722 | 20425 | 50929 | 81433, 111937, 142441, 172945, 203449 |
| 212 | AAY28408 | 14243 | 44747 | 75251, 105755, 136259, 166763, 197267 | 6395 | ADY38723 | 20426 | 50930 | 81434, 111938, 142442, 172946, 203450 |
| 213 | AAY28505 | 14244 | 44748 | 75252, 105756, 136260, 166764, 197268 | 6396 | ADY38734 | 20427 | 50931 | 81435, 111939, 142443, 172947, 203451 |
| 214 | AAY28524 | 14245 | 44749 | 75253, 105757, 136261, 166765, 197269 | 6397 | ADY38753 | 20428 | 50932 | 81436, 111940, 142444, 172948, 203452 |
| 215 | AAY28534 | 14246 | 44750 | 75254, 105758, 136262, 166766, 197270 | 6398 | ADY38763 | 20429 | 50933 | 81437, 111941, 142445, 172949, 203453 |
| 216 | AAY28544 | 14247 | 44751 | 75255, 105759, 136263, 166767, 197271 | 6399 | ADZ04600 | 20430 | 50934 | 81438, 111942, 142446, 172950, 203454 |
| 217 | AAY28554 | 14248 | 44752 | 75256, 105760, 136264, 166768, 197272 | 6400 | ADZ04610 | 20431 | 50935 | 81439, 111943, 142447, 172951, 203455 |
| 218 | AAY28564 | 14249 | 44753 | 75257, 105761, 136265, 166769, 197273 | 6401 | ADZ04693 | 20432 | 50936 | 81440, 111944, 142448, 172952, 203456 |
| 219 | AAY28574 | 14250 | 44754 | 75258, 105762, 136266, 166770, 197274 | 6402 | ADZ04701 | 20433 | 50937 | 81441, 111945, 142449, 172953, 203457 |
| 220 | AAY28584 | 14251 | 44755 | 75259, 105763, 136267, 166771, 197275 | 6403 | ADZ04711 | 20434 | 50938 | 81442, 111946, 142450, 172954, 203458 |
| 221 | AAY28594 | 14252 | 44756 | 75260, 105764, 136268, 166772, 197276 | 6404 | ADZ05393 | 20435 | 50939 | 81443, 111947, 142451, 172955, 203459 |
| 222 | AAY28611 | 14253 | 44757 | 75261, 105765, 136269, 166773, 197277 | 6405 | ADZ05837 | 20436 | 50940 | 81444, 111948, 142452, 172956, 203460 |
| 223 | AAY28651 | 14254 | 44758 | 75262, 105766, 136270, 166774, 197278 | 6406 | ADZ05848 | 20437 | 50941 | 81445, 111949, 142453, 172957, 203461 |
| 224 | AAY44613 | 14255 | 44759 | 75263, 105767, 136271, 166775, 197279 | 6407 | ADZ05858 | 20438 | 50942 | 81446, 111950, 142454, 172958, 203462 |
| 225 | AAY44624 | 14256 | 44760 | 75264, 105768, 136272, 166776, 197280 | 6408 | ADZ47841 | 20439 | 50943 | 81447, 111951, 142455, 172959, 203463 |
| 226 | AAY44634 | 14257 | 44761 | 75265, 105769, 136273, 166777, 197281 | 6409 | ADZ47851 | 20440 | 50944 | 81448, 111952, 142456, 172960, 203464 |
| 227 | AAY44644 | 14258 | 44762 | 75266, 105770, 136274, 166778, 197282 | 6410 | ADZ47861 | 20441 | 50945 | 81449, 111953, 142457, 172961, 203465 |

FIG. 3 continued

| | | | | | | | | | |
|---|---|---|---|---|---|---|---|---|---|
| 228 | AAY44654 | 14259 | 44763 | 75267, 105771, 136275, 166779, 197283 | 6411 | ADZ53101 | 20442 | 50946 | 81450, 111954, 142458, 172962, 203466 |
| 229 | AAY44758 | 14260 | 44764 | 75268, 105772, 136276, 166780, 197284 | 6412 | ADZ53124 | 20443 | 50947 | 81451, 111955, 142459, 172963, 203467 |
| 230 | AAY44778 | 14261 | 44765 | 75269, 105773, 136277, 166781, 197285 | 6413 | ADZ53130 | 20444 | 50948 | 81452, 111956, 142460, 172964, 203468 |
| 231 | AAY44788 | 14262 | 44766 | 75270, 105774, 136278, 166782, 197286 | 6414 | ADZ53132 | 20445 | 50949 | 81453, 111957, 142461, 172965, 203469 |
| 232 | AAY44909 | 14263 | 44767 | 75271, 105775, 136279, 166783, 197287 | 6415 | ADZ53134 | 20446 | 50950 | 81454, 111958, 142462, 172966, 203470 |
| 233 | AAY45649 | 14264 | 44768 | 75272, 105776, 136280, 166784, 197288 | 6416 | ADZ53136 | 20447 | 50951 | 81455, 111959, 142463, 172967, 203471 |
| 234 | AAY46374 | 14265 | 44769 | 75273, 105777, 136281, 166785, 197289 | 6417 | ADZ53137 | 20448 | 50952 | 81456, 111960, 142464, 172968, 203472 |
| 235 | AAY46384 | 14266 | 44770 | 75274, 105778, 136282, 166786, 197290 | 6418 | ADZ53139 | 20449 | 50953 | 81457, 111961, 142465, 172969, 203473 |
| 236 | AAY46394 | 14267 | 44771 | 75275, 105779, 136283, 166787, 197291 | 6419 | ADZ53141 | 20450 | 50954 | 81458, 111962, 142466, 172970, 203474 |
| 237 | AAY46419 | 14268 | 44772 | 75276, 105780, 136284, 166788, 197292 | 6420 | AEA03712 | 20451 | 50955 | 81459, 111963, 142467, 172971, 203475 |
| 238 | AAY47016 | 14269 | 44773 | 75277, 105781, 136285, 166789, 197293 | 6421 | AEA03722 | 20452 | 50956 | 81460, 111964, 142468, 172972, 203476 |
| 239 | AAY47055 | 14270 | 44774 | 75278, 105782, 136286, 166790, 197294 | 6422 | AEA03744 | 20453 | 50957 | 81461, 111965, 142469, 172973, 203477 |
| 240 | AAY47078 | 14271 | 44775 | 75279, 105783, 136287, 166791, 197295 | 6423 | AEA03755 | 20454 | 50958 | 81462, 111966, 142470, 172974, 203478 |
| 241 | AAY47088 | 14272 | 44776 | 75280, 105784, 136288, 166792, 197296 | 6424 | AEA03766 | 20455 | 50959 | 81463, 111967, 142471, 172975, 203479 |
| 242 | AAY58319 | 14273 | 44777 | 75281, 105785, 136289, 166793, 197297 | 6425 | AEA03796 | 20456 | 50960 | 81464, 111968, 142472, 172976, 203480 |
| 243 | AAY59038 | 14274 | 44778 | 75282, 105786, 136290, 166794, 197298 | 6426 | AEA03806 | 20457 | 50961 | 81465, 111969, 142473, 172977, 203481 |
| 244 | AAY64195 | 14275 | 44779 | 75283, 105787, 136291, 166795, 197299 | 6427 | AEA03817 | 20458 | 50962 | 81466, 111970, 142474, 172978, 203482 |
| 245 | AAY64205 | 14276 | 44780 | 75284, 105788, 136292, 166796, 197300 | 6428 | AEA03828 | 20459 | 50963 | 81467, 111971, 142475, 172979, 203483 |

FIG. 3 continued

| | | | | | | | | | |
|---|---|---|---|---|---|---|---|---|---|
| 246 | AAY64215 | 14277 | 44781 | 75285, 105789, 136293, 166797, 197301 | 6429 | AEA03838 | 20460 | 50964 | 81468, 111972, 142476, 172980, 203484 |
| 247 | AAY64225 | 14278 | 44782 | 75286, 105790, 136294, 166798, 197302 | 6430 | AEA03849 | 20461 | 50965 | 81469, 111973, 142477, 172981, 203485 |
| 248 | AAY64245 | 14279 | 44783 | 75287, 105791, 136295, 166799, 197303 | 6431 | AEA03860 | 20462 | 50966 | 81470, 111974, 142478, 172982, 203486 |
| 249 | AAY64255 | 14280 | 44784 | 75288, 105792, 136296, 166800, 197304 | 6432 | AEA03871 | 20463 | 50967 | 81471, 111975, 142479, 172983, 203487 |
| 250 | AAY64265 | 14281 | 44785 | 75289, 105793, 136297, 166801, 197305 | 6433 | AEA03879 | 20464 | 50968 | 81472, 111976, 142480, 172984, 203488 |
| 251 | AAY64285 | 14282 | 44786 | 75290, 105794, 136298, 166802, 197306 | 6434 | AEA03889 | 20465 | 50969 | 81473, 111977, 142481, 172985, 203489 |
| 252 | AAY64295 | 14283 | 44787 | 75291, 105795, 136299, 166803, 197307 | 6435 | AEA03898 | 20466 | 50970 | 81474, 111978, 142482, 172986, 203490 |
| 253 | AAY64305 | 14284 | 44788 | 75292, 105796, 136300, 166804, 197308 | 6436 | AEA03909 | 20467 | 50971 | 81475, 111979, 142483, 172987, 203491 |
| 254 | AAY64335 | 14285 | 44789 | 75293, 105797, 136301, 166805, 197309 | 6437 | AEA03924 | 20468 | 50972 | 81476, 111980, 142484, 172988, 203492 |
| 255 | AAY64365 | 14286 | 44790 | 75294, 105798, 136302, 166806, 197310 | 6438 | AEA03935 | 20469 | 50973 | 81477, 111981, 142485, 172989, 203493 |
| 256 | AAY64385 | 14287 | 44791 | 75295, 105799, 136303, 166807, 197311 | 6439 | AEA03946 | 20470 | 50974 | 81478, 111982, 142486, 172990, 203494 |
| 257 | AAY64395 | 14288 | 44792 | 75296, 105800, 136304, 166808, 197312 | 6440 | AEA03957 | 20471 | 50975 | 81479, 111983, 142487, 172991, 203495 |
| 258 | AAY64405 | 14289 | 44793 | 75297, 105801, 136305, 166809, 197313 | 6441 | AEA03989 | 20472 | 50976 | 81480, 111984, 142488, 172992, 203496 |
| 259 | AAY98040 | 14290 | 44794 | 75298, 105802, 136306, 166810, 197314 | 6442 | AEA04000 | 20473 | 50977 | 81481, 111985, 142489, 172993, 203497 |
| 260 | AAY98050 | 14291 | 44795 | 75299, 105803, 136307, 166811, 197315 | 6443 | AEA04011 | 20474 | 50978 | 81482, 111986, 142490, 172994, 203498 |
| 261 | AAY98060 | 14292 | 44796 | 75300, 105804, 136308, 166812, 197316 | 6444 | AEA04022 | 20475 | 50979 | 81483, 111987, 142491, 172995, 203499 |
| 262 | AAY98070 | 14293 | 44797 | 75301, 105805, 136309, 166813, 197317 | 6445 | AEA04033 | 20476 | 50980 | 81484, 111988, 142492, 172996, 203500 |
| 263 | AAY98080 | 14294 | 44798 | 75302, 105806, 136310, 166814, 197318 | 6446 | AEA04044 | 20477 | 50981 | 81485, 111989, 142493, 172997, 203501 |

FIG. 3 continued

| | | | | | | | | | |
|---|---|---|---|---|---|---|---|---|---|
| 264 | AAY98090 | 14295 | 44799 | 75303, 105807, 136311, 166815, 197319 | 6447 | AEA04049 | 20478 | 50982 | 81486, 111990, 142494, 172998, 203502 |
| 265 | AAY98100 | 14296 | 44800 | 75304, 105808, 136312, 166816, 197320 | 6448 | AEA04059 | 20479 | 50983 | 81487, 111991, 142495, 172999, 203503 |
| 266 | AAY98110 | 14297 | 44801 | 75305, 105809, 136313, 166817, 197321 | 6449 | AEA04070 | 20480 | 50984 | 81488, 111992, 142496, 173000, 203504 |
| 267 | AAY98120 | 14298 | 44802 | 75306, 105810, 136314, 166818, 197322 | 6450 | AEA04081 | 20481 | 50985 | 81489, 111993, 142497, 173001, 203505 |
| 268 | AAY98130 | 14299 | 44803 | 75307, 105811, 136315, 166819, 197323 | 6451 | AEA04092 | 20482 | 50986 | 81490, 111994, 142498, 173002, 203506 |
| 269 | AAY98150 | 14300 | 44804 | 75308, 105812, 136316, 166820, 197324 | 6452 | AEA04103 | 20483 | 50987 | 81491, 111995, 142499, 173003, 203507 |
| 270 | AAY98160 | 14301 | 44805 | 75309, 105813, 136317, 166821, 197325 | 6453 | AEA04125 | 20484 | 50988 | 81492, 111996, 142500, 173004, 203508 |
| 271 | AAY98170 | 14302 | 44806 | 75310, 105814, 136318, 166822, 197326 | 6454 | AEA04133 | 20485 | 50989 | 81493, 111997, 142501, 173005, 203509 |
| 272 | AAY98180 | 14303 | 44807 | 75311, 105815, 136319, 166823, 197327 | 6455 | AEA04144 | 20486 | 50990 | 81494, 111998, 142502, 173006, 203510 |
| 273 | AAY98200 | 14304 | 44808 | 75312, 105816, 136320, 166824, 197328 | 6456 | AEA04155 | 20487 | 50991 | 81495, 111999, 142503, 173007, 203511 |
| 274 | AAY98210 | 14305 | 44809 | 75313, 105817, 136321, 166825, 197329 | 6457 | AEA04166 | 20488 | 50992 | 81496, 112000, 142504, 173008, 203512 |
| 275 | AAY98220 | 14306 | 44810 | 75314, 105818, 136322, 166826, 197330 | 6458 | AEA04177 | 20489 | 50993 | 81497, 112001, 142505, 173009, 203513 |
| 276 | AAY98230 | 14307 | 44811 | 75315, 105819, 136323, 166827, 197331 | 6459 | AEA04188 | 20490 | 50994 | 81498, 112002, 142506, 173010, 203514 |
| 277 | AAY98250 | 14308 | 44812 | 75316, 105820, 136324, 166828, 197332 | 6460 | AEA04199 | 20491 | 50995 | 81499, 112003, 142507, 173011, 203515 |
| 278 | AAY98322 | 14309 | 44813 | 75317, 105821, 136325, 166829, 197333 | 6461 | AEA04210 | 20492 | 50996 | 81500, 112004, 142508, 173012, 203516 |
| 279 | AAY98332 | 14310 | 44814 | 75318, 105822, 136326, 166830, 197334 | 6462 | AEA04229 | 20493 | 50997 | 81501, 112005, 142509, 173013, 203517 |
| 280 | AAY98342 | 14311 | 44815 | 75319, 105823, 136327, 166831, 197335 | 6463 | AEA04239 | 20494 | 50998 | 81502, 112006, 142510, 173014, 203518 |
| 281 | AAY98359 | 14312 | 44816 | 75320, 105824, 136328, 166832, 197336 | 6464 | AEA04250 | 20495 | 50999 | 81503, 112007, 142511, 173015, 203519 |

FIG. 3 continued

| | | | | | | | | | |
|---|---|---|---|---|---|---|---|---|---|
| 282 | AAY98369 | 14313 | 44817 | 75321, 105825, 136329, 166833, 197337 | 6465 | AEA04260 | 20496 | 51000 | 81504, 112008, 142512, 173016, 203520 |
| 283 | AAY98379 | 14314 | 44818 | 75322, 105826, 136330, 166834, 197338 | 6466 | AEA04268 | 20497 | 51001 | 81505, 112009, 142513, 173017, 203521 |
| 284 | AAY98389 | 14315 | 44819 | 75323, 105827, 136331, 166835, 197339 | 6467 | AEA04276 | 20498 | 51002 | 81506, 112010, 142514, 173018, 203522 |
| 285 | AAY98399 | 14316 | 44820 | 75324, 105828, 136332, 166836, 197340 | 6468 | AEA04287 | 20499 | 51003 | 81507, 112011, 142515, 173019, 203523 |
| 286 | AAY98409 | 14317 | 44821 | 75325, 105829, 136333, 166837, 197341 | 6469 | AEA04298 | 20500 | 51004 | 81508, 112012, 142516, 173020, 203524 |
| 287 | AAY98773 | 14318 | 44822 | 75326, 105830, 136334, 166838, 197342 | 6470 | AEA04307 | 20501 | 51005 | 81509, 112013, 142517, 173021, 203525 |
| 288 | AAZ32955 | 14319 | 44823 | 75327, 105831, 136335, 166839, 197343 | 6471 | AEA04357 | 20502 | 51006 | 81510, 112014, 142518, 173022, 203526 |
| 289 | AAZ32957 | 14320 | 44824 | 75328, 105832, 136336, 166840, 197344 | 6472 | AEA04368 | 20503 | 51007 | 81511, 112015, 142519, 173023, 203527 |
| 290 | AAZ32958 | 14321 | 44825 | 75329, 105833, 136337, 166841, 197345 | 6473 | AEA04379 | 20504 | 51008 | 81512, 112016, 142520, 173024, 203528 |
| 291 | AAZ32959 | 14322 | 44826 | 75330, 105834, 136338, 166842, 197346 | 6474 | AEA10295 | 20505 | 51009 | 81513, 112017, 142521, 173025, 203529 |
| 292 | AAZ38465 | 14323 | 44827 | 75331, 105835, 136339, 166843, 197347 | 6475 | AEA10306 | 20506 | 51010 | 81514, 112018, 142522, 173026, 203530 |
| 293 | AAZ38476 | 14324 | 44828 | 75332, 105836, 136340, 166844, 197348 | 6476 | AEA10316 | 20507 | 51011 | 81515, 112019, 142523, 173027, 203531 |
| 294 | AAZ38487 | 14325 | 44829 | 75333, 105837, 136341, 166845, 197349 | 6477 | AEA10326 | 20508 | 51012 | 81516, 112020, 142524, 173028, 203532 |
| 295 | AAZ38509 | 14326 | 44830 | 75334, 105838, 136342, 166846, 197350 | 6478 | AEA10335 | 20509 | 51013 | 81517, 112021, 142525, 173029, 203533 |
| 296 | AAZ38586 | 14327 | 44831 | 75335, 105839, 136343, 166847, 197351 | 6479 | AEA10342 | 20510 | 51014 | 81518, 112022, 142526, 173030, 203534 |
| 297 | AAZ38597 | 14328 | 44832 | 75336, 105840, 136344, 166848, 197352 | 6480 | AEA10352 | 20511 | 51015 | 81519, 112023, 142527, 173031, 203535 |
| 298 | AAZ38608 | 14329 | 44833 | 75337, 105841, 136345, 166849, 197353 | 6481 | AEA48991 | 20512 | 51016 | 81520, 112024, 142528, 173032, 203536 |
| 299 | AAZ38619 | 14330 | 44834 | 75338, 105842, 136346, 166850, 197354 | 6482 | AEA72707 | 20513 | 51017 | 81521, 112025, 142529, 173033, 203537 |

FIG. 3 continued

| | | | | | | | | | |
|---|---|---|---|---|---|---|---|---|---|
| 300 | AAZ38641 | 14331 | 44835 | 75339, 105843, 136347, 166851, 197355 | 6483 | AEA72718 | 20514 | 51018 | 81522, 112026, 142530, 173034, 203538 |
| 301 | AAZ38653 | 14332 | 44836 | 75340, 105844, 136348, 166852, 197356 | 6484 | AEA72729 | 20515 | 51019 | 81523, 112027, 142531, 173035, 203539 |
| 302 | AAZ43386 | 14333 | 44837 | 75341, 105845, 136349, 166853, 197357 | 6485 | AEA72742 | 20516 | 51020 | 81524, 112028, 142532, 173036, 203540 |
| 303 | AAZ43397 | 14334 | 44838 | 75342, 105846, 136350, 166854, 197358 | 6486 | AEA72779 | 20517 | 51021 | 81525, 112029, 142533, 173037, 203541 |
| 304 | AAZ43408 | 14335 | 44839 | 75343, 105847, 136351, 166855, 197359 | 6487 | AEA72789 | 20518 | 51022 | 81526, 112030, 142534, 173038, 203542 |
| 305 | AAZ74355 | 14336 | 44840 | 75344, 105848, 136352, 166856, 197360 | 6488 | AEA73291 | 20519 | 51023 | 81527, 112031, 142535, 173039, 203543 |
| 306 | AAZ74366 | 14337 | 44841 | 75345, 105849, 136353, 166857, 197361 | 6489 | AEA73302 | 20520 | 51024 | 81528, 112032, 142536, 173040, 203544 |
| 307 | AAZ74377 | 14338 | 44842 | 75346, 105850, 136354, 166858, 197362 | 6490 | AEA73313 | 20521 | 51025 | 81529, 112033, 142537, 173041, 203545 |
| 308 | AAZ74400 | 14339 | 44843 | 75347, 105851, 136355, 166859, 197363 | 6491 | AEA73324 | 20522 | 51026 | 81530, 112034, 142538, 173042, 203546 |
| 309 | AAZ74411 | 14340 | 44844 | 75348, 105852, 136356, 166860, 197364 | 6492 | AEA73335 | 20523 | 51027 | 81531, 112035, 142539, 173043, 203547 |
| 310 | AAZ74422 | 14341 | 44845 | 75349, 105853, 136357, 166861, 197365 | 6493 | AEA73346 | 20524 | 51028 | 81532, 112036, 142540, 173044, 203548 |
| 311 | AAZ74444 | 14342 | 44846 | 75350, 105854, 136358, 166862, 197366 | 6494 | AEA73357 | 20525 | 51029 | 81533, 112037, 142541, 173045, 203549 |
| 312 | AAZ74455 | 14343 | 44847 | 75351, 105855, 136359, 166863, 197367 | 6495 | AEA73368 | 20526 | 51030 | 81534, 112038, 142542, 173046, 203550 |
| 313 | AAZ74477 | 14344 | 44848 | 75352, 105856, 136360, 166864, 197368 | 6496 | AEA73379 | 20527 | 51031 | 81535, 112039, 142543, 173047, 203551 |
| 314 | AAZ74488 | 14345 | 44849 | 75353, 105857, 136361, 166865, 197369 | 6497 | AEA73390 | 20528 | 51032 | 81536, 112040, 142544, 173048, 203552 |
| 315 | AAZ74499 | 14346 | 44850 | 75354, 105858, 136362, 166866, 197370 | 6498 | AEA73401 | 20529 | 51033 | 81537, 112041, 142545, 173049, 203553 |
| 316 | AAZ74510 | 14347 | 44851 | 75355, 105859, 136363, 166867, 197371 | 6499 | AEA73412 | 20530 | 51034 | 81538, 112042, 142546, 173050, 203554 |
| 317 | AAZ74521 | 14348 | 44852 | 75356, 105860, 136364, 166868, 197372 | 6500 | AEA73423 | 20531 | 51035 | 81539, 112043, 142547, 173051, 203555 |

FIG. 3 continued

| | | | | | | | | | |
|---|---|---|---|---|---|---|---|---|---|
| 318 | AAZ74532 | 14349 | 44853 | 75357, 105861, 136365, 166869, 197373 | 6501 | AEA73455 | 20532 | 51036 | 81540, 112044, 142548, 173052, 203556 |
| 319 | AAZ74543 | 14350 | 44854 | 75358, 105862, 136366, 166870, 197374 | 6502 | AEA73466 | 20533 | 51037 | 81541, 112045, 142549, 173053, 203557 |
| 320 | AAZ74565 | 14351 | 44855 | 75359, 105863, 136367, 166871, 197375 | 6503 | AEA73477 | 20534 | 51038 | 81542, 112046, 142550, 173054, 203558 |
| 321 | AAZ74598 | 14352 | 44856 | 75360, 105864, 136368, 166872, 197376 | 6504 | AEA73488 | 20535 | 51039 | 81543, 112047, 142551, 173055, 203559 |
| 322 | AAZ74609 | 14353 | 44857 | 75361, 105865, 136369, 166873, 197377 | 6505 | AEA73499 | 20536 | 51040 | 81544, 112048, 142552, 173056, 203560 |
| 323 | AAZ74620 | 14354 | 44858 | 75362, 105866, 136370, 166874, 197378 | 6506 | AEA73510 | 20537 | 51041 | 81545, 112049, 142553, 173057, 203561 |
| 324 | AAZ79508 | 14355 | 44859 | 75363, 105867, 136371, 166875, 197379 | 6507 | AEA73521 | 20538 | 51042 | 81546, 112050, 142554, 173058, 203562 |
| 325 | AAZ79519 | 14356 | 44860 | 75364, 105868, 136372, 166876, 197380 | 6508 | AEA73532 | 20539 | 51043 | 81547, 112051, 142555, 173059, 203563 |
| 326 | AAZ79530 | 14357 | 44861 | 75365, 105869, 136373, 166877, 197381 | 6509 | AEA73543 | 20540 | 51044 | 81548, 112052, 142556, 173060, 203564 |
| 327 | AAZ79552 | 14358 | 44862 | 75366, 105870, 136374, 166878, 197382 | 6510 | AEA73554 | 20541 | 51045 | 81549, 112053, 142557, 173061, 203565 |
| 328 | AAZ79563 | 14359 | 44863 | 75367, 105871, 136375, 166879, 197383 | 6511 | AEA73565 | 20542 | 51046 | 81550, 112054, 142558, 173062, 203566 |
| 329 | AAZ79574 | 14360 | 44864 | 75368, 105872, 136376, 166880, 197384 | 6512 | AEA73576 | 20543 | 51047 | 81551, 112055, 142559, 173063, 203567 |
| 330 | AAZ79585 | 14361 | 44865 | 75369, 105873, 136377, 166881, 197385 | 6513 | AEA73587 | 20544 | 51048 | 81552, 112056, 142560, 173064, 203568 |
| 331 | AAZ79618 | 14362 | 44866 | 75370, 105874, 136378, 166882, 197386 | 6514 | AEA73598 | 20545 | 51049 | 81553, 112057, 142561, 173065, 203569 |
| 332 | AAZ79633 | 14363 | 44867 | 75371, 105875, 136379, 166883, 197387 | 6515 | AEA73609 | 20546 | 51050 | 81554, 112058, 142562, 173066, 203570 |
| 333 | AAZ79945 | 14364 | 44868 | 75372, 105876, 136380, 166884, 197388 | 6516 | AEA73620 | 20547 | 51051 | 81555, 112059, 142563, 173067, 203571 |
| 334 | AAZ79966 | 14365 | 44869 | 75373, 105877, 136381, 166885, 197389 | 6517 | AEA73631 | 20548 | 51052 | 81556, 112060, 142564, 173068, 203572 |
| 335 | AAZ79977 | 14366 | 44870 | 75374, 105878, 136382, 166886, 197390 | 6518 | AEA73642 | 20549 | 51053 | 81557, 112061, 142565, 173069, 203573 |

FIG. 3 continued

| | | | | | | | | | |
|---|---|---|---|---|---|---|---|---|---|
| 336 | AAZ79988 | 14367 | 44871 | 75375, 105879, 136383, 166887, 197391 | 6519 | AEA73653 | 20550 | 51054 | 81558, 112062, 142566, 173070, 203574 |
| 337 | AAZ79999 | 14368 | 44872 | 75376, 105880, 136384, 166888, 197392 | 6520 | AEA73664 | 20551 | 51055 | 81559, 112063, 142567, 173071, 203575 |
| 338 | AAZ80010 | 14369 | 44873 | 75377, 105881, 136385, 166889, 197393 | 6521 | AEA73675 | 20552 | 51056 | 81560, 112064, 142568, 173072, 203576 |
| 339 | AAZ80021 | 14370 | 44874 | 75378, 105882, 136386, 166890, 197394 | 6522 | AEA73686 | 20553 | 51057 | 81561, 112065, 142569, 173073, 203577 |
| 340 | AAZ83245 | 14371 | 44875 | 75379, 105883, 136387, 166891, 197395 | 6523 | AEA73697 | 20554 | 51058 | 81562, 112066, 142570, 173074, 203578 |
| 341 | AAZ83256 | 14372 | 44876 | 75380, 105884, 136388, 166892, 197396 | 6524 | AEA73708 | 20555 | 51059 | 81563, 112067, 142571, 173075, 203579 |
| 342 | AAZ83269 | 14373 | 44877 | 75381, 105885, 136389, 166893, 197397 | 6525 | AEA73719 | 20556 | 51060 | 81564, 112068, 142572, 173076, 203580 |
| 343 | AAZ83280 | 14374 | 44878 | 75382, 105886, 136390, 166894, 197398 | 6526 | AEA73730 | 20557 | 51061 | 81565, 112069, 142573, 173077, 203581 |
| 344 | AAZ83291 | 14375 | 44879 | 75383, 105887, 136391, 166895, 197399 | 6527 | AEA73741 | 20558 | 51062 | 81566, 112070, 142574, 173078, 203582 |
| 345 | AAZ83302 | 14376 | 44880 | 75384, 105888, 136392, 166896, 197400 | 6528 | AEA73752 | 20559 | 51063 | 81567, 112071, 142575, 173079, 203583 |
| 346 | AAZ83315 | 14377 | 44881 | 75385, 105889, 136393, 166897, 197401 | 6529 | AEA73763 | 20560 | 51064 | 81568, 112072, 142576, 173080, 203584 |
| 347 | AAZ83326 | 14378 | 44882 | 75386, 105890, 136394, 166898, 197402 | 6530 | AEA73774 | 20561 | 51065 | 81569, 112073, 142577, 173081, 203585 |
| 348 | AAZ83374 | 14379 | 44883 | 75387, 105891, 136395, 166899, 197403 | 6531 | AEA73784 | 20562 | 51066 | 81570, 112074, 142578, 173082, 203586 |
| 349 | AAZ83385 | 14380 | 44884 | 75388, 105892, 136396, 166900, 197404 | 6532 | AEA73794 | 20563 | 51067 | 81571, 112075, 142579, 173083, 203587 |
| 350 | AAZ85129 | 14381 | 44885 | 75389, 105893, 136397, 166901, 197405 | 6533 | AEA73804 | 20564 | 51068 | 81572, 112076, 142580, 173084, 203588 |
| 351 | ABA06513 | 14382 | 44886 | 75390, 105894, 136398, 166902, 197406 | 6534 | AEA73814 | 20565 | 51069 | 81573, 112077, 142581, 173085, 203589 |
| 352 | ABA06545 | 14383 | 44887 | 75391, 105895, 136399, 166903, 197407 | 6535 | AEA73824 | 20566 | 51070 | 81574, 112078, 142582, 173086, 203590 |
| 353 | ABA08478 | 14384 | 44888 | 75392, 105896, 136400, 166904, 197408 | 6536 | AEA73834 | 20567 | 51071 | 81575, 112079, 142583, 173087, 203591 |

FIG. 3 continued

| | | | | | | | | | |
|---|---|---|---|---|---|---|---|---|---|
| 354 | ABA08511 | 14385 | 44889 | 75393, 105897, 136401, 166905, 197409 | 6537 | AEA73844 | 20568 | 51072 | 81576, 112080, 142584, 173088, 203592 |
| 355 | ABA12699 | 14386 | 44890 | 75394, 105898, 136402, 166906, 197410 | 6538 | AEA73854 | 20569 | 51073 | 81577, 112081, 142585, 173089, 203593 |
| 356 | ABA12710 | 14387 | 44891 | 75395, 105899, 136403, 166907, 197411 | 6539 | AEA73864 | 20570 | 51074 | 81578, 112082, 142586, 173090, 203594 |
| 357 | ABA12721 | 14388 | 44892 | 75396, 105900, 136404, 166908, 197412 | 6540 | AEA73874 | 20571 | 51075 | 81579, 112083, 142587, 173091, 203595 |
| 358 | ABA12732 | 14389 | 44893 | 75397, 105901, 136405, 166909, 197413 | 6541 | AEA73884 | 20572 | 51076 | 81580, 112084, 142588, 173092, 203596 |
| 359 | ABA12743 | 14390 | 44894 | 75398, 105902, 136406, 166910, 197414 | 6542 | AEA73894 | 20573 | 51077 | 81581, 112085, 142589, 173093, 203597 |
| 360 | ABA12754 | 14391 | 44895 | 75399, 105903, 136407, 166911, 197415 | 6543 | AEA73904 | 20574 | 51078 | 81582, 112086, 142590, 173094, 203598 |
| 361 | ABA12765 | 14392 | 44896 | 75400, 105904, 136408, 166912, 197416 | 6544 | AEA73914 | 20575 | 51079 | 81583, 112087, 142591, 173095, 203599 |
| 362 | ABA12776 | 14393 | 44897 | 75401, 105905, 136409, 166913, 197417 | 6545 | AEA73924 | 20576 | 51080 | 81584, 112088, 142592, 173096, 203600 |
| 363 | ABA12786 | 14394 | 44898 | 75402, 105906, 136410, 166914, 197418 | 6546 | AEA73934 | 20577 | 51081 | 81585, 112089, 142593, 173097, 203601 |
| 364 | ABA18029 | 14395 | 44899 | 75403, 105907, 136411, 166915, 197419 | 6547 | AEA73944 | 20578 | 51082 | 81586, 112090, 142594, 173098, 203602 |
| 365 | ABA18040 | 14396 | 44900 | 75404, 105908, 136412, 166916, 197420 | 6548 | AEA73954 | 20579 | 51083 | 81587, 112091, 142595, 173099, 203603 |
| 366 | ABA18126 | 14397 | 44901 | 75405, 105909, 136413, 166917, 197421 | 6549 | AEA73964 | 20580 | 51084 | 81588, 112092, 142596, 173100, 203604 |
| 367 | ABA18148 | 14398 | 44902 | 75406, 105910, 136414, 166918, 197422 | 6550 | AEA73974 | 20581 | 51085 | 81589, 112093, 142597, 173101, 203605 |
| 368 | ABA18159 | 14399 | 44903 | 75407, 105911, 136415, 166919, 197423 | 6551 | AEA73984 | 20582 | 51086 | 81590, 112094, 142598, 173102, 203606 |
| 369 | ABA26703 | 14400 | 44904 | 75408, 105912, 136416, 166920, 197424 | 6552 | AEA73994 | 20583 | 51087 | 81591, 112095, 142599, 173103, 203607 |
| 370 | ABA26714 | 14401 | 44905 | 75409, 105913, 136417, 166921, 197425 | 6553 | AEA74004 | 20584 | 51088 | 81592, 112096, 142600, 173104, 203608 |
| 371 | ABA26736 | 14402 | 44906 | 75410, 105914, 136418, 166922, 197426 | 6554 | AEA74014 | 20585 | 51089 | 81593, 112097, 142601, 173105, 203609 |

FIG. 3 continued

| | | | | | | | | | |
|---|---|---|---|---|---|---|---|---|---|
| 372 | ABA26747 | 14403 | 44907 | 75411, 105915, 136419, 166923, 197427 | 6555 | AEA74024 | 20586 | 51090 | 81594, 112098, 142602, 173106, 203610 |
| 373 | ABA26758 | 14404 | 44908 | 75412, 105916, 136420, 166924, 197428 | 6556 | AEA74032 | 20587 | 51091 | 81595, 112099, 142603, 173107, 203611 |
| 374 | ABA26769 | 14405 | 44909 | 75413, 105917, 136421, 166925, 197429 | 6557 | AEA74034 | 20588 | 51092 | 81596, 112100, 142604, 173108, 203612 |
| 375 | ABA26780 | 14406 | 44910 | 75414, 105918, 136422, 166926, 197430 | 6558 | AEA77302 | 20589 | 51093 | 81597, 112101, 142605, 173109, 203613 |
| 376 | ABA26791 | 14407 | 44911 | 75415, 105919, 136423, 166927, 197431 | 6559 | AEB21318 | 20590 | 51094 | 81598, 112102, 142606, 173110, 203614 |
| 377 | ABA26802 | 14408 | 44912 | 75416, 105920, 136424, 166928, 197432 | 6560 | AEB21328 | 20591 | 51095 | 81599, 112103, 142607, 173111, 203615 |
| 378 | ABA42250 | 14409 | 44913 | 75417, 105921, 136425, 166929, 197433 | 6561 | AEB21340 | 20592 | 51096 | 81600, 112104, 142608, 173112, 203616 |
| 379 | ABA42261 | 14410 | 44914 | 75418, 105922, 136426, 166930, 197434 | 6562 | AEB21350 | 20593 | 51097 | 81601, 112105, 142609, 173113, 203617 |
| 380 | ABA42272 | 14411 | 44915 | 75419, 105923, 136427, 166931, 197435 | 6563 | AEB21360 | 20594 | 51098 | 81602, 112106, 142610, 173114, 203618 |
| 381 | ABA42294 | 14412 | 44916 | 75420, 105924, 136428, 166932, 197436 | 6564 | AEB40209 | 20595 | 51099 | 81603, 112107, 142611, 173115, 203619 |
| 382 | ABA42305 | 14413 | 44917 | 75421, 105925, 136429, 166933, 197437 | 6565 | AEB66898 | 20596 | 51100 | 81604, 112108, 142612, 173116, 203620 |
| 383 | ABA42316 | 14414 | 44918 | 75422, 105926, 136430, 166934, 197438 | 6566 | AEB71103 | 20597 | 51101 | 81605, 112109, 142613, 173117, 203621 |
| 384 | ABA42327 | 14415 | 44919 | 75423, 105927, 136431, 166935, 197439 | 6567 | AEB71899 | 20598 | 51102 | 81606, 112110, 142614, 173118, 203622 |
| 385 | ABA42338 | 14416 | 44920 | 75424, 105928, 136432, 166936, 197440 | 6568 | AEB71910 | 20599 | 51103 | 81607, 112111, 142615, 173119, 203623 |
| 386 | ABA42349 | 14417 | 44921 | 75425, 105929, 136433, 166937, 197441 | 6569 | AEB71919 | 20600 | 51104 | 81608, 112112, 142616, 173120, 203624 |
| 387 | ABA42360 | 14418 | 44922 | 75426, 105930, 136434, 166938, 197442 | 6570 | AEB71928 | 20601 | 51105 | 81609, 112113, 142617, 173121, 203625 |
| 388 | ABA42371 | 14419 | 44923 | 75427, 105931, 136435, 166939, 197443 | 6571 | AEB71939 | 20602 | 51106 | 81610, 112114, 142618, 173122, 203626 |
| 389 | ABA42382 | 14420 | 44924 | 75428, 105932, 136436, 166940, 197444 | 6572 | AEB71950 | 20603 | 51107 | 81611, 112115, 142619, 173123, 203627 |

FIG. 3 continued

| | | | | | | | | | |
|---|---|---|---|---|---|---|---|---|---|
| 390 | ABA42393 | 14421 | 44925 | 75429, 105933, 136437, 166941, 197445 | 6573 | AEB71961 | 20604 | 51108 | 81612, 112116, 142620, 173124, 203628 |
| 391 | ABA42404 | 14422 | 44926 | 75430, 105934, 136438, 166942, 197446 | 6574 | AEB71972 | 20605 | 51109 | 81613, 112117, 142621, 173125, 203629 |
| 392 | ABA42415 | 14423 | 44927 | 75431, 105935, 136439, 166943, 197447 | 6575 | AEB71983 | 20606 | 51110 | 81614, 112118, 142622, 173126, 203630 |
| 393 | ABA42446 | 14424 | 44928 | 75432, 105936, 136440, 166944, 197448 | 6576 | AEB71995 | 20607 | 51111 | 81615, 112119, 142623, 173127, 203631 |
| 394 | ABA42457 | 14425 | 44929 | 75433, 105937, 136441, 166945, 197449 | 6577 | AEC13316 | 20608 | 51112 | 81616, 112120, 142624, 173128, 203632 |
| 395 | ABA42468 | 14426 | 44930 | 75434, 105938, 136442, 166946, 197450 | 6578 | AEC53262 | 20609 | 51113 | 81617, 112121, 142625, 173129, 203633 |
| 396 | ABA42479 | 14427 | 44931 | 75435, 105939, 136443, 166947, 197451 | 6579 | AEC53272 | 20610 | 51114 | 81618, 112122, 142626, 173130, 203634 |
| 397 | ABA42490 | 14428 | 44932 | 75436, 105940, 136444, 166948, 197452 | 6580 | AEC53282 | 20611 | 51115 | 81619, 112123, 142627, 173131, 203635 |
| 398 | ABA42501 | 14429 | 44933 | 75437, 105941, 136445, 166949, 197453 | 6581 | AEC53292 | 20612 | 51116 | 81620, 112124, 142628, 173132, 203636 |
| 399 | ABA42512 | 14430 | 44934 | 75438, 105942, 136446, 166950, 197454 | 6582 | AEC53302 | 20613 | 51117 | 81621, 112125, 142629, 173133, 203637 |
| 400 | ABA42523 | 14431 | 44935 | 75439, 105943, 136447, 166951, 197455 | 6583 | AEC53350 | 20614 | 51118 | 81622, 112126, 142630, 173134, 203638 |
| 401 | ABA42534 | 14432 | 44936 | 75440, 105944, 136448, 166952, 197456 | 6584 | AEC53407 | 20615 | 51119 | 81623, 112127, 142631, 173135, 203639 |
| 402 | ABA42545 | 14433 | 44937 | 75441, 105945, 136449, 166953, 197457 | 6585 | AEC53427 | 20616 | 51120 | 81624, 112128, 142632, 173136, 203640 |
| 403 | ABA42556 | 14434 | 44938 | 75442, 105946, 136450, 166954, 197458 | 6586 | AED99967 | 20617 | 51121 | 81625, 112129, 142633, 173137, 203641 |
| 404 | ABA42567 | 14435 | 44939 | 75443, 105947, 136451, 166955, 197459 | 6587 | AEE27161 | 20618 | 51122 | 81626, 112130, 142634, 173138, 203642 |
| 405 | ABA42931 | 14436 | 44940 | 75444, 105948, 136452, 166956, 197460 | 6588 | AEE27170 | 20619 | 51123 | 81627, 112131, 142635, 173139, 203643 |
| 406 | ABA42942 | 14437 | 44941 | 75445, 105949, 136453, 166957, 197461 | 6589 | AEE27180 | 20620 | 51124 | 81628, 112132, 142636, 173140, 203644 |
| 407 | ABA42981 | 14438 | 44942 | 75446, 105950, 136454, 166958, 197462 | 6590 | AEE27190 | 20621 | 51125 | 81629, 112133, 142637, 173141, 203645 |

FIG. 3 continued

| | | | | | | | | | |
|---|---|---|---|---|---|---|---|---|---|
| 408 | ABA42992 | 14439 | 44943 | 75447, 105951, 136455, 166959, 197463 | 6591 | AEE27200 | 20622 | 51126 | 81630, 112134, 142638, 173142, 203646 |
| 409 | ABA43192 | 14440 | 44944 | 75448, 105952, 136456, 166960, 197464 | 6592 | AEG64755 | 20623 | 51127 | 81631, 112135, 142639, 173143, 203647 |
| 410 | ABA43203 | 14441 | 44945 | 75449, 105953, 136457, 166961, 197465 | 6593 | AEG64765 | 20624 | 51128 | 81632, 112136, 142640, 173144, 203648 |
| 411 | ABA43339 | 14442 | 44946 | 75450, 105954, 136458, 166962, 197466 | 6594 | AEG64787 | 20625 | 51129 | 81633, 112137, 142641, 173145, 203649 |
| 412 | ABA54916 | 14443 | 44947 | 75451, 105955, 136459, 166963, 197467 | 6595 | AEG64837 | 20626 | 51130 | 81634, 112138, 142642, 173146, 203650 |
| 413 | ABA87048 | 14444 | 44948 | 75452, 105956, 136460, 166964, 197468 | 6596 | AEG64848 | 20627 | 51131 | 81635, 112139, 142643, 173147, 203651 |
| 414 | ABA87060 | 14445 | 44949 | 75453, 105957, 136461, 166965, 197469 | 6597 | AEG64859 | 20628 | 51132 | 81636, 112140, 142644, 173148, 203652 |
| 415 | ABA87083 | 14446 | 44950 | 75454, 105958, 136462, 166966, 197470 | 6598 | AEG64870 | 20629 | 51133 | 81637, 112141, 142645, 173149, 203653 |
| 416 | ABA87234 | 14447 | 44951 | 75455, 105959, 136463, 166967, 197471 | 6599 | AEG64881 | 20630 | 51134 | 81638, 112142, 142646, 173150, 203654 |
| 417 | ABB02784 | 14448 | 44952 | 75456, 105960, 136464, 166968, 197472 | 6600 | AEG64892 | 20631 | 51135 | 81639, 112143, 142647, 173151, 203655 |
| 418 | ABB02795 | 14449 | 44953 | 75457, 105961, 136465, 166969, 197473 | 6601 | AEG64914 | 20632 | 51136 | 81640, 112144, 142648, 173152, 203656 |
| 419 | ABB02806 | 14450 | 44954 | 75458, 105962, 136466, 166970, 197474 | 6602 | AEG64925 | 20633 | 51137 | 81641, 112145, 142649, 173153, 203657 |
| 420 | ABB02817 | 14451 | 44955 | 75459, 105963, 136467, 166971, 197475 | 6603 | AEG64936 | 20634 | 51138 | 81642, 112146, 142650, 173154, 203658 |
| 421 | ABB02828 | 14452 | 44956 | 75460, 105964, 136468, 166972, 197476 | 6604 | AEG64947 | 20635 | 51139 | 81643, 112147, 142651, 173155, 203659 |
| 422 | ABB02839 | 14453 | 44957 | 75461, 105965, 136469, 166973, 197477 | 6605 | AEG64958 | 20636 | 51140 | 81644, 112148, 142652, 173156, 203660 |
| 423 | ABB02850 | 14454 | 44958 | 75462, 105966, 136470, 166974, 197478 | 6606 | AEG64969 | 20637 | 51141 | 81645, 112149, 142653, 173157, 203661 |
| 424 | ABB02861 | 14455 | 44959 | 75463, 105967, 136471, 166975, 197479 | 6607 | AEG64980 | 20638 | 51142 | 81646, 112150, 142654, 173158, 203662 |
| 425 | ABB02872 | 14456 | 44960 | 75464, 105968, 136472, 166976, 197480 | 6608 | AEG64991 | 20639 | 51143 | 81647, 112151, 142655, 173159, 203663 |

FIG. 3 continued

| | | | | | | | | | |
|---|---|---|---|---|---|---|---|---|---|
| 426 | ABB02883 | 14457 | 44961 | 75465, 105969, 136473, 166977, 197481 | 6609 | AEG65002 | 20640 | 51144 | 81648, 112152, 142656, 173160, 203664 |
| 427 | ABB02894 | 14458 | 44962 | 75466, 105970, 136474, 166978, 197482 | 6610 | AEG65013 | 20641 | 51145 | 81649, 112153, 142657, 173161, 203665 |
| 428 | ABB02905 | 14459 | 44963 | 75467, 105971, 136475, 166979, 197483 | 6611 | AEG65024 | 20642 | 51146 | 81650, 112154, 142658, 173162, 203666 |
| 429 | ABB02916 | 14460 | 44964 | 75468, 105972, 136476, 166980, 197484 | 6612 | AEG65035 | 20643 | 51147 | 81651, 112155, 142659, 173163, 203667 |
| 430 | ABB02927 | 14461 | 44965 | 75469, 105973, 136477, 166981, 197485 | 6613 | AEG65057 | 20644 | 51148 | 81652, 112156, 142660, 173164, 203668 |
| 431 | ABB02939 | 14462 | 44966 | 75470, 105974, 136478, 166982, 197486 | 6614 | AEG65068 | 20645 | 51149 | 81653, 112157, 142661, 173165, 203669 |
| 432 | ABB02950 | 14463 | 44967 | 75471, 105975, 136479, 166983, 197487 | 6615 | AEG65079 | 20646 | 51150 | 81654, 112158, 142662, 173166, 203670 |
| 433 | ABB02961 | 14464 | 44968 | 75472, 105976, 136480, 166984, 197488 | 6616 | AEG65090 | 20647 | 51151 | 81655, 112159, 142663, 173167, 203671 |
| 434 | ABB02972 | 14465 | 44969 | 75473, 105977, 136481, 166985, 197489 | 6617 | AEG65101 | 20648 | 51152 | 81656, 112160, 142664, 173168, 203672 |
| 435 | ABB02983 | 14466 | 44970 | 75474, 105978, 136482, 166986, 197490 | 6618 | AEG65123 | 20649 | 51153 | 81657, 112161, 142665, 173169, 203673 |
| 436 | ABB02994 | 14467 | 44971 | 75475, 105979, 136483, 166987, 197491 | 6619 | AEG65134 | 20650 | 51154 | 81658, 112162, 142666, 173170, 203674 |
| 437 | ABB03005 | 14468 | 44972 | 75476, 105980, 136484, 166988, 197492 | 6620 | AEG65145 | 20651 | 51155 | 81659, 112163, 142667, 173171, 203675 |
| 438 | ABB03016 | 14469 | 44973 | 75477, 105981, 136485, 166989, 197493 | 6621 | AEG65156 | 20652 | 51156 | 81660, 112164, 142668, 173172, 203676 |
| 439 | ABB03027 | 14470 | 44974 | 75478, 105982, 136486, 166990, 197494 | 6622 | AEG65167 | 20653 | 51157 | 81661, 112165, 142669, 173173, 203677 |
| 440 | ABB03038 | 14471 | 44975 | 75479, 105983, 136487, 166991, 197495 | 6623 | AEG65178 | 20654 | 51158 | 81662, 112166, 142670, 173174, 203678 |
| 441 | ABB03049 | 14472 | 44976 | 75480, 105984, 136488, 166992, 197496 | 6624 | AEG65189 | 20655 | 51159 | 81663, 112167, 142671, 173175, 203679 |
| 442 | ABB03060 | 14473 | 44977 | 75481, 105985, 136489, 166993, 197497 | 6625 | AEG65200 | 20656 | 51160 | 81664, 112168, 142672, 173176, 203680 |
| 443 | ABB03071 | 14474 | 44978 | 75482, 105986, 136490, 166994, 197498 | 6626 | AEG65211 | 20657 | 51161 | 81665, 112169, 142673, 173177, 203681 |

FIG. 3 continued

| | | | | | | | | | |
|---|---|---|---|---|---|---|---|---|---|
| 444 | ABB03093 | 14475 | 44979 | 75483, 105987, 136491, 166995, 197499 | 6627 | AEG65222 | 20658 | 51162 | 81666, 112170, 142674, 173178, 203682 |
| 445 | ABB03104 | 14476 | 44980 | 75484, 105988, 136492, 166996, 197500 | 6628 | AEG65233 | 20659 | 51163 | 81667, 112171, 142675, 173179, 203683 |
| 446 | ABB03115 | 14477 | 44981 | 75485, 105989, 136493, 166997, 197501 | 6629 | AEG65244 | 20660 | 51164 | 81668, 112172, 142676, 173180, 203684 |
| 447 | ABB03126 | 14478 | 44982 | 75486, 105990, 136494, 166998, 197502 | 6630 | AEG65255 | 20661 | 51165 | 81669, 112173, 142677, 173181, 203685 |
| 448 | ABB03148 | 14479 | 44983 | 75487, 105991, 136495, 166999, 197503 | 6631 | AEG65266 | 20662 | 51166 | 81670, 112174, 142678, 173182, 203686 |
| 449 | ABB04286 | 14480 | 44984 | 75488, 105992, 136496, 167000, 197504 | 6632 | AEG65277 | 20663 | 51167 | 81671, 112175, 142679, 173183, 203687 |
| 450 | ABB04297 | 14481 | 44985 | 75489, 105993, 136497, 167001, 197505 | 6633 | AEG65288 | 20664 | 51168 | 81672, 112176, 142680, 173184, 203688 |
| 451 | ABB04319 | 14482 | 44986 | 75490, 105994, 136498, 167002, 197506 | 6634 | AEG65299 | 20665 | 51169 | 81673, 112177, 142681, 173185, 203689 |
| 452 | ABB04341 | 14483 | 44987 | 75491, 105995, 136499, 167003, 197507 | 6635 | AEG65310 | 20666 | 51170 | 81674, 112178, 142682, 173186, 203690 |
| 453 | ABB04352 | 14484 | 44988 | 75492, 105996, 136500, 167004, 197508 | 6636 | AEG65321 | 20667 | 51171 | 81675, 112179, 142683, 173187, 203691 |
| 454 | ABB04374 | 14485 | 44989 | 75493, 105997, 136501, 167005, 197509 | 6637 | AEG65332 | 20668 | 51172 | 81676, 112180, 142684, 173188, 203692 |
| 455 | ABB04931 | 14486 | 44990 | 75494, 105998, 136502, 167006, 197510 | 6638 | AEG65354 | 20669 | 51173 | 81677, 112181, 142685, 173189, 203693 |
| 456 | ABB04942 | 14487 | 44991 | 75495, 105999, 136503, 167007, 197511 | 6639 | AEG65365 | 20670 | 51174 | 81678, 112182, 142686, 173190, 203694 |
| 457 | ABB04953 | 14488 | 44992 | 75496, 106000, 136504, 167008, 197512 | 6640 | AEG65376 | 20671 | 51175 | 81679, 112183, 142687, 173191, 203695 |
| 458 | ABB04975 | 14489 | 44993 | 75497, 106001, 136505, 167009, 197513 | 6641 | AEG65387 | 20672 | 51176 | 81680, 112184, 142688, 173192, 203696 |
| 459 | ABB04986 | 14490 | 44994 | 75498, 106002, 136506, 167010, 197514 | 6642 | AEG65398 | 20673 | 51177 | 81681, 112185, 142689, 173193, 203697 |
| 460 | ABB04997 | 14491 | 44995 | 75499, 106003, 136507, 167011, 197515 | 6643 | AEG65409 | 20674 | 51178 | 81682, 112186, 142690, 173194, 203698 |
| 461 | ABB05008 | 14492 | 44996 | 75500, 106004, 136508, 167012, 197516 | 6644 | AEG65420 | 20675 | 51179 | 81683, 112187, 142691, 173195, 203699 |

FIG. 3 continued

| | | | | | | | | | |
|---|---|---|---|---|---|---|---|---|---|
| 462 | ABB05186 | 14493 | 44997 | 75501, 106005, 136509, 167013, 197517 | 6645 | AEG65431 | 20676 | 51180 | 81684, 112188, 142692, 173196, 203700 |
| 463 | ABB05219 | 14494 | 44998 | 75502, 106006, 136510, 167014, 197518 | 6646 | AEG65442 | 20677 | 51181 | 81685, 112189, 142693, 173197, 203701 |
| 464 | ABB46395 | 14495 | 44999 | 75503, 106007, 136511, 167015, 197519 | 6647 | AEG65453 | 20678 | 51182 | 81686, 112190, 142694, 173198, 203702 |
| 465 | ABB46417 | 14496 | 45000 | 75504, 106008, 136512, 167016, 197520 | 6648 | AEG65464 | 20679 | 51183 | 81687, 112191, 142695, 173199, 203703 |
| 466 | ABB46428 | 14497 | 45001 | 75505, 106009, 136513, 167017, 197521 | 6649 | AEG65475 | 20680 | 51184 | 81688, 112192, 142696, 173200, 203704 |
| 467 | ABB46439 | 14498 | 45002 | 75506, 106010, 136514, 167018, 197522 | 6650 | AEG65486 | 20681 | 51185 | 81689, 112193, 142697, 173201, 203705 |
| 468 | ABB46450 | 14499 | 45003 | 75507, 106011, 136515, 167019, 197523 | 6651 | AEG65497 | 20682 | 51186 | 81690, 112194, 142698, 173202, 203706 |
| 469 | ABB46461 | 14500 | 45004 | 75508, 106012, 136516, 167020, 197524 | 6652 | AEG65508 | 20683 | 51187 | 81691, 112195, 142699, 173203, 203707 |
| 470 | ABB46550 | 14501 | 45005 | 75509, 106013, 136517, 167021, 197525 | 6653 | AEG65519 | 20684 | 51188 | 81692, 112196, 142700, 173204, 203708 |
| 471 | ABB51955 | 14502 | 45006 | 75510, 106014, 136518, 167022, 197526 | 6654 | AEG65530 | 20685 | 51189 | 81693, 112197, 142701, 173205, 203709 |
| 472 | ABB51956 | 14503 | 45007 | 75511, 106015, 136519, 167023, 197527 | 6655 | AEG65541 | 20686 | 51190 | 81694, 112198, 142702, 173206, 203710 |
| 473 | ABB51957 | 14504 | 45008 | 75512, 106016, 136520, 167024, 197528 | 6656 | AEG65563 | 20687 | 51191 | 81695, 112199, 142703, 173207, 203711 |
| 474 | ABB51958 | 14505 | 45009 | 75513, 106017, 136521, 167025, 197529 | 6657 | AEG65574 | 20688 | 51192 | 81696, 112200, 142704, 173208, 203712 |
| 475 | ABB51959 | 14506 | 45010 | 75514, 106018, 136522, 167026, 197530 | 6658 | AEG65585 | 20689 | 51193 | 81697, 112201, 142705, 173209, 203713 |
| 476 | ABB51960 | 14507 | 45011 | 75515, 106019, 136523, 167027, 197531 | 6659 | AEG65596 | 20690 | 51194 | 81698, 112202, 142706, 173210, 203714 |
| 477 | ABB53617 | 14508 | 45012 | 75516, 106020, 136524, 167028, 197532 | 6660 | AEG65607 | 20691 | 51195 | 81699, 112203, 142707, 173211, 203715 |
| 478 | ABB53721 | 14509 | 45013 | 75517, 106021, 136525, 167029, 197533 | 6661 | AEG65629 | 20692 | 51196 | 81700, 112204, 142708, 173212, 203716 |
| 479 | ABB53754 | 14510 | 45014 | 75518, 106022, 136526, 167030, 197534 | 6662 | AEG65640 | 20693 | 51197 | 81701, 112205, 142709, 173213, 203717 |

FIG. 3 continued

| | | | | | | | | | |
|---|---|---|---|---|---|---|---|---|---|
| 480 | ABB54517 | 14511 | 45015 | 75519, 106023, 136527, 167031, 197535 | 6663 | AEG65651 | 20694 | 51198 | 81702, 112206, 142710, 173214, 203718 |
| 481 | ABB59999 | 14512 | 45016 | 75520, 106024, 136528, 167032, 197536 | 6664 | AEG65662 | 20695 | 51199 | 81703, 112207, 142711, 173215, 203719 |
| 482 | ABB60010 | 14513 | 45017 | 75521, 106025, 136529, 167033, 197537 | 6665 | AEG65673 | 20696 | 51200 | 81704, 112208, 142712, 173216, 203720 |
| 483 | ABB77867 | 14514 | 45018 | 75522, 106026, 136530, 167034, 197538 | 6666 | AEG65684 | 20697 | 51201 | 81705, 112209, 142713, 173217, 203721 |
| 484 | ABB79719 | 14515 | 45019 | 75523, 106027, 136531, 167035, 197539 | 6667 | AEG65695 | 20698 | 51202 | 81706, 112210, 142714, 173218, 203722 |
| 485 | ABB79734 | 14516 | 45020 | 75524, 106028, 136532, 167036, 197540 | 6668 | AEG65706 | 20699 | 51203 | 81707, 112211, 142715, 173219, 203723 |
| 486 | ABB79791 | 14517 | 45021 | 75525, 106029, 136533, 167037, 197541 | 6669 | AEG65728 | 20700 | 51204 | 81708, 112212, 142716, 173220, 203724 |
| 487 | ABB79802 | 14518 | 45022 | 75526, 106030, 136534, 167038, 197542 | 6670 | AEG65739 | 20701 | 51205 | 81709, 112213, 142717, 173221, 203725 |
| 488 | ABB79813 | 14519 | 45023 | 75527, 106031, 136535, 167039, 197543 | 6671 | AEG65750 | 20702 | 51206 | 81710, 112214, 142718, 173222, 203726 |
| 489 | ABB79960 | 14520 | 45024 | 75528, 106032, 136536, 167040, 197544 | 6672 | AEG65761 | 20703 | 51207 | 81711, 112215, 142719, 173223, 203727 |
| 490 | ABB79971 | 14521 | 45025 | 75529, 106033, 136537, 167041, 197545 | 6673 | AEG65772 | 20704 | 51208 | 81712, 112216, 142720, 173224, 203728 |
| 491 | ABB79982 | 14522 | 45026 | 75530, 106034, 136538, 167042, 197546 | 6674 | AEG65783 | 20705 | 51209 | 81713, 112217, 142721, 173225, 203729 |
| 492 | ABB79993 | 14523 | 45027 | 75531, 106035, 136539, 167043, 197547 | 6675 | AEG65794 | 20706 | 51210 | 81714, 112218, 142722, 173226, 203730 |
| 493 | ABB80004 | 14524 | 45028 | 75532, 106036, 136540, 167044, 197548 | 6676 | AEG65805 | 20707 | 51211 | 81715, 112219, 142723, 173227, 203731 |
| 494 | ABB80015 | 14525 | 45029 | 75533, 106037, 136541, 167045, 197549 | 6677 | AEG65816 | 20708 | 51212 | 81716, 112220, 142724, 173228, 203732 |
| 495 | ABB80037 | 14526 | 45030 | 75534, 106038, 136542, 167046, 197550 | 6678 | AEG79808 | 20709 | 51213 | 81717, 112221, 142725, 173229, 203733 |
| 496 | ABB80048 | 14527 | 45031 | 75535, 106039, 136543, 167047, 197551 | 6679 | AEG79814 | 20710 | 51214 | 81718, 112222, 142726, 173230, 203734 |
| 497 | ABB80084 | 14528 | 45032 | 75536, 106040, 136544, 167048, 197552 | 6680 | AEG79826 | 20711 | 51215 | 81719, 112223, 142727, 173231, 203735 |

FIG. 3 continued

| | | | | | | | | | |
|---|---|---|---|---|---|---|---|---|---|
| 498 | ABB80095 | 14529 | 45033 | 75537, 106041, 136545, 167049, 197553 | 6681 | AEG79830 | 20712 | 51216 | 81720, 112224, 142728, 173232, 203736 |
| 499 | ABB80162 | 14530 | 45034 | 75538, 106042, 136546, 167050, 197554 | 6682 | AEG79836 | 20713 | 51217 | 81721, 112225, 142729, 173233, 203737 |
| 500 | ABB80199 | 14531 | 45035 | 75539, 106043, 136547, 167051, 197555 | 6683 | AEH59356 | 20714 | 51218 | 81722, 112226, 142730, 173234, 203738 |
| 501 | ABB80210 | 14532 | 45036 | 75540, 106044, 136548, 167052, 197556 | 6684 | AEH59360 | 20715 | 51219 | 81723, 112227, 142731, 173235, 203739 |
| 502 | ABB80232 | 14533 | 45037 | 75541, 106045, 136549, 167053, 197557 | 6685 | AEH59364 | 20716 | 51220 | 81724, 112228, 142732, 173236, 203740 |
| 503 | ABB80243 | 14534 | 45038 | 75542, 106046, 136550, 167054, 197558 | 6686 | AEH59366 | 20717 | 51221 | 81725, 112229, 142733, 173237, 203741 |
| 504 | ABB80254 | 14535 | 45039 | 75543, 106047, 136551, 167055, 197559 | 6687 | AEH59368 | 20718 | 51222 | 81726, 112230, 142734, 173238, 203742 |
| 505 | ABB80495 | 14536 | 45040 | 75544, 106048, 136552, 167056, 197560 | 6688 | AEH59370 | 20719 | 51223 | 81727, 112231, 142735, 173239, 203743 |
| 506 | ABB80506 | 14537 | 45041 | 75545, 106049, 136553, 167057, 197561 | 6689 | AEH59372 | 20720 | 51224 | 81728, 112232, 142736, 173240, 203744 |
| 507 | ABB80517 | 14538 | 45042 | 75546, 106050, 136554, 167058, 197562 | 6690 | AEH59376 | 20721 | 51225 | 81729, 112233, 142737, 173241, 203745 |
| 508 | ABB80532 | 14539 | 45043 | 75547, 106051, 136555, 167059, 197563 | 6691 | AEH59378 | 20722 | 51226 | 81730, 112234, 142738, 173242, 203746 |
| 509 | ABB80644 | 14540 | 45044 | 75548, 106052, 136556, 167060, 197564 | 6692 | AEH59382 | 20723 | 51227 | 81731, 112235, 142739, 173243, 203747 |
| 510 | ABB80664 | 14541 | 45045 | 75549, 106053, 136557, 167061, 197565 | 6693 | AEH59384 | 20724 | 51228 | 81732, 112236, 142740, 173244, 203748 |
| 511 | ABB80675 | 14542 | 45046 | 75550, 106054, 136558, 167062, 197566 | 6694 | AEH59386 | 20725 | 51229 | 81733, 112237, 142741, 173245, 203749 |
| 512 | ABB80685 | 14543 | 45047 | 75551, 106055, 136559, 167063, 197567 | 6695 | AEH59388 | 20726 | 51230 | 81734, 112238, 142742, 173246, 203750 |
| 513 | ABB80696 | 14544 | 45048 | 75552, 106056, 136560, 167064, 197568 | 6696 | AEH59390 | 20727 | 51231 | 81735, 112239, 142743, 173247, 203751 |
| 514 | ABB80707 | 14545 | 45049 | 75553, 106057, 136561, 167065, 197569 | 6697 | AEH59392 | 20728 | 51232 | 81736, 112240, 142744, 173248, 203752 |
| 515 | ABB80716 | 14546 | 45050 | 75554, 106058, 136562, 167066, 197570 | 6698 | AEH59396 | 20729 | 51233 | 81737, 112241, 142745, 173249, 203753 |

FIG. 3 continued

| | | | | | | | | | |
|---|---|---|---|---|---|---|---|---|---|
| 516 | ABB80725 | 14547 | 45051 | 75555, 106059, 136563, 167067, 197571 | 6699 | AEH59398 | 20730 | 51234 | 81738, 112242, 142746, 173250, 203754 |
| 517 | ABB80740 | 14548 | 45052 | 75556, 106060, 136564, 167068, 197572 | 6700 | AEH59400 | 20731 | 51235 | 81739, 112243, 142747, 173251, 203755 |
| 518 | ABB80751 | 14549 | 45053 | 75557, 106061, 136565, 167069, 197573 | 6701 | AEH59402 | 20732 | 51236 | 81740, 112244, 142748, 173252, 203756 |
| 519 | ABB82186 | 14550 | 45054 | 75558, 106062, 136566, 167070, 197574 | 6702 | AEH59404 | 20733 | 51237 | 81741, 112245, 142749, 173253, 203757 |
| 520 | ABB82197 | 14551 | 45055 | 75559, 106063, 136567, 167071, 197575 | 6703 | AEH59406 | 20734 | 51238 | 81742, 112246, 142750, 173254, 203758 |
| 521 | ABB82208 | 14552 | 45056 | 75560, 106064, 136568, 167072, 197576 | 6704 | AEH59408 | 20735 | 51239 | 81743, 112247, 142751, 173255, 203759 |
| 522 | ABB82219 | 14553 | 45057 | 75561, 106065, 136569, 167073, 197577 | 6705 | AEH59412 | 20736 | 51240 | 81744, 112248, 142752, 173256, 203760 |
| 523 | ABB82230 | 14554 | 45058 | 75562, 106066, 136570, 167074, 197578 | 6706 | AEH59416 | 20737 | 51241 | 81745, 112249, 142753, 173257, 203761 |
| 524 | ABB83018 | 14555 | 45059 | 75563, 106067, 136571, 167075, 197579 | 6707 | AEH59584 | 20738 | 51242 | 81746, 112250, 142754, 173258, 203762 |
| 525 | ABB83029 | 14556 | 45060 | 75564, 106068, 136572, 167076, 197580 | 6708 | AEH59586 | 20739 | 51243 | 81747, 112251, 142755, 173259, 203763 |
| 526 | ABB83130 | 14557 | 45061 | 75565, 106069, 136573, 167077, 197581 | 6709 | AEH59588 | 20740 | 51244 | 81748, 112252, 142756, 173260, 203764 |
| 527 | ABB83141 | 14558 | 45062 | 75566, 106070, 136574, 167078, 197582 | 6710 | AEH59592 | 20741 | 51245 | 81749, 112253, 142757, 173261, 203765 |
| 528 | ABB86876 | 14559 | 45063 | 75567, 106071, 136575, 167079, 197583 | 6711 | AEH59594 | 20742 | 51246 | 81750, 112254, 142758, 173262, 203766 |
| 529 | ABB86886 | 14560 | 45064 | 75568, 106072, 136576, 167080, 197584 | 6712 | AEH59596 | 20743 | 51247 | 81751, 112255, 142759, 173263, 203767 |
| 530 | ABB86898 | 14561 | 45065 | 75569, 106073, 136577, 167081, 197585 | 6713 | AEH59598 | 20744 | 51248 | 81752, 112256, 142760, 173264, 203768 |
| 531 | ABB86906 | 14562 | 45066 | 75570, 106074, 136578, 167082, 197586 | 6714 | AEH59600 | 20745 | 51249 | 81753, 112257, 142761, 173265, 203769 |
| 532 | ABB86916 | 14563 | 45067 | 75571, 106075, 136579, 167083, 197587 | 6715 | AEH59602 | 20746 | 51250 | 81754, 112258, 142762, 173266, 203770 |
| 533 | ABB86928 | 14564 | 45068 | 75572, 106076, 136580, 167084, 197588 | 6716 | AEH59606 | 20747 | 51251 | 81755, 112259, 142763, 173267, 203771 |

FIG. 3 continued

| | | | | | | | | | |
|---|---|---|---|---|---|---|---|---|---|
| 534 | ABB86936 | 14565 | 45069 | 75573, 106077, 136581, 167085, 197589 | 6717 | AEH59616 | 20748 | 51252 | 81756, 112260, 142764, 173268, 203772 |
| 535 | ABB86947 | 14566 | 45070 | 75574, 106078, 136582, 167086, 197590 | 6718 | AEH59626 | 20749 | 51253 | 81757, 112261, 142765, 173269, 203773 |
| 536 | ABB86957 | 14567 | 45071 | 75575, 106079, 136583, 167087, 197591 | 6719 | AEH77262 | 20750 | 51254 | 81758, 112262, 142766, 173270, 203774 |
| 537 | ABB96333 | 14568 | 45072 | 75576, 106080, 136584, 167088, 197592 | 6720 | AEH77273 | 20751 | 51255 | 81759, 112263, 142767, 173271, 203775 |
| 538 | ABB96344 | 14569 | 45073 | 75577, 106081, 136585, 167089, 197593 | 6721 | AEH77282 | 20752 | 51256 | 81760, 112264, 142768, 173272, 203776 |
| 539 | ABB96398 | 14570 | 45074 | 75578, 106082, 136586, 167090, 197594 | 6722 | AEI29218 | 20753 | 51257 | 81761, 112265, 142769, 173273, 203777 |
| 540 | ABB96490 | 14571 | 45075 | 75579, 106083, 136587, 167091, 197595 | 6723 | AEI29228 | 20754 | 51258 | 81762, 112266, 142770, 173274, 203778 |
| 541 | ABB96501 | 14572 | 45076 | 75580, 106084, 136588, 167092, 197596 | 6724 | AEI54350 | 20755 | 51259 | 81763, 112267, 142771, 173275, 203779 |
| 542 | ABB96534 | 14573 | 45077 | 75581, 106085, 136589, 167093, 197597 | 6725 | AEI54361 | 20756 | 51260 | 81764, 112268, 142772, 173276, 203780 |
| 543 | ABC02237 | 14574 | 45078 | 75582, 106086, 136590, 167094, 197598 | 6726 | AEI54372 | 20757 | 51261 | 81765, 112269, 142773, 173277, 203781 |
| 544 | ABC02258 | 14575 | 45079 | 75583, 106087, 136591, 167095, 197599 | 6727 | AEI54383 | 20758 | 51262 | 81766, 112270, 142774, 173278, 203782 |
| 545 | ABC02269 | 14576 | 45080 | 75584, 106088, 136592, 167096, 197600 | 6728 | AEI54394 | 20759 | 51263 | 81767, 112271, 142775, 173279, 203783 |
| 546 | ABC02280 | 14577 | 45081 | 75585, 106089, 136593, 167097, 197601 | 6729 | AEI54416 | 20760 | 51264 | 81768, 112272, 142776, 173280, 203784 |
| 547 | ABC02302 | 14578 | 45082 | 75586, 106090, 136594, 167098, 197602 | 6730 | AEI54427 | 20761 | 51265 | 81769, 112273, 142777, 173281, 203785 |
| 548 | ABC02313 | 14579 | 45083 | 75587, 106091, 136595, 167099, 197603 | 6731 | AEI54438 | 20762 | 51266 | 81770, 112274, 142778, 173282, 203786 |
| 549 | ABC02324 | 14580 | 45084 | 75588, 106092, 136596, 167100, 197604 | 6732 | AEI54449 | 20763 | 51267 | 81771, 112275, 142779, 173283, 203787 |
| 550 | ABC02335 | 14581 | 45085 | 75589, 106093, 136597, 167101, 197605 | 6733 | AEI54460 | 20764 | 51268 | 81772, 112276, 142780, 173284, 203788 |
| 551 | ABC39808 | 14582 | 45086 | 75590, 106094, 136598, 167102, 197606 | 6734 | AEI54471 | 20765 | 51269 | 81773, 112277, 142781, 173285, 203789 |

FIG. 3 continued

| | | | | | | | | | |
|---|---|---|---|---|---|---|---|---|---|
| 552 | ABC40525 | 14583 | 45087 | 75591, 106095, 136599, 167103, 197607 | 6735 | AEI54482 | 20766 | 51270 | 81774, 112278, 142782, 173286, 203790 |
| 553 | ABC40536 | 14584 | 45088 | 75592, 106096, 136600, 167104, 197608 | 6736 | AEI54493 | 20767 | 51271 | 81775, 112279, 142783, 173287, 203791 |
| 554 | ABC40547 | 14585 | 45089 | 75593, 106097, 136601, 167105, 197609 | 6737 | AEI54504 | 20768 | 51272 | 81776, 112280, 142784, 173288, 203792 |
| 555 | ABC40558 | 14586 | 45090 | 75594, 106098, 136602, 167106, 197610 | 6738 | AEI59982 | 20769 | 51273 | 81777, 112281, 142785, 173289, 203793 |
| 556 | ABC40611 | 14587 | 45091 | 75595, 106099, 136603, 167107, 197611 | 6739 | AEI59993 | 20770 | 51274 | 81778, 112282, 142786, 173290, 203794 |
| 557 | ABC40622 | 14588 | 45092 | 75596, 106100, 136604, 167108, 197612 | 6740 | AEI60004 | 20771 | 51275 | 81779, 112283, 142787, 173291, 203795 |
| 558 | ABC40634 | 14589 | 45093 | 75597, 106101, 136605, 167109, 197613 | 6741 | AEI60015 | 20772 | 51276 | 81780, 112284, 142788, 173292, 203796 |
| 559 | ABC40645 | 14590 | 45094 | 75598, 106102, 136606, 167110, 197614 | 6742 | AEI60026 | 20773 | 51277 | 81781, 112285, 142789, 173293, 203797 |
| 560 | ABC41706 | 14591 | 45095 | 75599, 106103, 136607, 167111, 197615 | 6743 | AEI60037 | 20774 | 51278 | 81782, 112286, 142790, 173294, 203798 |
| 561 | ABC41717 | 14592 | 45096 | 75600, 106104, 136608, 167112, 197616 | 6744 | AEI60048 | 20775 | 51279 | 81783, 112287, 142791, 173295, 203799 |
| 562 | ABC41728 | 14593 | 45097 | 75601, 106105, 136609, 167113, 197617 | 6745 | AEI60089 | 20776 | 51280 | 81784, 112288, 142792, 173296, 203800 |
| 563 | ABC41742 | 14594 | 45098 | 75602, 106106, 136610, 167114, 197618 | 6746 | AEI60099 | 20777 | 51281 | 81785, 112289, 142793, 173297, 203801 |
| 564 | ABC41956 | 14595 | 45099 | 75603, 106107, 136611, 167115, 197619 | 6747 | AEI60111 | 20778 | 51282 | 81786, 112290, 142794, 173298, 203802 |
| 565 | ABC41967 | 14596 | 45100 | 75604, 106108, 136612, 167116, 197620 | 6748 | AEI73669 | 20779 | 51283 | 81787, 112291, 142795, 173299, 203803 |
| 566 | ABC42017 | 14597 | 45101 | 75605, 106109, 136613, 167117, 197621 | 6749 | AEI86727 | 20780 | 51284 | 81788, 112292, 142796, 173300, 203804 |
| 567 | ABC42117 | 14598 | 45102 | 75606, 106110, 136614, 167118, 197622 | 6750 | AEI86737 | 20781 | 51285 | 81789, 112293, 142797, 173301, 203805 |
| 568 | ABC42128 | 14599 | 45103 | 75607, 106111, 136615, 167119, 197623 | 6751 | AEI86757 | 20782 | 51286 | 81790, 112294, 142798, 173302, 203806 |
| 569 | ABC42139 | 14600 | 45104 | 75608, 106112, 136616, 167120, 197624 | 6752 | AEI86767 | 20783 | 51287 | 81791, 112295, 142799, 173303, 203807 |

FIG. 3 continued

| | | | | | | | | | |
|---|---|---|---|---|---|---|---|---|---|
| 570 | ABC42150 | 14601 | 45105 | 75609, 106113, 136617, 167121, 197625 | 6753 | AE186777 | 20784 | 51288 | 81792, 112296, 142800, 173304, 203808 |
| 571 | ABC42161 | 14602 | 45106 | 75610, 106114, 136618, 167122, 197626 | 6754 | AE186787 | 20785 | 51289 | 81793, 112297, 142801, 173305, 203809 |
| 572 | ABC42172 | 14603 | 45107 | 75611, 106115, 136619, 167123, 197627 | 6755 | AE186797 | 20786 | 51290 | 81794, 112298, 142802, 173306, 203810 |
| 573 | ABC42183 | 14604 | 45108 | 75612, 106116, 136620, 167124, 197628 | 6756 | AE186807 | 20787 | 51291 | 81795, 112299, 142803, 173307, 203811 |
| 574 | ABC42195 | 14605 | 45109 | 75613, 106117, 136621, 167125, 197629 | 6757 | AE186817 | 20788 | 51292 | 81796, 112300, 142804, 173308, 203812 |
| 575 | ABC42310 | 14606 | 45110 | 75614, 106118, 136622, 167126, 197630 | 6758 | AE186827 | 20789 | 51293 | 81797, 112301, 142805, 173309, 203813 |
| 576 | ABC42321 | 14607 | 45111 | 75615, 106119, 136623, 167127, 197631 | 6759 | AE186837 | 20790 | 51294 | 81798, 112302, 142806, 173310, 203814 |
| 577 | ABC42349 | 14608 | 45112 | 75616, 106120, 136624, 167128, 197632 | 6760 | AE186847 | 20791 | 51295 | 81799, 112303, 142807, 173311, 203815 |
| 578 | ABC42464 | 14609 | 45113 | 75617, 106121, 136625, 167129, 197633 | 6761 | AE186867 | 20792 | 51296 | 81800, 112304, 142808, 173312, 203816 |
| 579 | ABC42497 | 14610 | 45114 | 75618, 106122, 136626, 167130, 197634 | 6762 | AE186887 | 20793 | 51297 | 81801, 112305, 142809, 173313, 203817 |
| 580 | ABC42508 | 14611 | 45115 | 75619, 106123, 136627, 167131, 197635 | 6763 | AE186897 | 20794 | 51298 | 81802, 112306, 142810, 173314, 203818 |
| 581 | ABC42519 | 14612 | 45116 | 75620, 106124, 136628, 167132, 197636 | 6764 | AE186907 | 20795 | 51299 | 81803, 112307, 142811, 173315, 203819 |
| 582 | ABC42530 | 14613 | 45117 | 75621, 106125, 136629, 167133, 197637 | 6765 | AE186917 | 20796 | 51300 | 81804, 112308, 142812, 173316, 203820 |
| 583 | ABC42577 | 14614 | 45118 | 75622, 106126, 136630, 167134, 197638 | 6766 | AE186927 | 20797 | 51301 | 81805, 112309, 142813, 173317, 203821 |
| 584 | ABC42588 | 14615 | 45119 | 75623, 106127, 136631, 167135, 197639 | 6767 | AE186937 | 20798 | 51302 | 81806, 112310, 142814, 173318, 203822 |
| 585 | ABC42599 | 14616 | 45120 | 75624, 106128, 136632, 167136, 197640 | 6768 | AE186947 | 20799 | 51303 | 81807, 112311, 142815, 173319, 203823 |
| 586 | ABC42610 | 14617 | 45121 | 75625, 106129, 136633, 167137, 197641 | 6769 | AE186967 | 20800 | 51304 | 81808, 112312, 142816, 173320, 203824 |
| 587 | ABC42621 | 14618 | 45122 | 75626, 106130, 136634, 167138, 197642 | 6770 | AE186977 | 20801 | 51305 | 81809, 112313, 142817, 173321, 203825 |

FIG. 3 continued

| | | | | | | | | | |
|---|---|---|---|---|---|---|---|---|---|
| 588 | ABC42632 | 14619 | 45123 | 75627, 106131, 136635, 167139, 197643 | 6771 | AEI86997 | 20802 | 51306 | 81810, 112314, 142818, 173322, 203826 |
| 589 | ABC42643 | 14620 | 45124 | 75628, 106132, 136636, 167140, 197644 | 6772 | AEI87007 | 20803 | 51307 | 81811, 112315, 142819, 173323, 203827 |
| 590 | ABC42654 | 14621 | 45125 | 75629, 106133, 136637, 167141, 197645 | 6773 | AEI87017 | 20804 | 51308 | 81812, 112316, 142820, 173324, 203828 |
| 591 | ABC42665 | 14622 | 45126 | 75630, 106134, 136638, 167142, 197646 | 6774 | AEI87027 | 20805 | 51309 | 81813, 112317, 142821, 173325, 203829 |
| 592 | ABC42676 | 14623 | 45127 | 75631, 106135, 136639, 167143, 197647 | 6775 | AEI87037 | 20806 | 51310 | 81814, 112318, 142822, 173326, 203830 |
| 593 | ABC42687 | 14624 | 45128 | 75632, 106136, 136640, 167144, 197648 | 6776 | AEI87047 | 20807 | 51311 | 81815, 112319, 142823, 173327, 203831 |
| 594 | ABC42698 | 14625 | 45129 | 75633, 106137, 136641, 167145, 197649 | 6777 | AEI87057 | 20808 | 51312 | 81816, 112320, 142824, 173328, 203832 |
| 595 | ABC42709 | 14626 | 45130 | 75634, 106138, 136642, 167146, 197650 | 6778 | AEI87067 | 20809 | 51313 | 81817, 112321, 142825, 173329, 203833 |
| 596 | ABC42720 | 14627 | 45131 | 75635, 106139, 136643, 167147, 197651 | 6779 | AEI87077 | 20810 | 51314 | 81818, 112322, 142826, 173330, 203834 |
| 597 | ABC42742 | 14628 | 45132 | 75636, 106140, 136644, 167148, 197652 | 6780 | AEI87087 | 20811 | 51315 | 81819, 112323, 142827, 173331, 203835 |
| 598 | ABC42764 | 14629 | 45133 | 75637, 106141, 136645, 167149, 197653 | 6781 | AEI87097 | 20812 | 51316 | 81820, 112324, 142828, 173332, 203836 |
| 599 | ABC42775 | 14630 | 45134 | 75638, 106142, 136646, 167150, 197654 | 6782 | AEI87107 | 20813 | 51317 | 81821, 112325, 142829, 173333, 203837 |
| 600 | ABC42786 | 14631 | 45135 | 75639, 106143, 136647, 167151, 197655 | 6783 | AEI91968 | 20814 | 51318 | 81822, 112326, 142830, 173334, 203838 |
| 601 | ABC42797 | 14632 | 45136 | 75640, 106144, 136648, 167152, 197656 | 6784 | AEI91983 | 20815 | 51319 | 81823, 112327, 142831, 173335, 203839 |
| 602 | ABC42808 | 14633 | 45137 | 75641, 106145, 136649, 167153, 197657 | 6785 | AEI91984 | 20816 | 51320 | 81824, 112328, 142832, 173336, 203840 |
| 603 | ABC42819 | 14634 | 45138 | 75642, 106146, 136650, 167154, 197658 | 6786 | AEI92004 | 20817 | 51321 | 81825, 112329, 142833, 173337, 203841 |
| 604 | ABC42841 | 14635 | 45139 | 75643, 106147, 136651, 167155, 197659 | 6787 | AEI92023 | 20818 | 51322 | 81826, 112330, 142834, 173338, 203842 |
| 605 | ABC42852 | 14636 | 45140 | 75644, 106148, 136652, 167156, 197660 | 6788 | AEJ10403 | 20819 | 51323 | 81827, 112331, 142835, 173339, 203843 |

FIG. 3 continued

| | | | | | | | | | |
|---|---|---|---|---|---|---|---|---|---|
| 606 | ABC42863 | 14637 | 45141 | 75645, 106149, 136653, 167157, 197661 | 6789 | AEJ10413 | 20820 | 51324 | 81828, 112332, 142836, 173340, 203844 |
| 607 | ABC42874 | 14638 | 45142 | 75646, 106150, 136654, 167158, 197662 | 6790 | AEJ10423 | 20821 | 51325 | 81829, 112333, 142837, 173341, 203845 |
| 608 | ABC42885 | 14639 | 45143 | 75647, 106151, 136655, 167159, 197663 | 6791 | AEJ10433 | 20822 | 51326 | 81830, 112334, 142838, 173342, 203846 |
| 609 | ABC42896 | 14640 | 45144 | 75648, 106152, 136656, 167160, 197664 | 6792 | AEJ10443 | 20823 | 51327 | 81831, 112335, 142839, 173343, 203847 |
| 610 | ABC42914 | 14641 | 45145 | 75649, 106153, 136657, 167161, 197665 | 6793 | AEJ10453 | 20824 | 51328 | 81832, 112336, 142840, 173344, 203848 |
| 611 | ABC42932 | 14642 | 45146 | 75650, 106154, 136658, 167162, 197666 | 6794 | AEJ10463 | 20825 | 51329 | 81833, 112337, 142841, 173345, 203849 |
| 612 | ABC42943 | 14643 | 45147 | 75651, 106155, 136659, 167163, 197667 | 6795 | AEJ10473 | 20826 | 51330 | 81834, 112338, 142842, 173346, 203850 |
| 613 | ABC42954 | 14644 | 45148 | 75652, 106156, 136660, 167164, 197668 | 6796 | AEJ10503 | 20827 | 51331 | 81835, 112339, 142843, 173347, 203851 |
| 614 | ABC42965 | 14645 | 45149 | 75653, 106157, 136661, 167165, 197669 | 6797 | AEJ10523 | 20828 | 51332 | 81836, 112340, 142844, 173348, 203852 |
| 615 | ABC42976 | 14646 | 45150 | 75654, 106158, 136662, 167166, 197670 | 6798 | AEJ10533 | 20829 | 51333 | 81837, 112341, 142845, 173349, 203853 |
| 616 | ABC42987 | 14647 | 45151 | 75655, 106159, 136663, 167167, 197671 | 6799 | AEJ10543 | 20830 | 51334 | 81838, 112342, 142846, 173350, 203854 |
| 617 | ABC42998 | 14648 | 45152 | 75656, 106160, 136664, 167168, 197672 | 6800 | AEJ10553 | 20831 | 51335 | 81839, 112343, 142847, 173351, 203855 |
| 618 | ABC43009 | 14649 | 45153 | 75657, 106161, 136665, 167169, 197673 | 6801 | AEJ10563 | 20832 | 51336 | 81840, 112344, 142848, 173352, 203856 |
| 619 | ABC43020 | 14650 | 45154 | 75658, 106162, 136666, 167170, 197674 | 6802 | AEJ10573 | 20833 | 51337 | 81841, 112345, 142849, 173353, 203857 |
| 620 | ABC43042 | 14651 | 45155 | 75659, 106163, 136667, 167171, 197675 | 6803 | AEJ10583 | 20834 | 51338 | 81842, 112346, 142850, 173354, 203858 |
| 621 | ABC43053 | 14652 | 45156 | 75660, 106164, 136668, 167172, 197676 | 6804 | AEJ36305 | 20835 | 51339 | 81843, 112347, 142851, 173355, 203859 |
| 622 | ABC43064 | 14653 | 45157 | 75661, 106165, 136669, 167173, 197677 | 6805 | AEJ37856 | 20836 | 51340 | 81844, 112348, 142852, 173356, 203860 |
| 623 | ABC43075 | 14654 | 45158 | 75662, 106166, 136670, 167174, 197678 | 6806 | AEJ37866 | 20837 | 51341 | 81845, 112349, 142853, 173357, 203861 |

FIG. 3 continued

| | | | | | | | | | |
|---|---|---|---|---|---|---|---|---|---|
| 624 | ABC43086 | 14655 | 45159 | 75663, 106167, 136671, 167175, 197679 | 6807 | AEJ37876 | 20838 | 51342 | 81846, 112350, 142854, 173358, 203862 |
| 625 | ABC43097 | 14656 | 45160 | 75664, 106168, 136672, 167176, 197680 | 6808 | AEJ37886 | 20839 | 51343 | 81847, 112351, 142855, 173359, 203863 |
| 626 | ABC43108 | 14657 | 45161 | 75665, 106169, 136673, 167177, 197681 | 6809 | AEJ37896 | 20840 | 51344 | 81848, 112352, 142856, 173360, 203864 |
| 627 | ABC43119 | 14658 | 45162 | 75666, 106170, 136674, 167178, 197682 | 6810 | AEJ37906 | 20841 | 51345 | 81849, 112353, 142857, 173361, 203865 |
| 628 | ABC43130 | 14659 | 45163 | 75667, 106171, 136675, 167179, 197683 | 6811 | AEJ37916 | 20842 | 51346 | 81850, 112354, 142858, 173362, 203866 |
| 629 | ABC43141 | 14660 | 45164 | 75668, 106172, 136676, 167180, 197684 | 6812 | AEJ37926 | 20843 | 51347 | 81851, 112355, 142859, 173363, 203867 |
| 630 | ABC43152 | 14661 | 45165 | 75669, 106173, 136677, 167181, 197685 | 6813 | AEJ37936 | 20844 | 51348 | 81852, 112356, 142860, 173364, 203868 |
| 631 | ABC43163 | 14662 | 45166 | 75670, 106174, 136678, 167182, 197686 | 6814 | AEJ37946 | 20845 | 51349 | 81853, 112357, 142861, 173365, 203869 |
| 632 | ABC43174 | 14663 | 45167 | 75671, 106175, 136679, 167183, 197687 | 6815 | AEJ37956 | 20846 | 51350 | 81854, 112358, 142862, 173366, 203870 |
| 633 | ABC43185 | 14664 | 45168 | 75672, 106176, 136680, 167184, 197688 | 6816 | AEJ37966 | 20847 | 51351 | 81855, 112359, 142863, 173367, 203871 |
| 634 | ABC43478 | 14665 | 45169 | 75673, 106177, 136681, 167185, 197689 | 6817 | AEJ37976 | 20848 | 51352 | 81856, 112360, 142864, 173368, 203872 |
| 635 | ABC43489 | 14666 | 45170 | 75674, 106178, 136682, 167186, 197690 | 6818 | AEJ37986 | 20849 | 51353 | 81857, 112361, 142865, 173369, 203873 |
| 636 | ABC43500 | 14667 | 45171 | 75675, 106179, 136683, 167187, 197691 | 6819 | AEK21372 | 20850 | 51354 | 81858, 112362, 142866, 173370, 203874 |
| 637 | ABC43511 | 14668 | 45172 | 75676, 106180, 136684, 167188, 197692 | 6820 | AEK21383 | 20851 | 51355 | 81859, 112363, 142867, 173371, 203875 |
| 638 | ABC43522 | 14669 | 45173 | 75677, 106181, 136685, 167189, 197693 | 6821 | AEK21399 | 20852 | 51356 | 81860, 112364, 142868, 173372, 203876 |
| 639 | ABC43533 | 14670 | 45174 | 75678, 106182, 136686, 167190, 197694 | 6822 | AEK21409 | 20853 | 51357 | 81861, 112365, 142869, 173373, 203877 |
| 640 | ABC43544 | 14671 | 45175 | 75679, 106183, 136687, 167191, 197695 | 6823 | AEK21419 | 20854 | 51358 | 81862, 112366, 142870, 173374, 203878 |
| 641 | ABC43555 | 14672 | 45176 | 75680, 106184, 136688, 167192, 197696 | 6824 | AEK21429 | 20855 | 51359 | 81863, 112367, 142871, 173375, 203879 |

FIG. 3 continued

| | | | | | | | | | |
|---|---|---|---|---|---|---|---|---|---|
| 642 | ABC46557 | 14673 | 45177 | 75681, 106185, 136689, 167193, 197697 | 6825 | AEK21439 | 20856 | 51360 | 81864, 112368, 142872, 173376, 203880 |
| 643 | ABC46579 | 14674 | 45178 | 75682, 106186, 136690, 167194, 197698 | 6826 | AEK21449 | 20857 | 51361 | 81865, 112369, 142873, 173377, 203881 |
| 644 | ABC50170 | 14675 | 45179 | 75683, 106187, 136691, 167195, 197699 | 6827 | AEK21459 | 20858 | 51362 | 81866, 112370, 142874, 173378, 203882 |
| 645 | ABC50181 | 14676 | 45180 | 75684, 106188, 136692, 167196, 197700 | 6828 | AEK21469 | 20859 | 51363 | 81867, 112371, 142875, 173379, 203883 |
| 646 | ABC50192 | 14677 | 45181 | 75685, 106189, 136693, 167197, 197701 | 6829 | AEK21479 | 20860 | 51364 | 81868, 112372, 142876, 173380, 203884 |
| 647 | ABC50203 | 14678 | 45182 | 75686, 106190, 136694, 167198, 197702 | 6830 | AEK21489 | 20861 | 51365 | 81869, 112373, 142877, 173381, 203885 |
| 648 | ABC50214 | 14679 | 45183 | 75687, 106191, 136695, 167199, 197703 | 6831 | AEK28776 | 20862 | 51366 | 81870, 112374, 142878, 173382, 203886 |
| 649 | ABC50225 | 14680 | 45184 | 75688, 106192, 136696, 167200, 197704 | 6832 | AEK28787 | 20863 | 51367 | 81871, 112375, 142879, 173383, 203887 |
| 650 | ABC50247 | 14681 | 45185 | 75689, 106193, 136697, 167201, 197705 | 6833 | AEK28798 | 20864 | 51368 | 81872, 112376, 142880, 173384, 203888 |
| 651 | ABC50258 | 14682 | 45186 | 75690, 106194, 136698, 167202, 197706 | 6834 | AEK28809 | 20865 | 51369 | 81873, 112377, 142881, 173385, 203889 |
| 652 | ABC50280 | 14683 | 45187 | 75691, 106195, 136699, 167203, 197707 | 6835 | AEK28819 | 20866 | 51370 | 81874, 112378, 142882, 173386, 203890 |
| 653 | ABC50291 | 14684 | 45188 | 75692, 106196, 136700, 167204, 197708 | 6836 | AEK28830 | 20867 | 51371 | 81875, 112379, 142883, 173387, 203891 |
| 654 | ABC50302 | 14685 | 45189 | 75693, 106197, 136701, 167205, 197709 | 6837 | AEK28841 | 20868 | 51372 | 81876, 112380, 142884, 173388, 203892 |
| 655 | ABC50313 | 14686 | 45190 | 75694, 106198, 136702, 167206, 197710 | 6838 | AEK28852 | 20869 | 51373 | 81877, 112381, 142885, 173389, 203893 |
| 656 | ABC50324 | 14687 | 45191 | 75695, 106199, 136703, 167207, 197711 | 6839 | AEK28863 | 20870 | 51374 | 81878, 112382, 142886, 173390, 203894 |
| 657 | ABC50335 | 14688 | 45192 | 75696, 106200, 136704, 167208, 197712 | 6840 | AEK28874 | 20871 | 51375 | 81879, 112383, 142887, 173391, 203895 |
| 658 | ABC50346 | 14689 | 45193 | 75697, 106201, 136705, 167209, 197713 | 6841 | AEK28885 | 20872 | 51376 | 81880, 112384, 142888, 173392, 203896 |
| 659 | ABC50357 | 14690 | 45194 | 75698, 106202, 136706, 167210, 197714 | 6842 | AEK28896 | 20873 | 51377 | 81881, 112385, 142889, 173393, 203897 |

FIG. 3 continued

| | | | | | | | | | |
|---|---|---|---|---|---|---|---|---|---|
| 660 | ABC50368 | 14691 | 45195 | 75699, 106203, 136707, 167211, 197715 | 6843 | AEK28907 | 20874 | 51378 | 81882, 112386, 142890, 173394, 203898 |
| 661 | ABC50379 | 14692 | 45196 | 75700, 106204, 136708, 167212, 197716 | 6844 | AEK28918 | 20875 | 51379 | 81883, 112387, 142891, 173395, 203899 |
| 662 | ABC50390 | 14693 | 45197 | 75701, 106205, 136709, 167213, 197717 | 6845 | AEK28929 | 20876 | 51380 | 81884, 112388, 142892, 173396, 203900 |
| 663 | ABC50412 | 14694 | 45198 | 75702, 106206, 136710, 167214, 197718 | 6846 | AEK28951 | 20877 | 51381 | 81885, 112389, 142893, 173397, 203901 |
| 664 | ABC50423 | 14695 | 45199 | 75703, 106207, 136711, 167215, 197719 | 6847 | AEK28962 | 20878 | 51382 | 81886, 112390, 142894, 173398, 203902 |
| 665 | ABC54671 | 14696 | 45200 | 75704, 106208, 136712, 167216, 197720 | 6848 | AEK28973 | 20879 | 51383 | 81887, 112391, 142895, 173399, 203903 |
| 666 | ABC54682 | 14697 | 45201 | 75705, 106209, 136713, 167217, 197721 | 6849 | AEK28984 | 20880 | 51384 | 81888, 112392, 142896, 173400, 203904 |
| 667 | ABC67322 | 14698 | 45202 | 75706, 106210, 136714, 167218, 197722 | 6850 | AEK28995 | 20881 | 51385 | 81889, 112393, 142897, 173401, 203905 |
| 668 | ABC67474 | 14699 | 45203 | 75707, 106211, 136715, 167219, 197723 | 6851 | AEK29006 | 20882 | 51386 | 81890, 112394, 142898, 173402, 203906 |
| 669 | ABC67546 | 14700 | 45204 | 75708, 106212, 136716, 167220, 197724 | 6852 | AEK29028 | 20883 | 51387 | 81891, 112395, 142899, 173403, 203907 |
| 670 | ABC67557 | 14701 | 45205 | 75709, 106213, 136717, 167221, 197725 | 6853 | AEK29050 | 20884 | 51388 | 81892, 112396, 142900, 173404, 203908 |
| 671 | ABC67568 | 14702 | 45206 | 75710, 106214, 136718, 167222, 197726 | 6854 | AEK29061 | 20885 | 51389 | 81893, 112397, 142901, 173405, 203909 |
| 672 | ABC67579 | 14703 | 45207 | 75711, 106215, 136719, 167223, 197727 | 6855 | AEK29083 | 20886 | 51390 | 81894, 112398, 142902, 173406, 203910 |
| 673 | ABC67590 | 14704 | 45208 | 75712, 106216, 136720, 167224, 197728 | 6856 | AEK29094 | 20887 | 51391 | 81895, 112399, 142903, 173407, 203911 |
| 674 | ABC67601 | 14705 | 45209 | 75713, 106217, 136721, 167225, 197729 | 6857 | AEK29127 | 20888 | 51392 | 81896, 112400, 142904, 173408, 203912 |
| 675 | ABC67612 | 14706 | 45210 | 75714, 106218, 136722, 167226, 197730 | 6858 | AEK29138 | 20889 | 51393 | 81897, 112401, 142905, 173409, 203913 |
| 676 | ABC67623 | 14707 | 45211 | 75715, 106219, 136723, 167227, 197731 | 6859 | AEK29182 | 20890 | 51394 | 81898, 112402, 142906, 173410, 203914 |
| 677 | ABC67634 | 14708 | 45212 | 75716, 106220, 136724, 167228, 197732 | 6860 | AEK29204 | 20891 | 51395 | 81899, 112403, 142907, 173411, 203915 |

FIG. 3 continued

| | | | | | | | | | |
|---|---|---|---|---|---|---|---|---|---|
| 678 | ABC67645 | 14709 | 45213 | 75717, 106221, 136725, 167229, 197733 | 6861 | AEK29215 | 20892 | 51396 | 81900, 112404, 142908, 173412, 203916 |
| 679 | ABC67656 | 14710 | 45214 | 75718, 106222, 136726, 167230, 197734 | 6862 | AEK29237 | 20893 | 51397 | 81901, 112405, 142909, 173413, 203917 |
| 680 | ABC67700 | 14711 | 45215 | 75719, 106223, 136727, 167231, 197735 | 6863 | AEK29248 | 20894 | 51398 | 81902, 112406, 142910, 173414, 203918 |
| 681 | ABC67711 | 14712 | 45216 | 75720, 106224, 136728, 167232, 197736 | 6864 | AEK29259 | 20895 | 51399 | 81903, 112407, 142911, 173415, 203919 |
| 682 | ABC67736 | 14713 | 45217 | 75721, 106225, 136729, 167233, 197737 | 6865 | AEK29270 | 20896 | 51400 | 81904, 112408, 142912, 173416, 203920 |
| 683 | ABC67809 | 14714 | 45218 | 75722, 106226, 136730, 167234, 197738 | 6866 | AEK59839 | 20897 | 51401 | 81905, 112409, 142913, 173417, 203921 |
| 684 | ABC67820 | 14715 | 45219 | 75723, 106227, 136731, 167235, 197739 | 6867 | AEK98375 | 20898 | 51402 | 81906, 112410, 142914, 173418, 203922 |
| 685 | ABC67842 | 14716 | 45220 | 75724, 106228, 136732, 167236, 197740 | 6868 | AEK98377 | 20899 | 51403 | 81907, 112411, 142915, 173419, 203923 |
| 686 | ABC67853 | 14717 | 45221 | 75725, 106229, 136733, 167237, 197741 | 6869 | AEK98379 | 20900 | 51404 | 81908, 112412, 142916, 173420, 203924 |
| 687 | ABC67864 | 14718 | 45222 | 75726, 106230, 136734, 167238, 197742 | 6870 | AEK98381 | 20901 | 51405 | 81909, 112413, 142917, 173421, 203925 |
| 688 | ABC67886 | 14719 | 45223 | 75727, 106231, 136735, 167239, 197743 | 6871 | AEK98383 | 20902 | 51406 | 81910, 112414, 142918, 173422, 203926 |
| 689 | ABC67897 | 14720 | 45224 | 75728, 106232, 136736, 167240, 197744 | 6872 | AEK98385 | 20903 | 51407 | 81911, 112415, 142919, 173423, 203927 |
| 690 | ABC67970 | 14721 | 45225 | 75729, 106233, 136737, 167241, 197745 | 6873 | AEK98387 | 20904 | 51408 | 81912, 112416, 142920, 173424, 203928 |
| 691 | ABC67981 | 14722 | 45226 | 75730, 106234, 136738, 167242, 197746 | 6874 | AEK98389 | 20905 | 51409 | 81913, 112417, 142921, 173425, 203929 |
| 692 | ABC67992 | 14723 | 45227 | 75731, 106235, 136739, 167243, 197747 | 6875 | AEK98393 | 20906 | 51410 | 81914, 112418, 142922, 173426, 203930 |
| 693 | ABC68003 | 14724 | 45228 | 75732, 106236, 136740, 167244, 197748 | 6876 | AEK98395 | 20907 | 51411 | 81915, 112419, 142923, 173427, 203931 |
| 694 | ABC68052 | 14725 | 45229 | 75733, 106237, 136741, 167245, 197749 | 6877 | AEK98397 | 20908 | 51412 | 81916, 112420, 142924, 173428, 203932 |
| 695 | ABC68063 | 14726 | 45230 | 75734, 106238, 136742, 167246, 197750 | 6878 | AEK98399 | 20909 | 51413 | 81917, 112421, 142925, 173429, 203933 |

FIG. 3 continued

| | | | | | | | | | |
|---|---|---|---|---|---|---|---|---|---|
| 696 | ABC68074 | 14727 | 45231 | 75735, 106239, 136743, 167247, 197751 | 6879 | AEK98403 | 20910 | 51414 | 81918, 112422, 142926, 173430, 203934 |
| 697 | ABC68085 | 14728 | 45232 | 75736, 106240, 136744, 167248, 197752 | 6880 | AEK98405 | 20911 | 51415 | 81919, 112423, 142927, 173431, 203935 |
| 698 | ABC68096 | 14729 | 45233 | 75737, 106241, 136745, 167249, 197753 | 6881 | AEK98407 | 20912 | 51416 | 81920, 112424, 142928, 173432, 203936 |
| 699 | ABC68225 | 14730 | 45234 | 75738, 106242, 136746, 167250, 197754 | 6882 | AEL11690 | 20913 | 51417 | 81921, 112425, 142929, 173433, 203937 |
| 700 | ABC68236 | 14731 | 45235 | 75739, 106243, 136747, 167251, 197755 | 6883 | AEL89300 | 20914 | 51418 | 81922, 112426, 142930, 173434, 203938 |
| 701 | ABC72646 | 14732 | 45236 | 75740, 106244, 136748, 167252, 197756 | 6884 | AEL89310 | 20915 | 51419 | 81923, 112427, 142931, 173435, 203939 |
| 702 | ABC84392 | 14733 | 45237 | 75741, 106245, 136749, 167253, 197757 | 6885 | AEL89320 | 20916 | 51420 | 81924, 112428, 142932, 173436, 203940 |
| 703 | ABC84403 | 14734 | 45238 | 75742, 106246, 136750, 167254, 197758 | 6886 | AEL89330 | 20917 | 51421 | 81925, 112429, 142933, 173437, 203941 |
| 704 | ABC84414 | 14735 | 45239 | 75743, 106247, 136751, 167255, 197759 | 6887 | AEL89340 | 20918 | 51422 | 81926, 112430, 142934, 173438, 203942 |
| 705 | ABC84425 | 14736 | 45240 | 75744, 106248, 136752, 167256, 197760 | 6888 | AEL89350 | 20919 | 51423 | 81927, 112431, 142935, 173439, 203943 |
| 706 | ABC84436 | 14737 | 45241 | 75745, 106249, 136753, 167257, 197761 | 6889 | AEL89360 | 20920 | 51424 | 81928, 112432, 142936, 173440, 203944 |
| 707 | ABC84447 | 14738 | 45242 | 75746, 106250, 136754, 167258, 197762 | 6890 | AEL89370 | 20921 | 51425 | 81929, 112433, 142937, 173441, 203945 |
| 708 | ABC84501 | 14739 | 45243 | 75747, 106251, 136755, 167259, 197763 | 6891 | AEL89394 | 20922 | 51426 | 81930, 112434, 142938, 173442, 203946 |
| 709 | ABC84512 | 14740 | 45244 | 75748, 106252, 136756, 167260, 197764 | 6892 | AEL89404 | 20923 | 51427 | 81931, 112435, 142939, 173443, 203947 |
| 710 | ABC84523 | 14741 | 45245 | 75749, 106253, 136757, 167261, 197765 | 6893 | AEL89414 | 20924 | 51428 | 81932, 112436, 142940, 173444, 203948 |
| 711 | ABC84545 | 14742 | 45246 | 75750, 106254, 136758, 167262, 197766 | 6894 | AEL89424 | 20925 | 51429 | 81933, 112437, 142941, 173445, 203949 |
| 712 | ABC84574 | 14743 | 45247 | 75751, 106255, 136759, 167263, 197767 | 6895 | AEL89434 | 20926 | 51430 | 81934, 112438, 142942, 173446, 203950 |
| 713 | ABC85757 | 14744 | 45248 | 75752, 106256, 136760, 167264, 197768 | 6896 | AEL89444 | 20927 | 51431 | 81935, 112439, 142943, 173447, 203951 |

FIG. 3 continued

| | | | | | | | | | |
|---|---|---|---|---|---|---|---|---|---|
| 714 | ABC85768 | 14745 | 45249 | 75753, 106257, 136761, 167265, 197769 | 6897 | AEL89454 | 20928 | 51432 | 81936, 112440, 142944, 173448, 203952 |
| 715 | ABC85779 | 14746 | 45250 | 75754, 106258, 136762, 167266, 197770 | 6898 | AEL89464 | 20929 | 51433 | 81937, 112441, 142945, 173449, 203953 |
| 716 | ABC85790 | 14747 | 45251 | 75755, 106259, 136763, 167267, 197771 | 6899 | AEL89474 | 20930 | 51434 | 81938, 112442, 142946, 173450, 203954 |
| 717 | ABC85801 | 14748 | 45252 | 75756, 106260, 136764, 167268, 197772 | 6900 | AEL89484 | 20931 | 51435 | 81939, 112443, 142947, 173451, 203955 |
| 718 | ABC85812 | 14749 | 45253 | 75757, 106261, 136765, 167269, 197773 | 6901 | AEL89494 | 20932 | 51436 | 81940, 112444, 142948, 173452, 203956 |
| 719 | ABC85823 | 14750 | 45254 | 75758, 106262, 136766, 167270, 197774 | 6902 | AEL89514 | 20933 | 51437 | 81941, 112445, 142949, 173453, 203957 |
| 720 | ABC85834 | 14751 | 45255 | 75759, 106263, 136767, 167271, 197775 | 6903 | AEL89524 | 20934 | 51438 | 81942, 112446, 142950, 173454, 203958 |
| 721 | ABC85845 | 14752 | 45256 | 75760, 106264, 136768, 167272, 197776 | 6904 | AEL89534 | 20935 | 51439 | 81943, 112447, 142951, 173455, 203959 |
| 722 | ABC85856 | 14753 | 45257 | 75761, 106265, 136769, 167273, 197777 | 6905 | AEL89544 | 20936 | 51440 | 81944, 112448, 142952, 173456, 203960 |
| 723 | ABC85867 | 14754 | 45258 | 75762, 106266, 136770, 167274, 197778 | 6906 | AEL89554 | 20937 | 51441 | 81945, 112449, 142953, 173457, 203961 |
| 724 | ABC85900 | 14755 | 45259 | 75763, 106267, 136771, 167275, 197779 | 6907 | AEL89564 | 20938 | 51442 | 81946, 112450, 142954, 173458, 203962 |
| 725 | ABC85911 | 14756 | 45260 | 75764, 106268, 136772, 167276, 197780 | 6908 | AEL89574 | 20939 | 51443 | 81947, 112451, 142955, 173459, 203963 |
| 726 | ABC85922 | 14757 | 45261 | 75765, 106269, 136773, 167277, 197781 | 6909 | AEL89584 | 20940 | 51444 | 81948, 112452, 142956, 173460, 203964 |
| 727 | ABC85933 | 14758 | 45262 | 75766, 106270, 136774, 167278, 197782 | 6910 | AEL89604 | 20941 | 51445 | 81949, 112453, 142957, 173461, 203965 |
| 728 | ABC85955 | 14759 | 45263 | 75767, 106271, 136775, 167279, 197783 | 6911 | AEL89624 | 20942 | 51446 | 81950, 112454, 142958, 173462, 203966 |
| 729 | ABC85966 | 14760 | 45264 | 75768, 106272, 136776, 167280, 197784 | 6912 | AEL89634 | 20943 | 51447 | 81951, 112455, 142959, 173463, 203967 |
| 730 | ABC85977 | 14761 | 45265 | 75769, 106273, 136777, 167281, 197785 | 6913 | AEL89644 | 20944 | 51448 | 81952, 112456, 142960, 173464, 203968 |
| 731 | ABC85988 | 14762 | 45266 | 75770, 106274, 136778, 167282, 197786 | 6914 | AEL89654 | 20945 | 51449 | 81953, 112457, 142961, 173465, 203969 |

FIG. 3 continued

| | | | | | | | | | |
|---|---|---|---|---|---|---|---|---|---|
| 732 | ABC85999 | 14763 | 45267 | 75771, 106275, 136779, 167283, 197787 | 6915 | AEL89664 | 20946 | 51450 | 81954, 112458, 142962, 173466, 203970 |
| 733 | ABC86010 | 14764 | 45268 | 75772, 106276, 136780, 167284, 197788 | 6916 | AEL89674 | 20947 | 51451 | 81955, 112459, 142963, 173467, 203971 |
| 734 | ABC86021 | 14765 | 45269 | 75773, 106277, 136781, 167285, 197789 | 6917 | AEL89694 | 20948 | 51452 | 81956, 112460, 142964, 173468, 203972 |
| 735 | ABC86127 | 14766 | 45270 | 75774, 106278, 136782, 167286, 197790 | 6918 | AEL89704 | 20949 | 51453 | 81957, 112461, 142965, 173469, 203973 |
| 736 | ABC86140 | 14767 | 45271 | 75775, 106279, 136783, 167287, 197791 | 6919 | AEL89714 | 20950 | 51454 | 81958, 112462, 142966, 173470, 203974 |
| 737 | ABC86151 | 14768 | 45272 | 75776, 106280, 136784, 167288, 197792 | 6920 | AEL89744 | 20951 | 51455 | 81959, 112463, 142967, 173471, 203975 |
| 738 | ABC86240 | 14769 | 45273 | 75777, 106281, 136785, 167289, 197793 | 6921 | AEL89754 | 20952 | 51456 | 81960, 112464, 142968, 173472, 203976 |
| 739 | ABC97377 | 14770 | 45274 | 75778, 106282, 136786, 167290, 197794 | 6922 | AEL89774 | 20953 | 51457 | 81961, 112465, 142969, 173473, 203977 |
| 740 | ABD15452 | 14771 | 45275 | 75779, 106283, 136787, 167291, 197795 | 6923 | AEL89784 | 20954 | 51458 | 81962, 112466, 142970, 173474, 203978 |
| 741 | ABD15463 | 14772 | 45276 | 75780, 106284, 136788, 167292, 197796 | 6924 | AEL89794 | 20955 | 51459 | 81963, 112467, 142971, 173475, 203979 |
| 742 | ABD15474 | 14773 | 45277 | 75781, 106285, 136789, 167293, 197797 | 6925 | AEL89804 | 20956 | 51460 | 81964, 112468, 142972, 173476, 203980 |
| 743 | ABD15485 | 14774 | 45278 | 75782, 106286, 136790, 167294, 197798 | 6926 | AEL89815 | 20957 | 51461 | 81965, 112469, 142973, 173477, 203981 |
| 744 | ABD15496 | 14775 | 45279 | 75783, 106287, 136791, 167295, 197799 | 6927 | AEL89825 | 20958 | 51462 | 81966, 112470, 142974, 173478, 203982 |
| 745 | ABD15507 | 14776 | 45280 | 75784, 106288, 136792, 167296, 197800 | 6928 | AEL89835 | 20959 | 51463 | 81967, 112471, 142975, 173479, 203983 |
| 746 | ABD15518 | 14777 | 45281 | 75785, 106289, 136793, 167297, 197801 | 6929 | AEL89845 | 20960 | 51464 | 81968, 112472, 142976, 173480, 203984 |
| 747 | ABD15529 | 14778 | 45282 | 75786, 106290, 136794, 167298, 197802 | 6930 | AEL89855 | 20961 | 51465 | 81969, 112473, 142977, 173481, 203985 |
| 748 | ABD15551 | 14779 | 45283 | 75787, 106291, 136795, 167299, 197803 | 6931 | AEL93581 | 20962 | 51466 | 81970, 112474, 142978, 173482, 203986 |
| 749 | ABD15562 | 14780 | 45284 | 75788, 106292, 136796, 167300, 197804 | 6932 | AEL93591 | 20963 | 51467 | 81971, 112475, 142979, 173483, 203987 |

FIG. 3 continued

| | | | | | | | | | |
|---|---|---|---|---|---|---|---|---|---|
| 750 | ABD15573 | 14781 | 45285 | 75789, 106293, 136797, 167301, 197805 | 6933 | AEL93601 | 20964 | 51468 | 81972, 112476, 142980, 173484, 203988 |
| 751 | ABD15584 | 14782 | 45286 | 75790, 106294, 136798, 167302, 197806 | 6934 | AEL93611 | 20965 | 51469 | 81973, 112477, 142981, 173485, 203989 |
| 752 | ABD15595 | 14783 | 45287 | 75791, 106295, 136799, 167303, 197807 | 6935 | AEL93621 | 20966 | 51470 | 81974, 112478, 142982, 173486, 203990 |
| 753 | ABD15606 | 14784 | 45288 | 75792, 106296, 136800, 167304, 197808 | 6936 | AEL93631 | 20967 | 51471 | 81975, 112479, 142983, 173487, 203991 |
| 754 | ABD15617 | 14785 | 45289 | 75793, 106297, 136801, 167305, 197809 | 6937 | AEL93641 | 20968 | 51472 | 81976, 112480, 142984, 173488, 203992 |
| 755 | ABD15639 | 14786 | 45290 | 75794, 106298, 136802, 167306, 197810 | 6938 | AEL94890 | 20969 | 51473 | 81977, 112481, 142985, 173489, 203993 |
| 756 | ABD15650 | 14787 | 45291 | 75795, 106299, 136803, 167307, 197811 | 6939 | AEL95429 | 20970 | 51474 | 81978, 112482, 142986, 173490, 203994 |
| 757 | ABD15661 | 14788 | 45292 | 75796, 106300, 136804, 167308, 197812 | 6940 | AEL97634 | 20971 | 51475 | 81979, 112483, 142987, 173491, 203995 |
| 758 | ABD15683 | 14789 | 45293 | 75797, 106301, 136805, 167309, 197813 | 6941 | AEL99667 | 20972 | 51476 | 81980, 112484, 142988, 173492, 203996 |
| 759 | ABD15694 | 14790 | 45294 | 75798, 106302, 136806, 167310, 197814 | 6942 | AEL99677 | 20973 | 51477 | 81981, 112485, 142989, 173493, 203997 |
| 760 | ABD15705 | 14791 | 45295 | 75799, 106303, 136807, 167311, 197815 | 6943 | AEM53471 | 20974 | 51478 | 81982, 112486, 142990, 173494, 203998 |
| 761 | ABD15727 | 14792 | 45296 | 75800, 106304, 136808, 167312, 197816 | 6944 | AEM60040 | 20975 | 51479 | 81983, 112487, 142991, 173495, 203999 |
| 762 | ABD15749 | 14793 | 45297 | 75801, 106305, 136809, 167313, 197817 | 6945 | AEM60061 | 20976 | 51480 | 81984, 112488, 142992, 173496, 204000 |
| 763 | ABD15760 | 14794 | 45298 | 75802, 106306, 136810, 167314, 197818 | 6946 | AEM60072 | 20977 | 51481 | 81985, 112489, 142993, 173497, 204001 |
| 764 | ABD15771 | 14795 | 45299 | 75803, 106307, 136811, 167315, 197819 | 6947 | AEM62774 | 20978 | 51482 | 81986, 112490, 142994, 173498, 204002 |
| 765 | ABD15782 | 14796 | 45300 | 75804, 106308, 136812, 167316, 197820 | 6948 | AEM62783 | 20979 | 51483 | 81987, 112491, 142995, 173499, 204003 |
| 766 | ABD15793 | 14797 | 45301 | 75805, 106309, 136813, 167317, 197821 | 6949 | AEM62792 | 20980 | 51484 | 81988, 112492, 142996, 173500, 204004 |
| 767 | ABD16306 | 14798 | 45302 | 75806, 106310, 136814, 167318, 197822 | 6950 | AEM62801 | 20981 | 51485 | 81989, 112493, 142997, 173501, 204005 |

FIG. 3 continued

| | | | | | | | | | |
|---|---|---|---|---|---|---|---|---|---|
| 768 | ABD16317 | 14799 | 45303 | 75807, 106311, 136815, 167319, 197823 | 6951 | AEM62810 | 20982 | 51486 | 81990, 112494, 142998, 173502, 204006 |
| 769 | ABD16328 | 14800 | 45304 | 75808, 106312, 136816, 167320, 197824 | 6952 | AEM62819 | 20983 | 51487 | 81991, 112495, 142999, 173503, 204007 |
| 770 | ABD16339 | 14801 | 45305 | 75809, 106313, 136817, 167321, 197825 | 6953 | AEM62828 | 20984 | 51488 | 81992, 112496, 143000, 173504, 204008 |
| 771 | ABD16361 | 14802 | 45306 | 75810, 106314, 136818, 167322, 197826 | 6954 | AEM62837 | 20985 | 51489 | 81993, 112497, 143001, 173505, 204009 |
| 772 | ABD16475 | 14803 | 45307 | 75811, 106315, 136819, 167323, 197827 | 6955 | AEM62846 | 20986 | 51490 | 81994, 112498, 143002, 173506, 204010 |
| 773 | ABD16486 | 14804 | 45308 | 75812, 106316, 136820, 167324, 197828 | 6956 | AEM62855 | 20987 | 51491 | 81995, 112499, 143003, 173507, 204011 |
| 774 | ABD16497 | 14805 | 45309 | 75813, 106317, 136821, 167325, 197829 | 6957 | AEM62864 | 20988 | 51492 | 81996, 112500, 143004, 173508, 204012 |
| 775 | ABD16508 | 14806 | 45310 | 75814, 106318, 136822, 167326, 197830 | 6958 | AEM62872 | 20989 | 51493 | 81997, 112501, 143005, 173509, 204013 |
| 776 | ABD16519 | 14807 | 45311 | 75815, 106319, 136823, 167327, 197831 | 6959 | AEM92310 | 20990 | 51494 | 81998, 112502, 143006, 173510, 204014 |
| 777 | ABD16530 | 14808 | 45312 | 75816, 106320, 136824, 167328, 197832 | 6960 | AEM92320 | 20991 | 51495 | 81999, 112503, 143007, 173511, 204015 |
| 778 | ABD16541 | 14809 | 45313 | 75817, 106321, 136825, 167329, 197833 | 6961 | AEM92340 | 20992 | 51496 | 82000, 112504, 143008, 173512, 204016 |
| 779 | ABD16552 | 14810 | 45314 | 75818, 106322, 136826, 167330, 197834 | 6962 | AEM92350 | 20993 | 51497 | 82001, 112505, 143009, 173513, 204017 |
| 780 | ABD16563 | 14811 | 45315 | 75819, 106323, 136827, 167331, 197835 | 6963 | AEM92360 | 20994 | 51498 | 82002, 112506, 143010, 173514, 204018 |
| 781 | ABD16574 | 14812 | 45316 | 75820, 106324, 136828, 167332, 197836 | 6964 | AEM92370 | 20995 | 51499 | 82003, 112507, 143011, 173515, 204019 |
| 782 | ABD16585 | 14813 | 45317 | 75821, 106325, 136829, 167333, 197837 | 6965 | AEM92380 | 20996 | 51500 | 82004, 112508, 143012, 173516, 204020 |
| 783 | ABD16721 | 14814 | 45318 | 75822, 106326, 136830, 167334, 197838 | 6966 | AEM92399 | 20997 | 51501 | 82005, 112509, 143013, 173517, 204021 |
| 784 | ABD16732 | 14815 | 45319 | 75823, 106327, 136831, 167335, 197839 | 6967 | AEM92409 | 20998 | 51502 | 82006, 112510, 143014, 173518, 204022 |
| 785 | ABD16743 | 14816 | 45320 | 75824, 106328, 136832, 167336, 197840 | 6968 | AEM92419 | 20999 | 51503 | 82007, 112511, 143015, 173519, 204023 |

FIG. 3 continued

| | | | | | | | | | |
|---|---|---|---|---|---|---|---|---|---|
| 786 | ABD16754 | 14817 | 45321 | 75825, 106329, 136833, 167337, 197841 | 6969 | AEM92430 | 21000 | 51504 | 82008, 112512, 143016, 173520, 204024 |
| 787 | ABD16765 | 14818 | 45322 | 75826, 106330, 136834, 167338, 197842 | 6970 | AEM92440 | 21001 | 51505 | 82009, 112513, 143017, 173521, 204025 |
| 788 | ABD17326 | 14819 | 45323 | 75827, 106331, 136835, 167339, 197843 | 6971 | AEM92450 | 21002 | 51506 | 82010, 112514, 143018, 173522, 204026 |
| 789 | ABD38137 | 14820 | 45324 | 75828, 106332, 136836, 167340, 197844 | 6972 | AEM92460 | 21003 | 51507 | 82011, 112515, 143019, 173523, 204027 |
| 790 | ABD60782 | 14821 | 45325 | 75829, 106333, 136837, 167341, 197845 | 6973 | AEM92470 | 21004 | 51508 | 82012, 112516, 143020, 173524, 204028 |
| 791 | ABD60793 | 14822 | 45326 | 75830, 106334, 136838, 167342, 197846 | 6974 | AEM92480 | 21005 | 51509 | 82013, 112517, 143021, 173525, 204029 |
| 792 | ABD60804 | 14823 | 45327 | 75831, 106335, 136839, 167343, 197847 | 6975 | AEM92490 | 21006 | 51510 | 82014, 112518, 143022, 173526, 204030 |
| 793 | ABD60815 | 14824 | 45328 | 75832, 106336, 136840, 167344, 197848 | 6976 | AEM92500 | 21007 | 51511 | 82015, 112519, 143023, 173527, 204031 |
| 794 | ABD60826 | 14825 | 45329 | 75833, 106337, 136841, 167345, 197849 | 6977 | AEM92520 | 21008 | 51512 | 82016, 112520, 143024, 173528, 204032 |
| 795 | ABD60837 | 14826 | 45330 | 75834, 106338, 136842, 167346, 197850 | 6978 | AEM92550 | 21009 | 51513 | 82017, 112521, 143025, 173529, 204033 |
| 796 | ABD60848 | 14827 | 45331 | 75835, 106339, 136843, 167347, 197851 | 6979 | AEM92570 | 21010 | 51514 | 82018, 112522, 143026, 173530, 204034 |
| 797 | ABD60881 | 14828 | 45332 | 75836, 106340, 136844, 167348, 197852 | 6980 | AEM92580 | 21011 | 51515 | 82019, 112523, 143027, 173531, 204035 |
| 798 | ABD60892 | 14829 | 45333 | 75837, 106341, 136845, 167349, 197853 | 6981 | AEM92590 | 21012 | 51516 | 82020, 112524, 143028, 173532, 204036 |
| 799 | ABD60903 | 14830 | 45334 | 75838, 106342, 136846, 167350, 197854 | 6982 | AEM92600 | 21013 | 51517 | 82021, 112525, 143029, 173533, 204037 |
| 800 | ABD60914 | 14831 | 45335 | 75839, 106343, 136847, 167351, 197855 | 6983 | AEM92610 | 21014 | 51518 | 82022, 112526, 143030, 173534, 204038 |
| 801 | ABD60925 | 14832 | 45336 | 75840, 106344, 136848, 167352, 197856 | 6984 | AEM92620 | 21015 | 51519 | 82023, 112527, 143031, 173535, 204039 |
| 802 | ABD60947 | 14833 | 45337 | 75841, 106345, 136849, 167353, 197857 | 6985 | AEM92650 | 21016 | 51520 | 82024, 112528, 143032, 173536, 204040 |
| 803 | ABD61263 | 14834 | 45338 | 75842, 106346, 136850, 167354, 197858 | 6986 | AEM98410 | 21017 | 51521 | 82025, 112529, 143033, 173537, 204041 |

FIG. 3 continued

| | | | | | | | | | |
|---|---|---|---|---|---|---|---|---|---|
| 804 | ABD61274 | 14835 | 45339 | 75843, 106347, 136851, 167355, 197859 | 6987 | AEM98421 | 21018 | 51522 | 82026, 112530, 143034, 173538, 204042 |
| 805 | ABD61285 | 14836 | 45340 | 75844, 106348, 136852, 167356, 197860 | 6988 | AEM98432 | 21019 | 51523 | 82027, 112531, 143035, 173539, 204043 |
| 806 | ABD61296 | 14837 | 45341 | 75845, 106349, 136853, 167357, 197861 | 6989 | AEN55401 | 21020 | 51524 | 82028, 112532, 143036, 173540, 204044 |
| 807 | ABD61307 | 14838 | 45342 | 75846, 106350, 136854, 167358, 197862 | 6990 | AEN55411 | 21021 | 51525 | 82029, 112533, 143037, 173541, 204045 |
| 808 | ABD61318 | 14839 | 45343 | 75847, 106351, 136855, 167359, 197863 | 6991 | AEN55421 | 21022 | 51526 | 82030, 112534, 143038, 173542, 204046 |
| 809 | ABD61340 | 14840 | 45344 | 75848, 106352, 136856, 167360, 197864 | 6992 | AEN55466 | 21023 | 51527 | 82031, 112535, 143039, 173543, 204047 |
| 810 | ABD61351 | 14841 | 45345 | 75849, 106353, 136857, 167361, 197865 | 6993 | AEN55476 | 21024 | 51528 | 82032, 112536, 143040, 173544, 204048 |
| 811 | ABD61362 | 14842 | 45346 | 75850, 106354, 136858, 167362, 197866 | 6994 | AEN55486 | 21025 | 51529 | 82033, 112537, 143041, 173545, 204049 |
| 812 | ABD61373 | 14843 | 45347 | 75851, 106355, 136859, 167363, 197867 | 6995 | AEN55506 | 21026 | 51530 | 82034, 112538, 143042, 173546, 204050 |
| 813 | ABD61384 | 14844 | 45348 | 75852, 106356, 136860, 167364, 197868 | 6996 | AEN55516 | 21027 | 51531 | 82035, 112539, 143043, 173547, 204051 |
| 814 | ABD61395 | 14845 | 45349 | 75853, 106357, 136861, 167365, 197869 | 6997 | AEN55526 | 21028 | 51532 | 82036, 112540, 143044, 173548, 204052 |
| 815 | ABD61406 | 14846 | 45350 | 75854, 106358, 136862, 167366, 197870 | 6998 | AEN69429 | 21029 | 51533 | 82037, 112541, 143045, 173549, 204053 |
| 816 | ABD61521 | 14847 | 45351 | 75855, 106359, 136863, 167367, 197871 | 6999 | AEN69438 | 21030 | 51534 | 82038, 112542, 143046, 173550, 204054 |
| 817 | ABD61532 | 14848 | 45352 | 75856, 106360, 136864, 167368, 197872 | 7000 | AEN69484 | 21031 | 51535 | 82039, 112543, 143047, 173551, 204055 |
| 818 | ABD61543 | 14849 | 45353 | 75857, 106361, 136865, 167369, 197873 | 7001 | AEO01627 | 21032 | 51536 | 82040, 112544, 143048, 173552, 204056 |
| 819 | ABD63066 | 14850 | 45354 | 75858, 106362, 136866, 167370, 197874 | 7002 | AEO01638 | 21033 | 51537 | 82041, 112545, 143049, 173553, 204057 |
| 820 | ABD77601 | 14851 | 45355 | 75859, 106363, 136867, 167371, 197875 | 7003 | AEO01644 | 21034 | 51538 | 82042, 112546, 143050, 173554, 204058 |
| 821 | ABD77612 | 14852 | 45356 | 75860, 106364, 136868, 167372, 197876 | 7004 | AEO01654 | 21035 | 51539 | 82043, 112547, 143051, 173555, 204059 |

FIG. 3 continued

| | | | | | | | | | |
|---|---|---|---|---|---|---|---|---|---|
| 822 | ABD77634 | 14853 | 45357 | 75861, 106365, 136869, 167373, 197877 | 7005 | AE001665 | 21036 | 51540 | 82044, 112548, 143052, 173556, 204060 |
| 823 | ABD77645 | 14854 | 45358 | 75862, 106366, 136870, 167374, 197878 | 7006 | AE001676 | 21037 | 51541 | 82045, 112549, 143053, 173557, 204061 |
| 824 | ABD77656 | 14855 | 45359 | 75863, 106367, 136871, 167375, 197879 | 7007 | AE001693 | 21038 | 51542 | 82046, 112550, 143054, 173558, 204062 |
| 825 | ABD77700 | 14856 | 45360 | 75864, 106368, 136872, 167376, 197880 | 7008 | AE001711 | 21039 | 51543 | 82047, 112551, 143055, 173559, 204063 |
| 826 | ABD77722 | 14857 | 45361 | 75865, 106369, 136873, 167377, 197881 | 7009 | AE037533 | 21040 | 51544 | 82048, 112552, 143056, 173560, 204064 |
| 827 | ABD77733 | 14858 | 45362 | 75866, 106370, 136874, 167378, 197882 | 7010 | AE037543 | 21041 | 51545 | 82049, 112553, 143057, 173561, 204065 |
| 828 | ABD77744 | 14859 | 45363 | 75867, 106371, 136875, 167379, 197883 | 7011 | AE072179 | 21042 | 51546 | 82050, 112554, 143058, 173562, 204066 |
| 829 | ABD77755 | 14860 | 45364 | 75868, 106372, 136876, 167380, 197884 | 7012 | AE088957 | 21043 | 51547 | 82051, 112555, 143059, 173563, 204067 |
| 830 | ABD77766 | 14861 | 45365 | 75869, 106373, 136877, 167381, 197885 | 7013 | AE088965 | 21044 | 51548 | 82052, 112556, 143060, 173564, 204068 |
| 831 | ABD77777 | 14862 | 45366 | 75870, 106374, 136878, 167382, 197886 | 7014 | AE088973 | 21045 | 51549 | 82053, 112557, 143061, 173565, 204069 |
| 832 | ABD77788 | 14863 | 45367 | 75871, 106375, 136879, 167383, 197887 | 7015 | AE088982 | 21046 | 51550 | 82054, 112558, 143062, 173566, 204070 |
| 833 | ABD77799 | 14864 | 45368 | 75872, 106376, 136880, 167384, 197888 | 7016 | AE088990 | 21047 | 51551 | 82055, 112559, 143063, 173567, 204071 |
| 834 | ABD77810 | 14865 | 45369 | 75873, 106377, 136881, 167385, 197889 | 7017 | AE088998 | 21048 | 51552 | 82056, 112560, 143064, 173568, 204072 |
| 835 | ABD77832 | 14866 | 45370 | 75874, 106378, 136882, 167386, 197890 | 7018 | AE089006 | 21049 | 51553 | 82057, 112561, 143065, 173569, 204073 |
| 836 | ABD77876 | 14867 | 45371 | 75875, 106379, 136883, 167387, 197891 | 7019 | AE089023 | 21050 | 51554 | 82058, 112562, 143066, 173570, 204074 |
| 837 | ABD77887 | 14868 | 45372 | 75876, 106380, 136884, 167388, 197892 | 7020 | AE089032 | 21051 | 51555 | 82059, 112563, 143067, 173571, 204075 |
| 838 | ABD77898 | 14869 | 45373 | 75877, 106381, 136885, 167389, 197893 | 7021 | AE089041 | 21052 | 51556 | 82060, 112564, 143068, 173572, 204076 |
| 839 | ABD77909 | 14870 | 45374 | 75878, 106382, 136886, 167390, 197894 | 7022 | AE089050 | 21053 | 51557 | 82061, 112565, 143069, 173573, 204077 |

FIG. 3 continued

| | | | | | | | | | |
|---|---|---|---|---|---|---|---|---|---|
| 840 | ABD77920 | 14871 | 45375 | 75879, 106383, 136887, 167391, 197895 | 7023 | AE089058 | 21054 | 51558 | 82062, 112566, 143070, 173574, 204078 |
| 841 | ABD77931 | 14872 | 45376 | 75880, 106384, 136888, 167392, 197896 | 7024 | AE089075 | 21055 | 51559 | 82063, 112567, 143071, 173575, 204079 |
| 842 | ABD77942 | 14873 | 45377 | 75881, 106385, 136889, 167393, 197897 | 7025 | AE089084 | 21056 | 51560 | 82064, 112568, 143072, 173576, 204080 |
| 843 | ABD77953 | 14874 | 45378 | 75882, 106386, 136890, 167394, 197898 | 7026 | AE089093 | 21057 | 51561 | 82065, 112569, 143073, 173577, 204081 |
| 844 | ABD77964 | 14875 | 45379 | 75883, 106387, 136891, 167395, 197899 | 7027 | AE089102 | 21058 | 51562 | 82066, 112570, 143074, 173578, 204082 |
| 845 | ABD77975 | 14876 | 45380 | 75884, 106388, 136892, 167396, 197900 | 7028 | AE089111 | 21059 | 51563 | 82067, 112571, 143075, 173579, 204083 |
| 846 | ABD77986 | 14877 | 45381 | 75885, 106389, 136893, 167397, 197901 | 7029 | AE089120 | 21060 | 51564 | 82068, 112572, 143076, 173580, 204084 |
| 847 | ABD77997 | 14878 | 45382 | 75886, 106390, 136894, 167398, 197902 | 7030 | AE089129 | 21061 | 51565 | 82069, 112573, 143077, 173581, 204085 |
| 848 | ABD78008 | 14879 | 45383 | 75887, 106391, 136895, 167399, 197903 | 7031 | AE089138 | 21062 | 51566 | 82070, 112574, 143078, 173582, 204086 |
| 849 | ABD78019 | 14880 | 45384 | 75888, 106392, 136896, 167400, 197904 | 7032 | AE089156 | 21063 | 51567 | 82071, 112575, 143079, 173583, 204087 |
| 850 | ABD78030 | 14881 | 45385 | 75889, 106393, 136897, 167401, 197905 | 7033 | AE089174 | 21064 | 51568 | 82072, 112576, 143080, 173584, 204088 |
| 851 | ABD78041 | 14882 | 45386 | 75890, 106394, 136898, 167402, 197906 | 7034 | AE089183 | 21065 | 51569 | 82073, 112577, 143081, 173585, 204089 |
| 852 | ABD78052 | 14883 | 45387 | 75891, 106395, 136899, 167403, 197907 | 7035 | AE089205 | 21066 | 51570 | 82074, 112578, 143082, 173586, 204090 |
| 853 | ABD78063 | 14884 | 45388 | 75892, 106396, 136900, 167404, 197908 | 7036 | AE089215 | 21067 | 51571 | 82075, 112579, 143083, 173587, 204091 |
| 854 | ABD78074 | 14885 | 45389 | 75893, 106397, 136901, 167405, 197909 | 7037 | AE089226 | 21068 | 51572 | 82076, 112580, 143084, 173588, 204092 |
| 855 | ABD78085 | 14886 | 45390 | 75894, 106398, 136902, 167406, 197910 | 7038 | AE089237 | 21069 | 51573 | 82077, 112581, 143085, 173589, 204093 |
| 856 | ABD78096 | 14887 | 45391 | 75895, 106399, 136903, 167407, 197911 | 7039 | AE089248 | 21070 | 51574 | 82078, 112582, 143086, 173590, 204094 |
| 857 | ABD78118 | 14888 | 45392 | 75896, 106400, 136904, 167408, 197912 | 7040 | AE089270 | 21071 | 51575 | 82079, 112583, 143087, 173591, 204095 |

FIG. 3 continued

| | | | | | | | | | |
|---|---|---|---|---|---|---|---|---|---|
| 858 | ABD78129 | 14889 | 45393 | 75897, 106401, 136905, 167409, 197913 | 7041 | AEO89281 | 21072 | 51576 | 82080, 112584, 143088, 173592, 204096 |
| 859 | ABD79035 | 14890 | 45394 | 75898, 106402, 136906, 167410, 197914 | 7042 | AEO89291 | 21073 | 51577 | 82081, 112585, 143089, 173593, 204097 |
| 860 | ABD79115 | 14891 | 45395 | 75899, 106403, 136907, 167411, 197915 | 7043 | AEO89302 | 21074 | 51578 | 82082, 112586, 143090, 173594, 204098 |
| 861 | ABD79126 | 14892 | 45396 | 75900, 106404, 136908, 167412, 197916 | 7044 | AEO99218 | 21075 | 51579 | 82083, 112587, 143091, 173595, 204099 |
| 862 | ABD79137 | 14893 | 45397 | 75901, 106405, 136909, 167413, 197917 | 7045 | AEQ49739 | 21076 | 51580 | 82084, 112588, 143092, 173596, 204100 |
| 863 | ABD79148 | 14894 | 45398 | 75902, 106406, 136910, 167414, 197918 | 7046 | AEQ49740 | 21077 | 51581 | 82085, 112589, 143093, 173597, 204101 |
| 864 | ABD79159 | 14895 | 45399 | 75903, 106407, 136911, 167415, 197919 | 7047 | AEQ49741 | 21078 | 51582 | 82086, 112590, 143094, 173598, 204102 |
| 865 | ABD79170 | 14896 | 45400 | 75904, 106408, 136912, 167416, 197920 | 7048 | AEQ49742 | 21079 | 51583 | 82087, 112591, 143095, 173599, 204103 |
| 866 | ABD79181 | 14897 | 45401 | 75905, 106409, 136913, 167417, 197921 | 7049 | AEQ49743 | 21080 | 51584 | 82088, 112592, 143096, 173600, 204104 |
| 867 | ABD79192 | 14898 | 45402 | 75906, 106410, 136914, 167418, 197922 | 7050 | AEQ49744 | 21081 | 51585 | 82089, 112593, 143097, 173601, 204105 |
| 868 | ABD79203 | 14899 | 45403 | 75907, 106411, 136915, 167419, 197923 | 7051 | AEQ49745 | 21082 | 51586 | 82090, 112594, 143098, 173602, 204106 |
| 869 | ABD79214 | 14900 | 45404 | 75908, 106412, 136916, 167420, 197924 | 7052 | AEQ49746 | 21083 | 51587 | 82091, 112595, 143099, 173603, 204107 |
| 870 | ABD79236 | 14901 | 45405 | 75909, 106413, 136917, 167421, 197925 | 7053 | AEQ49747 | 21084 | 51588 | 82092, 112596, 143100, 173604, 204108 |
| 871 | ABD79247 | 14902 | 45406 | 75910, 106414, 136918, 167422, 197926 | 7054 | AEQ49748 | 21085 | 51589 | 82093, 112597, 143101, 173605, 204109 |
| 872 | ABD94737 | 14903 | 45407 | 75911, 106415, 136919, 167423, 197927 | 7055 | AEQ49749 | 21086 | 51590 | 82094, 112598, 143102, 173606, 204110 |
| 873 | ABD94748 | 14904 | 45408 | 75912, 106416, 136920, 167424, 197928 | 7056 | AEQ49750 | 21087 | 51591 | 82095, 112599, 143103, 173607, 204111 |
| 874 | ABD94759 | 14905 | 45409 | 75913, 106417, 136921, 167425, 197929 | 7057 | AEQ49751 | 21088 | 51592 | 82096, 112600, 143104, 173608, 204112 |
| 875 | ABD94770 | 14906 | 45410 | 75914, 106418, 136922, 167426, 197930 | 7058 | AEQ49752 | 21089 | 51593 | 82097, 112601, 143105, 173609, 204113 |

FIG. 3 continued

| | | | | | | | | | |
|---|---|---|---|---|---|---|---|---|---|
| 876 | ABD94792 | 14907 | 45411 | 75915, 106419, 136923, 167427, 197931 | 7059 | AEQ49753 | 21090 | 51594 | 82098, 112602, 143106, 173610, 204114 |
| 877 | ABD94803 | 14908 | 45412 | 75916, 106420, 136924, 167428, 197932 | 7060 | AEQ49754 | 21091 | 51595 | 82099, 112603, 143107, 173611, 204115 |
| 878 | ABD94814 | 14909 | 45413 | 75917, 106421, 136925, 167429, 197933 | 7061 | AEQ49755 | 21092 | 51596 | 82100, 112604, 143108, 173612, 204116 |
| 879 | ABD94825 | 14910 | 45414 | 75918, 106422, 136926, 167430, 197934 | 7062 | AEQ49756 | 21093 | 51597 | 82101, 112605, 143109, 173613, 204117 |
| 880 | ABD94847 | 14911 | 45415 | 75919, 106423, 136927, 167431, 197935 | 7063 | AEQ49757 | 21094 | 51598 | 82102, 112606, 143110, 173614, 204118 |
| 881 | ABD94858 | 14912 | 45416 | 75920, 106424, 136928, 167432, 197936 | 7064 | AEQ49758 | 21095 | 51599 | 82103, 112607, 143111, 173615, 204119 |
| 882 | ABD94880 | 14913 | 45417 | 75921, 106425, 136929, 167433, 197937 | 7065 | AEQ49759 | 21096 | 51600 | 82104, 112608, 143112, 173616, 204120 |
| 883 | ABD94891 | 14914 | 45418 | 75922, 106426, 136930, 167434, 197938 | 7066 | AEQ49760 | 21097 | 51601 | 82105, 112609, 143113, 173617, 204121 |
| 884 | ABD94902 | 14915 | 45419 | 75923, 106427, 136931, 167435, 197939 | 7067 | AEQ49761 | 21098 | 51602 | 82106, 112610, 143114, 173618, 204122 |
| 885 | ABD94924 | 14916 | 45420 | 75924, 106428, 136932, 167436, 197940 | 7068 | AEQ49762 | 21099 | 51603 | 82107, 112611, 143115, 173619, 204123 |
| 886 | ABD94946 | 14917 | 45421 | 75925, 106429, 136933, 167437, 197941 | 7069 | AEQ49763 | 21100 | 51604 | 82108, 112612, 143116, 173620, 204124 |
| 887 | ABD94957 | 14918 | 45422 | 75926, 106430, 136934, 167438, 197942 | 7070 | AEQ49764 | 21101 | 51605 | 82109, 112613, 143117, 173621, 204125 |
| 888 | ABD94968 | 14919 | 45423 | 75927, 106431, 136935, 167439, 197943 | 7071 | AEQ49765 | 21102 | 51606 | 82110, 112614, 143118, 173622, 204126 |
| 889 | ABD94990 | 14920 | 45424 | 75928, 106432, 136936, 167440, 197944 | 7072 | AEQ49766 | 21103 | 51607 | 82111, 112615, 143119, 173623, 204127 |
| 890 | ABD95001 | 14921 | 45425 | 75929, 106433, 136937, 167441, 197945 | 7073 | AEQ49767 | 21104 | 51608 | 82112, 112616, 143120, 173624, 204128 |
| 891 | ABD95012 | 14922 | 45426 | 75930, 106434, 136938, 167442, 197946 | 7074 | AEQ49768 | 21105 | 51609 | 82113, 112617, 143121, 173625, 204129 |
| 892 | ABD95023 | 14923 | 45427 | 75931, 106435, 136939, 167443, 197947 | 7075 | AEQ49769 | 21106 | 51610 | 82114, 112618, 143122, 173626, 204130 |
| 893 | ABD95034 | 14924 | 45428 | 75932, 106436, 136940, 167444, 197948 | 7076 | AEQ49770 | 21107 | 51611 | 82115, 112619, 143123, 173627, 204131 |

FIG. 3 continued

| | | | | | | | | | |
|---|---|---|---|---|---|---|---|---|---|
| 894 | ABD95056 | 14925 | 45429 | 75933, 106437, 136941, 167445, 197949 | 7077 | AEQ49771 | 21108 | 51612 | 82116, 112620, 143124, 173628, 204132 |
| 895 | ABD95067 | 14926 | 45430 | 75934, 106438, 136942, 167446, 197950 | 7078 | AEQ49772 | 21109 | 51613 | 82117, 112621, 143125, 173629, 204133 |
| 896 | ABD95078 | 14927 | 45431 | 75935, 106439, 136943, 167447, 197951 | 7079 | AEQ49773 | 21110 | 51614 | 82118, 112622, 143126, 173630, 204134 |
| 897 | ABD95089 | 14928 | 45432 | 75936, 106440, 136944, 167448, 197952 | 7080 | AEQ49774 | 21111 | 51615 | 82119, 112623, 143127, 173631, 204135 |
| 898 | ABD95100 | 14929 | 45433 | 75937, 106441, 136945, 167449, 197953 | 7081 | AEQ49775 | 21112 | 51616 | 82120, 112624, 143128, 173632, 204136 |
| 899 | ABD95111 | 14930 | 45434 | 75938, 106442, 136946, 167450, 197954 | 7082 | AEQ49776 | 21113 | 51617 | 82121, 112625, 143129, 173633, 204137 |
| 900 | ABD95122 | 14931 | 45435 | 75939, 106443, 136947, 167451, 197955 | 7083 | AEQ49777 | 21114 | 51618 | 82122, 112626, 143130, 173634, 204138 |
| 901 | ABD95144 | 14932 | 45436 | 75940, 106444, 136948, 167452, 197956 | 7084 | AEQ49778 | 21115 | 51619 | 82123, 112627, 143131, 173635, 204139 |
| 902 | ABD95155 | 14933 | 45437 | 75941, 106445, 136949, 167453, 197957 | 7085 | AEQ49779 | 21116 | 51620 | 82124, 112628, 143132, 173636, 204140 |
| 903 | ABD95166 | 14934 | 45438 | 75942, 106446, 136950, 167454, 197958 | 7086 | AEQ49780 | 21117 | 51621 | 82125, 112629, 143133, 173637, 204141 |
| 904 | ABD95177 | 14935 | 45439 | 75943, 106447, 136951, 167455, 197959 | 7087 | AEQ49781 | 21118 | 51622 | 82126, 112630, 143134, 173638, 204142 |
| 905 | ABD95188 | 14936 | 45440 | 75944, 106448, 136952, 167456, 197960 | 7088 | AEQ49782 | 21119 | 51623 | 82127, 112631, 143135, 173639, 204143 |
| 906 | ABD95199 | 14937 | 45441 | 75945, 106449, 136953, 167457, 197961 | 7089 | AEQ49783 | 21120 | 51624 | 82128, 112632, 143136, 173640, 204144 |
| 907 | ABD95210 | 14938 | 45442 | 75946, 106450, 136954, 167458, 197962 | 7090 | AEQ49785 | 21121 | 51625 | 82129, 112633, 143137, 173641, 204145 |
| 908 | ABD95221 | 14939 | 45443 | 75947, 106451, 136955, 167459, 197963 | 7091 | AEQ49786 | 21122 | 51626 | 82130, 112634, 143138, 173642, 204146 |
| 909 | ABD95232 | 14940 | 45444 | 75948, 106452, 136956, 167460, 197964 | 7092 | AEQ49788 | 21123 | 51627 | 82131, 112635, 143139, 173643, 204147 |
| 910 | ABD95243 | 14941 | 45445 | 75949, 106453, 136957, 167461, 197965 | 7093 | AEQ49789 | 21124 | 51628 | 82132, 112636, 143140, 173644, 204148 |
| 911 | ABD95254 | 14942 | 45446 | 75950, 106454, 136958, 167462, 197966 | 7094 | AEQ49790 | 21125 | 51629 | 82133, 112637, 143141, 173645, 204149 |

FIG. 3 continued

| | | | | | | | | | |
|---|---|---|---|---|---|---|---|---|---|
| 912 | ABD95265 | 14943 | 45447 | 75951, 106455, 136959, 167463, 197967 | 7095 | AEQ49791 | 21126 | 51630 | 82134, 112638, 143142, 173646, 204150 |
| 913 | ABD95276 | 14944 | 45448 | 75952, 106456, 136960, 167464, 197968 | 7096 | AEQ49792 | 21127 | 51631 | 82135, 112639, 143143, 173647, 204151 |
| 914 | ABD95287 | 14945 | 45449 | 75953, 106457, 136961, 167465, 197969 | 7097 | AEQ49793 | 21128 | 51632 | 82136, 112640, 143144, 173648, 204152 |
| 915 | ABD95298 | 14946 | 45450 | 75954, 106458, 136962, 167466, 197970 | 7098 | AEQ49794 | 21129 | 51633 | 82137, 112641, 143145, 173649, 204153 |
| 916 | ABD95309 | 14947 | 45451 | 75955, 106459, 136963, 167467, 197971 | 7099 | AEQ49795 | 21130 | 51634 | 82138, 112642, 143146, 173650, 204154 |
| 917 | ABD95320 | 14948 | 45452 | 75956, 106460, 136964, 167468, 197972 | 7100 | AEQ49796 | 21131 | 51635 | 82139, 112643, 143147, 173651, 204155 |
| 918 | ABD95331 | 14949 | 45453 | 75957, 106461, 136965, 167469, 197973 | 7101 | AEQ49797 | 21132 | 51636 | 82140, 112644, 143148, 173652, 204156 |
| 919 | ABD95342 | 14950 | 45454 | 75958, 106462, 136966, 167470, 197974 | 7102 | AEQ49798 | 21133 | 51637 | 82141, 112645, 143149, 173653, 204157 |
| 920 | ABD95353 | 14951 | 45455 | 75959, 106463, 136967, 167471, 197975 | 7103 | AEQ49799 | 21134 | 51638 | 82142, 112646, 143150, 173654, 204158 |
| 921 | ABE11660 | 14952 | 45456 | 75960, 106464, 136968, 167472, 197976 | 7104 | AEQ49800 | 21135 | 51639 | 82143, 112647, 143151, 173655, 204159 |
| 922 | ABE11671 | 14953 | 45457 | 75961, 106465, 136969, 167473, 197977 | 7105 | AEQ49801 | 21136 | 51640 | 82144, 112648, 143152, 173656, 204160 |
| 923 | ABE11682 | 14954 | 45458 | 75962, 106466, 136970, 167474, 197978 | 7106 | AEQ49802 | 21137 | 51641 | 82145, 112649, 143153, 173657, 204161 |
| 924 | ABE11693 | 14955 | 45459 | 75963, 106467, 136971, 167475, 197979 | 7107 | AEQ49803 | 21138 | 51642 | 82146, 112650, 143154, 173658, 204162 |
| 925 | ABE11704 | 14956 | 45460 | 75964, 106468, 136972, 167476, 197980 | 7108 | AEQ49804 | 21139 | 51643 | 82147, 112651, 143155, 173659, 204163 |
| 926 | ABE11715 | 14957 | 45461 | 75965, 106469, 136973, 167477, 197981 | 7109 | AEQ49805 | 21140 | 51644 | 82148, 112652, 143156, 173660, 204164 |
| 927 | ABE11726 | 14958 | 45462 | 75966, 106470, 136974, 167478, 197982 | 7110 | AEQ49806 | 21141 | 51645 | 82149, 112653, 143157, 173661, 204165 |
| 928 | ABE11737 | 14959 | 45463 | 75967, 106471, 136975, 167479, 197983 | 7111 | AEQ49807 | 21142 | 51646 | 82150, 112654, 143158, 173662, 204166 |
| 929 | ABE11815 | 14960 | 45464 | 75968, 106472, 136976, 167480, 197984 | 7112 | AEQ49809 | 21143 | 51647 | 82151, 112655, 143159, 173663, 204167 |

FIG. 3 continued

| | | | | | | | | | |
|---|---|---|---|---|---|---|---|---|---|
| 930 | ABE11826 | 14961 | 45465 | 75969, 106473, 136977, 167481, 197985 | 7113 | AEQ49811 | 21144 | 51648 | 82152, 112656, 143160, 173664, 204168 |
| 931 | ABE11837 | 14962 | 45466 | 75970, 106474, 136978, 167482, 197986 | 7114 | AEQ49812 | 21145 | 51649 | 82153, 112657, 143161, 173665, 204169 |
| 932 | ABE11848 | 14963 | 45467 | 75971, 106475, 136979, 167483, 197987 | 7115 | AEQ49813 | 21146 | 51650 | 82154, 112658, 143162, 173666, 204170 |
| 933 | ABE11859 | 14964 | 45468 | 75972, 106476, 136980, 167484, 197988 | 7116 | AEQ49815 | 21147 | 51651 | 82155, 112659, 143163, 173667, 204171 |
| 934 | ABE11903 | 14965 | 45469 | 75973, 106477, 136981, 167485, 197989 | 7117 | AEQ49816 | 21148 | 51652 | 82156, 112660, 143164, 173668, 204172 |
| 935 | ABE11925 | 14966 | 45470 | 75974, 106478, 136982, 167486, 197990 | 7118 | AEQ49820 | 21149 | 51653 | 82157, 112661, 143165, 173669, 204173 |
| 936 | ABE11952 | 14967 | 45471 | 75975, 106479, 136983, 167487, 197991 | 7119 | AEQ49821 | 21150 | 51654 | 82158, 112662, 143166, 173670, 204174 |
| 937 | ABE12035 | 14968 | 45472 | 75976, 106480, 136984, 167488, 197992 | 7120 | AEQ49822 | 21151 | 51655 | 82159, 112663, 143167, 173671, 204175 |
| 938 | ABE12094 | 14969 | 45473 | 75977, 106481, 136985, 167489, 197993 | 7121 | AEQ49823 | 21152 | 51656 | 82160, 112664, 143168, 173672, 204176 |
| 939 | ABE12126 | 14970 | 45474 | 75978, 106482, 136986, 167490, 197994 | 7122 | AEQ49824 | 21153 | 51657 | 82161, 112665, 143169, 173673, 204177 |
| 940 | ABE12263 | 14971 | 45475 | 75979, 106483, 136987, 167491, 197995 | 7123 | AEQ49825 | 21154 | 51658 | 82162, 112666, 143170, 173674, 204178 |
| 941 | ABE12626 | 14972 | 45476 | 75980, 106484, 136988, 167492, 197996 | 7124 | AEQ49826 | 21155 | 51659 | 82163, 112667, 143171, 173675, 204179 |
| 942 | ABE12650 | 14973 | 45477 | 75981, 106485, 136989, 167493, 197997 | 7125 | AEQ49827 | 21156 | 51660 | 82164, 112668, 143172, 173676, 204180 |
| 943 | ABE13095 | 14974 | 45478 | 75982, 106486, 136990, 167494, 197998 | 7126 | AEQ49828 | 21157 | 51661 | 82165, 112669, 143173, 173677, 204181 |
| 944 | ABE13332 | 14975 | 45479 | 75983, 106487, 136991, 167495, 197999 | 7127 | AEQ49829 | 21158 | 51662 | 82166, 112670, 143174, 173678, 204182 |
| 945 | ABE13558 | 14976 | 45480 | 75984, 106488, 136992, 167496, 198000 | 7128 | AEQ49830 | 21159 | 51663 | 82167, 112671, 143175, 173679, 204183 |
| 946 | ABE13642 | 14977 | 45481 | 75985, 106489, 136993, 167497, 198001 | 7129 | AEQ49831 | 21160 | 51664 | 82168, 112672, 143176, 173680, 204184 |
| 947 | ABE13668 | 14978 | 45482 | 75986, 106490, 136994, 167498, 198002 | 7130 | AEQ49832 | 21161 | 51665 | 82169, 112673, 143177, 173681, 204185 |

FIG. 3 continued

| | | | | | | | | | |
|---|---|---|---|---|---|---|---|---|---|
| 948 | ABE13836 | 14979 | 45483 | 75987, 106491, 136995, 167499, 198003 | 7131 | AEQ49833 | 21162 | 51666 | 82170, 112674, 143178, 173682, 204186 |
| 949 | ABE14033 | 14980 | 45484 | 75988, 106492, 136996, 167500, 198004 | 7132 | AEQ49835 | 21163 | 51667 | 82171, 112675, 143179, 173683, 204187 |
| 950 | ABE14055 | 14981 | 45485 | 75989, 106493, 136997, 167501, 198005 | 7133 | AEQ49836 | 21164 | 51668 | 82172, 112676, 143180, 173684, 204188 |
| 951 | ABE14857 | 14982 | 45486 | 75990, 106494, 136998, 167502, 198006 | 7134 | AEQ49838 | 21165 | 51669 | 82173, 112677, 143181, 173685, 204189 |
| 952 | ABE15594 | 14983 | 45487 | 75991, 106495, 136999, 167503, 198007 | 7135 | AEQ49839 | 21166 | 51670 | 82174, 112678, 143182, 173686, 204190 |
| 953 | ABE26994 | 14984 | 45488 | 75992, 106496, 137000, 167504, 198008 | 7136 | AEQ49840 | 21167 | 51671 | 82175, 112679, 143183, 173687, 204191 |
| 954 | ABE97641 | 14985 | 45489 | 75993, 106497, 137001, 167505, 198009 | 7137 | AEQ49841 | 21168 | 51672 | 82176, 112680, 143184, 173688, 204192 |
| 955 | ABE97642 | 14986 | 45490 | 75994, 106498, 137002, 167506, 198010 | 7138 | AEQ49842 | 21169 | 51673 | 82177, 112681, 143185, 173689, 204193 |
| 956 | ABE97644 | 14987 | 45491 | 75995, 106499, 137003, 167507, 198011 | 7139 | AEQ49843 | 21170 | 51674 | 82178, 112682, 143186, 173690, 204194 |
| 957 | ABE97645 | 14988 | 45492 | 75996, 106500, 137004, 167508, 198012 | 7140 | AEQ49844 | 21171 | 51675 | 82179, 112683, 143187, 173691, 204195 |
| 958 | ABE97646 | 14989 | 45493 | 75997, 106501, 137005, 167509, 198013 | 7141 | AEQ49845 | 21172 | 51676 | 82180, 112684, 143188, 173692, 204196 |
| 959 | ABE97647 | 14990 | 45494 | 75998, 106502, 137006, 167510, 198014 | 7142 | AEQ49846 | 21173 | 51677 | 82181, 112685, 143189, 173693, 204197 |
| 960 | ABE97649 | 14991 | 45495 | 75999, 106503, 137007, 167511, 198015 | 7143 | AEQ49850 | 21174 | 51678 | 82182, 112686, 143190, 173694, 204198 |
| 961 | ABE97651 | 14992 | 45496 | 76000, 106504, 137008, 167512, 198016 | 7144 | AEQ49851 | 21175 | 51679 | 82183, 112687, 143191, 173695, 204199 |
| 962 | ABE97653 | 14993 | 45497 | 76001, 106505, 137009, 167513, 198017 | 7145 | AEQ49852 | 21176 | 51680 | 82184, 112688, 143192, 173696, 204200 |
| 963 | ABE97654 | 14994 | 45498 | 76002, 106506, 137010, 167514, 198018 | 7146 | AEQ49969 | 21177 | 51681 | 82185, 112689, 143193, 173697, 204201 |
| 964 | ABE97655 | 14995 | 45499 | 76003, 106507, 137011, 167515, 198019 | 7147 | AEQ49970 | 21178 | 51682 | 82186, 112690, 143194, 173698, 204202 |
| 965 | ABE97657 | 14996 | 45500 | 76004, 106508, 137012, 167516, 198020 | 7148 | AEQ54954 | 21179 | 51683 | 82187, 112691, 143195, 173699, 204203 |

FIG. 3 continued

| | | | | | | | | | |
|---|---|---|---|---|---|---|---|---|---|
| 966 | ABE97658 | 14997 | 45501 | 76005, 106509, 137013, 167517, 198021 | 7149 | AER08645 | 21180 | 51684 | 82188, 112692, 143196, 173700, 204204 |
| 967 | ABE97659 | 14998 | 45502 | 76006, 106510, 137014, 167518, 198022 | 7150 | AER08649 | 21181 | 51685 | 82189, 112693, 143197, 173701, 204205 |
| 968 | ABE97660 | 14999 | 45503 | 76007, 106511, 137015, 167519, 198023 | 7151 | AER08657 | 21182 | 51686 | 82190, 112694, 143198, 173702, 204206 |
| 969 | ABE97661 | 15000 | 45504 | 76008, 106512, 137016, 167520, 198024 | 7152 | AER08659 | 21183 | 51687 | 82191, 112695, 143199, 173703, 204207 |
| 970 | ABE97662 | 15001 | 45505 | 76009, 106513, 137017, 167521, 198025 | 7153 | AER08661 | 21184 | 51688 | 82192, 112696, 143200, 173704, 204208 |
| 971 | ABE97663 | 15002 | 45506 | 76010, 106514, 137018, 167522, 198026 | 7154 | AER08663 | 21185 | 51689 | 82193, 112697, 143201, 173705, 204209 |
| 972 | ABE97665 | 15003 | 45507 | 76011, 106515, 137019, 167523, 198027 | 7155 | AER08665 | 21186 | 51690 | 82194, 112698, 143202, 173706, 204210 |
| 973 | ABE97666 | 15004 | 45508 | 76012, 106516, 137020, 167524, 198028 | 7156 | AER08669 | 21187 | 51691 | 82195, 112699, 143203, 173707, 204211 |
| 974 | ABE97667 | 15005 | 45509 | 76013, 106517, 137021, 167525, 198029 | 7157 | AER08671 | 21188 | 51692 | 82196, 112700, 143204, 173708, 204212 |
| 975 | ABE97669 | 15006 | 45510 | 76014, 106518, 137022, 167526, 198030 | 7158 | AER08673 | 21189 | 51693 | 82197, 112701, 143205, 173709, 204213 |
| 976 | ABE97670 | 15007 | 45511 | 76015, 106519, 137023, 167527, 198031 | 7159 | AER08675 | 21190 | 51694 | 82198, 112702, 143206, 173710, 204214 |
| 977 | ABE97671 | 15008 | 45512 | 76016, 106520, 137024, 167528, 198032 | 7160 | AER08677 | 21191 | 51695 | 82199, 112703, 143207, 173711, 204215 |
| 978 | ABE97672 | 15009 | 45513 | 76017, 106521, 137025, 167529, 198033 | 7161 | AER08679 | 21192 | 51696 | 82200, 112704, 143208, 173712, 204216 |
| 979 | ABE97675 | 15010 | 45514 | 76018, 106522, 137026, 167530, 198034 | 7162 | AER08681 | 21193 | 51697 | 82201, 112705, 143209, 173713, 204217 |
| 980 | ABE97676 | 15011 | 45515 | 76019, 106523, 137027, 167531, 198035 | 7163 | AER08683 | 21194 | 51698 | 82202, 112706, 143210, 173714, 204218 |
| 981 | ABE97677 | 15012 | 45516 | 76020, 106524, 137028, 167532, 198036 | 7164 | AER08685 | 21195 | 51699 | 82203, 112707, 143211, 173715, 204219 |
| 982 | ABE97679 | 15013 | 45517 | 76021, 106525, 137029, 167533, 198037 | 7165 | AER08687 | 21196 | 51700 | 82204, 112708, 143212, 173716, 204220 |
| 983 | ABE97680 | 15014 | 45518 | 76022, 106526, 137030, 167534, 198038 | 7166 | AER08689 | 21197 | 51701 | 82205, 112709, 143213, 173717, 204221 |

FIG. 3 continued

| | | | | | | | | | |
|---|---|---|---|---|---|---|---|---|---|
| 984 | ABE97681 | 15015 | 45519 | 76023, 106527, 137031, 167535, 198039 | 7167 | AER08691 | 21198 | 51702 | 82206, 112710, 143214, 173718, 204222 |
| 985 | ABE97682 | 15016 | 45520 | 76024, 106528, 137032, 167536, 198040 | 7168 | AER08693 | 21199 | 51703 | 82207, 112711, 143215, 173719, 204223 |
| 986 | ABE97684 | 15017 | 45521 | 76025, 106529, 137033, 167537, 198041 | 7169 | AER08697 | 21200 | 51704 | 82208, 112712, 143216, 173720, 204224 |
| 987 | ABE97685 | 15018 | 45522 | 76026, 106530, 137034, 167538, 198042 | 7170 | AER92714 | 21201 | 51705 | 82209, 112713, 143217, 173721, 204225 |
| 988 | ABE97686 | 15019 | 45523 | 76027, 106531, 137035, 167539, 198043 | 7171 | AER92721 | 21202 | 51706 | 82210, 112714, 143218, 173722, 204226 |
| 989 | ABE97687 | 15020 | 45524 | 76028, 106532, 137036, 167540, 198044 | 7172 | AER92724 | 21203 | 51707 | 82211, 112715, 143219, 173723, 204227 |
| 990 | ABE97688 | 15021 | 45525 | 76029, 106533, 137037, 167541, 198045 | 7173 | AET84165 | 21204 | 51708 | 82212, 112716, 143220, 173724, 204228 |
| 991 | ABE97690 | 15022 | 45526 | 76030, 106534, 137038, 167542, 198046 | 7174 | AET84176 | 21205 | 51709 | 82213, 112717, 143221, 173725, 204229 |
| 992 | ABE97691 | 15023 | 45527 | 76031, 106535, 137039, 167543, 198047 | 7175 | AET84187 | 21206 | 51710 | 82214, 112718, 143222, 173726, 204230 |
| 993 | ABE97694 | 15024 | 45528 | 76032, 106536, 137040, 167544, 198048 | 7176 | AET84198 | 21207 | 51711 | 82215, 112719, 143223, 173727, 204231 |
| 994 | ABE97696 | 15025 | 45529 | 76033, 106537, 137041, 167545, 198049 | 7177 | AET84209 | 21208 | 51712 | 82216, 112720, 143224, 173728, 204232 |
| 995 | ABE97697 | 15026 | 45530 | 76034, 106538, 137042, 167546, 198050 | 7178 | AET84231 | 21209 | 51713 | 82217, 112721, 143225, 173729, 204233 |
| 996 | ABE97702 | 15027 | 45531 | 76035, 106539, 137043, 167547, 198051 | 7179 | AET84242 | 21210 | 51714 | 82218, 112722, 143226, 173730, 204234 |
| 997 | ABE97703 | 15028 | 45532 | 76036, 106540, 137044, 167548, 198052 | 7180 | AET84253 | 21211 | 51715 | 82219, 112723, 143227, 173731, 204235 |
| 998 | ABE97705 | 15029 | 45533 | 76037, 106541, 137045, 167549, 198053 | 7181 | AET84264 | 21212 | 51716 | 82220, 112724, 143228, 173732, 204236 |
| 999 | ABE97706 | 15030 | 45534 | 76038, 106542, 137046, 167550, 198054 | 7182 | AET84275 | 21213 | 51717 | 82221, 112725, 143229, 173733, 204237 |
| 1000 | ABE97707 | 15031 | 45535 | 76039, 106543, 137047, 167551, 198055 | 7183 | AET84286 | 21214 | 51718 | 82222, 112726, 143230, 173734, 204238 |
| 1001 | ABE97708 | 15032 | 45536 | 76040, 106544, 137048, 167552, 198056 | 7184 | AET84297 | 21215 | 51719 | 82223, 112727, 143231, 173735, 204239 |

FIG. 3 continued

| | | | | | | | | | |
|---|---|---|---|---|---|---|---|---|---|
| 1002 | ABE97710 | 15033 | 45537 | 76041, 106545, 137049, 167553, 198057 | 7185 | AET84308 | 21216 | 51720 | 82224, 112728, 143232, 173736, 204240 |
| 1003 | ABE97711 | 15034 | 45538 | 76042, 106546, 137050, 167554, 198058 | 7186 | AET84319 | 21217 | 51721 | 82225, 112729, 143233, 173737, 204241 |
| 1004 | ABE97712 | 15035 | 45539 | 76043, 106547, 137051, 167555, 198059 | 7187 | AET84330 | 21218 | 51722 | 82226, 112730, 143234, 173738, 204242 |
| 1005 | ABE97713 | 15036 | 45540 | 76044, 106548, 137052, 167556, 198060 | 7188 | AET84341 | 21219 | 51723 | 82227, 112731, 143235, 173739, 204243 |
| 1006 | ABE97715 | 15037 | 45541 | 76045, 106549, 137053, 167557, 198061 | 7189 | AET84363 | 21220 | 51724 | 82228, 112732, 143236, 173740, 204244 |
| 1007 | ABE97717 | 15038 | 45542 | 76046, 106550, 137054, 167558, 198062 | 7190 | AET84374 | 21221 | 51725 | 82229, 112733, 143237, 173741, 204245 |
| 1008 | ABE97718 | 15039 | 45543 | 76047, 106551, 137055, 167559, 198063 | 7191 | AET84396 | 21222 | 51726 | 82230, 112734, 143238, 173742, 204246 |
| 1009 | ABE97719 | 15040 | 45544 | 76048, 106552, 137056, 167560, 198064 | 7192 | AET84407 | 21223 | 51727 | 82231, 112735, 143239, 173743, 204247 |
| 1010 | ABE97720 | 15041 | 45545 | 76049, 106553, 137057, 167561, 198065 | 7193 | AET84418 | 21224 | 51728 | 82232, 112736, 143240, 173744, 204248 |
| 1011 | ABF47553 | 15042 | 45546 | 76050, 106554, 137058, 167562, 198066 | 7194 | AET84429 | 21225 | 51729 | 82233, 112737, 143241, 173745, 204249 |
| 1012 | ABF47564 | 15043 | 45547 | 76051, 106555, 137059, 167563, 198067 | 7195 | AET84440 | 21226 | 51730 | 82234, 112738, 143242, 173746, 204250 |
| 1013 | ABF47575 | 15044 | 45548 | 76052, 106556, 137060, 167564, 198068 | 7196 | AET84451 | 21227 | 51731 | 82235, 112739, 143243, 173747, 204251 |
| 1014 | ABF47586 | 15045 | 45549 | 76053, 106557, 137061, 167565, 198069 | 7197 | AEV53421 | 21228 | 51732 | 82236, 112740, 143244, 173748, 204252 |
| 1015 | ABF47597 | 15046 | 45550 | 76054, 106558, 137062, 167566, 198070 | 7198 | AEV53423 | 21229 | 51733 | 82237, 112741, 143245, 173749, 204253 |
| 1016 | ABF47608 | 15047 | 45551 | 76055, 106559, 137063, 167567, 198071 | 7199 | AEV53425 | 21230 | 51734 | 82238, 112742, 143246, 173750, 204254 |
| 1017 | ABF47619 | 15048 | 45552 | 76056, 106560, 137064, 167568, 198072 | 7200 | AEV53427 | 21231 | 51735 | 82239, 112743, 143247, 173751, 204255 |
| 1018 | ABF47630 | 15049 | 45553 | 76057, 106561, 137065, 167569, 198073 | 7201 | AEV53429 | 21232 | 51736 | 82240, 112744, 143248, 173752, 204256 |
| 1019 | ABF47652 | 15050 | 45554 | 76058, 106562, 137066, 167570, 198074 | 7202 | AEV53431 | 21233 | 51737 | 82241, 112745, 143249, 173753, 204257 |

FIG. 3 continued

| | | | | | | | | | |
|---|---|---|---|---|---|---|---|---|---|
| 1020 | ABF47663 | 15051 | 45555 | 76059, 106563, 137067, 167571, 198075 | 7203 | AEV53435 | 21234 | 51738 | 82242, 112746, 143250, 173754, 204258 |
| 1021 | ABF47674 | 15052 | 45556 | 76060, 106564, 137068, 167572, 198076 | 7204 | AEV53437 | 21235 | 51739 | 82243, 112747, 143251, 173755, 204259 |
| 1022 | ABF47696 | 15053 | 45557 | 76061, 106565, 137069, 167573, 198077 | 7205 | AEV53439 | 21236 | 51740 | 82244, 112748, 143252, 173756, 204260 |
| 1023 | ABF47707 | 15054 | 45558 | 76062, 106566, 137070, 167574, 198078 | 7206 | AEV53441 | 21237 | 51741 | 82245, 112749, 143253, 173757, 204261 |
| 1024 | ABF47718 | 15055 | 45559 | 76063, 106567, 137071, 167575, 198079 | 7207 | AEV53443 | 21238 | 51742 | 82246, 112750, 143254, 173758, 204262 |
| 1025 | ABF47729 | 15056 | 45560 | 76064, 106568, 137072, 167576, 198080 | 7208 | AEV53445 | 21239 | 51743 | 82247, 112751, 143255, 173759, 204263 |
| 1026 | ABF47740 | 15057 | 45561 | 76065, 106569, 137073, 167577, 198081 | 7209 | AEV53447 | 21240 | 51744 | 82248, 112752, 143256, 173760, 204264 |
| 1027 | ABF47751 | 15058 | 45562 | 76066, 106570, 137074, 167578, 198082 | 7210 | AEV53449 | 21241 | 51745 | 82249, 112753, 143257, 173761, 204265 |
| 1028 | ABF47773 | 15059 | 45563 | 76067, 106571, 137075, 167579, 198083 | 7211 | AEV53451 | 21242 | 51746 | 82250, 112754, 143258, 173762, 204266 |
| 1029 | ABF47784 | 15060 | 45564 | 76068, 106572, 137076, 167580, 198084 | 7212 | AEV53453 | 21243 | 51747 | 82251, 112755, 143259, 173763, 204267 |
| 1030 | ABF47795 | 15061 | 45565 | 76069, 106573, 137077, 167581, 198085 | 7213 | AEV53455 | 21244 | 51748 | 82252, 112756, 143260, 173764, 204268 |
| 1031 | ABF47806 | 15062 | 45566 | 76070, 106574, 137078, 167582, 198086 | 7214 | AEV53457 | 21245 | 51749 | 82253, 112757, 143261, 173765, 204269 |
| 1032 | ABF47817 | 15063 | 45567 | 76071, 106575, 137079, 167583, 198087 | 7215 | AEV53459 | 21246 | 51750 | 82254, 112758, 143262, 173766, 204270 |
| 1033 | ABF47839 | 15064 | 45568 | 76072, 106576, 137080, 167584, 198088 | 7216 | AEV53461 | 21247 | 51751 | 82255, 112759, 143263, 173767, 204271 |
| 1034 | ABF47850 | 15065 | 45569 | 76073, 106577, 137081, 167585, 198089 | 7217 | AEV53463 | 21248 | 51752 | 82256, 112760, 143264, 173768, 204272 |
| 1035 | ABF47872 | 15066 | 45570 | 76074, 106578, 137082, 167586, 198090 | 7218 | AEV53465 | 21249 | 51753 | 82257, 112761, 143265, 173769, 204273 |
| 1036 | ABF47883 | 15067 | 45571 | 76075, 106579, 137083, 167587, 198091 | 7219 | AEV53467 | 21250 | 51754 | 82258, 112762, 143266, 173770, 204274 |
| 1037 | ABF47894 | 15068 | 45572 | 76076, 106580, 137084, 167588, 198092 | 7220 | AEV53469 | 21251 | 51755 | 82259, 112763, 143267, 173771, 204275 |

FIG. 3 continued

| | | | | | | | | | | |
|---|---|---|---|---|---|---|---|---|---|---|
| 1038 | ABF47905 | 15069 | 45573 | 76077, 106581, 137085, 167589, 198093 | 7221 | AEV53471 | 21252 | 51756 | 82260, 112764, 143268, 173772, 204276 |
| 1039 | ABF47958 | 15070 | 45574 | 76078, 106582, 137086, 167590, 198094 | 7222 | AEV53473 | 21253 | 51757 | 82261, 112765, 143269, 173773, 204277 |
| 1040 | ABF56651 | 15071 | 45575 | 76079, 106583, 137087, 167591, 198095 | 7223 | AEV53475 | 21254 | 51758 | 82262, 112766, 143270, 173774, 204278 |
| 1041 | ABF82654 | 15072 | 45576 | 76080, 106584, 137088, 167592, 198096 | 7224 | AEV53477 | 21255 | 51759 | 82263, 112767, 143271, 173775, 204279 |
| 1042 | ABF82665 | 15073 | 45577 | 76081, 106585, 137089, 167593, 198097 | 7225 | AEV53479 | 21256 | 51760 | 82264, 112768, 143272, 173776, 204280 |
| 1043 | ABF82676 | 15074 | 45578 | 76082, 106586, 137090, 167594, 198098 | 7226 | AEV53481 | 21257 | 51761 | 82265, 112769, 143273, 173777, 204281 |
| 1044 | ABF82687 | 15075 | 45579 | 76083, 106587, 137091, 167595, 198099 | 7227 | AEV53483 | 21258 | 51762 | 82266, 112770, 143274, 173778, 204282 |
| 1045 | ABF82698 | 15076 | 45580 | 76084, 106588, 137092, 167596, 198100 | 7228 | AEV53485 | 21259 | 51763 | 82267, 112771, 143275, 173779, 204283 |
| 1046 | ABF82709 | 15077 | 45581 | 76085, 106589, 137093, 167597, 198101 | 7229 | AEV53487 | 21260 | 51764 | 82268, 112772, 143276, 173780, 204284 |
| 1047 | ABF82822 | 15078 | 45582 | 76086, 106590, 137094, 167598, 198102 | 7230 | AEV53489 | 21261 | 51765 | 82269, 112773, 143277, 173781, 204285 |
| 1048 | ABF82833 | 15079 | 45583 | 76087, 106591, 137095, 167599, 198103 | 7231 | AEV53491 | 21262 | 51766 | 82270, 112774, 143278, 173782, 204286 |
| 1049 | ABF82844 | 15080 | 45584 | 76088, 106592, 137096, 167600, 198104 | 7232 | AEV53493 | 21263 | 51767 | 82271, 112775, 143279, 173783, 204287 |
| 1050 | ABF82855 | 15081 | 45585 | 76089, 106593, 137097, 167601, 198105 | 7233 | AEV53495 | 21264 | 51768 | 82272, 112776, 143280, 173784, 204288 |
| 1051 | ABF82866 | 15082 | 45586 | 76090, 106594, 137098, 167602, 198106 | 7234 | AEV53497 | 21265 | 51769 | 82273, 112777, 143281, 173785, 204289 |
| 1052 | ABF82888 | 15083 | 45587 | 76091, 106595, 137099, 167603, 198107 | 7235 | AEV53499 | 21266 | 51770 | 82274, 112778, 143282, 173786, 204290 |
| 1053 | ABF82910 | 15084 | 45588 | 76092, 106596, 137100, 167604, 198108 | 7236 | AEV53501 | 21267 | 51771 | 82275, 112779, 143283, 173787, 204291 |
| 1054 | ABF82921 | 15085 | 45589 | 76093, 106597, 137101, 167605, 198109 | 7237 | AEV53503 | 21268 | 51772 | 82276, 112780, 143284, 173788, 204292 |
| 1055 | ABF82932 | 15086 | 45590 | 76094, 106598, 137102, 167606, 198110 | 7238 | AEV53505 | 21269 | 51773 | 82277, 112781, 143285, 173789, 204293 |

FIG. 3 continued

| | | | | | | | | | |
|---|---|---|---|---|---|---|---|---|---|
| 1056 | ABF82943 | 15087 | 45591 | 76095, 106599, 137103, 167607, 198111 | 7239 | AEV53507 | 21270 | 51774 | 82278, 112782, 143286, 173790, 204294 |
| 1057 | ABG20474 | 15088 | 45592 | 76096, 106600, 137104, 167608, 198112 | 7240 | AEV53509 | 21271 | 51775 | 82279, 112783, 143287, 173791, 204295 |
| 1058 | ABG26761 | 15089 | 45593 | 76097, 106601, 137105, 167609, 198113 | 7241 | AEV53511 | 21272 | 51776 | 82280, 112784, 143288, 173792, 204296 |
| 1059 | ABG26772 | 15090 | 45594 | 76098, 106602, 137106, 167610, 198114 | 7242 | AEV53513 | 21273 | 51777 | 82281, 112785, 143289, 173793, 204297 |
| 1060 | ABG26783 | 15091 | 45595 | 76099, 106603, 137107, 167611, 198115 | 7243 | AEV53515 | 21274 | 51778 | 82282, 112786, 143290, 173794, 204298 |
| 1061 | ABG26794 | 15092 | 45596 | 76100, 106604, 137108, 167612, 198116 | 7244 | AEV53517 | 21275 | 51779 | 82283, 112787, 143291, 173795, 204299 |
| 1062 | ABG26805 | 15093 | 45597 | 76101, 106605, 137109, 167613, 198117 | 7245 | AEV53519 | 21276 | 51780 | 82284, 112788, 143292, 173796, 204300 |
| 1063 | ABG26816 | 15094 | 45598 | 76102, 106606, 137110, 167614, 198118 | 7246 | AEV53521 | 21277 | 51781 | 82285, 112789, 143293, 173797, 204301 |
| 1064 | ABG26827 | 15095 | 45599 | 76103, 106607, 137111, 167615, 198119 | 7247 | AEV53523 | 21278 | 51782 | 82286, 112790, 143294, 173798, 204302 |
| 1065 | ABG26838 | 15096 | 45600 | 76104, 106608, 137112, 167616, 198120 | 7248 | AEV53525 | 21279 | 51783 | 82287, 112791, 143295, 173799, 204303 |
| 1066 | ABG26860 | 15097 | 45601 | 76105, 106609, 137113, 167617, 198121 | 7249 | AEV53527 | 21280 | 51784 | 82288, 112792, 143296, 173800, 204304 |
| 1067 | ABG26871 | 15098 | 45602 | 76106, 106610, 137114, 167618, 198122 | 7250 | AEV53529 | 21281 | 51785 | 82289, 112793, 143297, 173801, 204305 |
| 1068 | ABG26893 | 15099 | 45603 | 76107, 106611, 137115, 167619, 198123 | 7251 | AEV53531 | 21282 | 51786 | 82290, 112794, 143298, 173802, 204306 |
| 1069 | ABG26915 | 15100 | 45604 | 76108, 106612, 137116, 167620, 198124 | 7252 | AEV53533 | 21283 | 51787 | 82291, 112795, 143299, 173803, 204307 |
| 1070 | ABG26937 | 15101 | 45605 | 76109, 106613, 137117, 167621, 198125 | 7253 | AEV53535 | 21284 | 51788 | 82292, 112796, 143300, 173804, 204308 |
| 1071 | ABG26948 | 15102 | 45606 | 76110, 106614, 137118, 167622, 198126 | 7254 | AEV53537 | 21285 | 51789 | 82293, 112797, 143301, 173805, 204309 |
| 1072 | ABG26959 | 15103 | 45607 | 76111, 106615, 137119, 167623, 198127 | 7255 | AEV53539 | 21286 | 51790 | 82294, 112798, 143302, 173806, 204310 |
| 1073 | ABG37123 | 15104 | 45608 | 76112, 106616, 137120, 167624, 198128 | 7256 | AEV53541 | 21287 | 51791 | 82295, 112799, 143303, 173807, 204311 |

FIG. 3 continued

| | | | | | | | | | |
|---|---|---|---|---|---|---|---|---|---|
| 1074 | ABG37134 | 15105 | 45609 | 76113, 106617, 137121, 167625, 198129 | 7257 | AEV53543 | 21288 | 51792 | 82296, 112800, 143304, 173808, 204312 |
| 1075 | ABG37145 | 15106 | 45610 | 76114, 106618, 137122, 167626, 198130 | 7258 | AEV53545 | 21289 | 51793 | 82297, 112801, 143305, 173809, 204313 |
| 1076 | ABG37156 | 15107 | 45611 | 76115, 106619, 137123, 167627, 198131 | 7259 | AEV53547 | 21290 | 51794 | 82298, 112802, 143306, 173810, 204314 |
| 1077 | ABG37167 | 15108 | 45612 | 76116, 106620, 137124, 167628, 198132 | 7260 | AEV53549 | 21291 | 51795 | 82299, 112803, 143307, 173811, 204315 |
| 1078 | ABG37189 | 15109 | 45613 | 76117, 106621, 137125, 167629, 198133 | 7261 | AEV53551 | 21292 | 51796 | 82300, 112804, 143308, 173812, 204316 |
| 1079 | ABG37200 | 15110 | 45614 | 76118, 106622, 137126, 167630, 198134 | 7262 | AEV53553 | 21293 | 51797 | 82301, 112805, 143309, 173813, 204317 |
| 1080 | ABG37211 | 15111 | 45615 | 76119, 106623, 137127, 167631, 198135 | 7263 | AEV53555 | 21294 | 51798 | 82302, 112806, 143310, 173814, 204318 |
| 1081 | ABG37233 | 15112 | 45616 | 76120, 106624, 137128, 167632, 198136 | 7264 | AEV53557 | 21295 | 51799 | 82303, 112807, 143311, 173815, 204319 |
| 1082 | ABG37244 | 15113 | 45617 | 76121, 106625, 137129, 167633, 198137 | 7265 | AEV53559 | 21296 | 51800 | 82304, 112808, 143312, 173816, 204320 |
| 1083 | ABG37255 | 15114 | 45618 | 76122, 106626, 137130, 167634, 198138 | 7266 | AEV53561 | 21297 | 51801 | 82305, 112809, 143313, 173817, 204321 |
| 1084 | ABG37266 | 15115 | 45619 | 76123, 106627, 137131, 167635, 198139 | 7267 | AEV53563 | 21298 | 51802 | 82306, 112810, 143314, 173818, 204322 |
| 1085 | ABG37277 | 15116 | 45620 | 76124, 106628, 137132, 167636, 198140 | 7268 | AEV53565 | 21299 | 51803 | 82307, 112811, 143315, 173819, 204323 |
| 1086 | ABG37288 | 15117 | 45621 | 76125, 106629, 137133, 167637, 198141 | 7269 | AEV53567 | 21300 | 51804 | 82308, 112812, 143316, 173820, 204324 |
| 1087 | ABG37310 | 15118 | 45622 | 76126, 106630, 137134, 167638, 198142 | 7270 | AEV53569 | 21301 | 51805 | 82309, 112813, 143317, 173821, 204325 |
| 1088 | ABG37321 | 15119 | 45623 | 76127, 106631, 137135, 167639, 198143 | 7271 | AEV53571 | 21302 | 51806 | 82310, 112814, 143318, 173822, 204326 |
| 1089 | ABG37332 | 15120 | 45624 | 76128, 106632, 137136, 167640, 198144 | 7272 | AEV53573 | 21303 | 51807 | 82311, 112815, 143319, 173823, 204327 |
| 1090 | ABG37343 | 15121 | 45625 | 76129, 106633, 137137, 167641, 198145 | 7273 | AEV53575 | 21304 | 51808 | 82312, 112816, 143320, 173824, 204328 |
| 1091 | ABG37354 | 15122 | 45626 | 76130, 106634, 137138, 167642, 198146 | 7274 | AEV53577 | 21305 | 51809 | 82313, 112817, 143321, 173825, 204329 |

FIG. 3 continued

| | | | | | | | | | |
|---|---|---|---|---|---|---|---|---|---|
| 1092 | ABG37365 | 15123 | 45627 | 76131, 106635, 137139, 167643, 198147 | 7275 | AEV53579 | 21306 | 51810 | 82314, 112818, 143322, 173826, 204330 |
| 1093 | ABG37387 | 15124 | 45628 | 76132, 106636, 137140, 167644, 198148 | 7276 | AEV53581 | 21307 | 51811 | 82315, 112819, 143323, 173827, 204331 |
| 1094 | ABG37398 | 15125 | 45629 | 76133, 106637, 137141, 167645, 198149 | 7277 | AEV53583 | 21308 | 51812 | 82316, 112820, 143324, 173828, 204332 |
| 1095 | ABG37409 | 15126 | 45630 | 76134, 106638, 137142, 167646, 198150 | 7278 | AEV53585 | 21309 | 51813 | 82317, 112821, 143325, 173829, 204333 |
| 1096 | ABG37442 | 15127 | 45631 | 76135, 106639, 137143, 167647, 198151 | 7279 | AEV76877 | 21310 | 51814 | 82318, 112822, 143326, 173830, 204334 |
| 1097 | ABG37453 | 15128 | 45632 | 76136, 106640, 137144, 167648, 198152 | 7280 | AEW10576 | 21311 | 51815 | 82319, 112823, 143327, 173831, 204335 |
| 1098 | ABG37464 | 15129 | 45633 | 76137, 106641, 137145, 167649, 198153 | 7281 | AEW10586 | 21312 | 51816 | 82320, 112824, 143328, 173832, 204336 |
| 1099 | ABG37475 | 15130 | 45634 | 76138, 106642, 137146, 167650, 198154 | 7282 | AEW10596 | 21313 | 51817 | 82321, 112825, 143329, 173833, 204337 |
| 1100 | ABG37486 | 15131 | 45635 | 76139, 106643, 137147, 167651, 198155 | 7283 | AEW10606 | 21314 | 51818 | 82322, 112826, 143330, 173834, 204338 |
| 1101 | ABG37497 | 15132 | 45636 | 76140, 106644, 137148, 167652, 198156 | 7284 | AEW10616 | 21315 | 51819 | 82323, 112827, 143331, 173835, 204339 |
| 1102 | ABG37508 | 15133 | 45637 | 76141, 106645, 137149, 167653, 198157 | 7285 | AEW10626 | 21316 | 51820 | 82324, 112828, 143332, 173836, 204340 |
| 1103 | ABG37519 | 15134 | 45638 | 76142, 106646, 137150, 167654, 198158 | 7286 | AEW10636 | 21317 | 51821 | 82325, 112829, 143333, 173837, 204341 |
| 1104 | ABG37530 | 15135 | 45639 | 76143, 106647, 137151, 167655, 198159 | 7287 | AEW10646 | 21318 | 51822 | 82326, 112830, 143334, 173838, 204342 |
| 1105 | ABG37541 | 15136 | 45640 | 76144, 106648, 137152, 167656, 198160 | 7288 | AEW10656 | 21319 | 51823 | 82327, 112831, 143335, 173839, 204343 |
| 1106 | ABG37552 | 15137 | 45641 | 76145, 106649, 137153, 167657, 198161 | 7289 | AEW10666 | 21320 | 51824 | 82328, 112832, 143336, 173840, 204344 |
| 1107 | ABG37563 | 15138 | 45642 | 76146, 106650, 137154, 167658, 198162 | 7290 | AEW10676 | 21321 | 51825 | 82329, 112833, 143337, 173841, 204345 |
| 1108 | ABG37585 | 15139 | 45643 | 76147, 106651, 137155, 167659, 198163 | 7291 | AEW10686 | 21322 | 51826 | 82330, 112834, 143338, 173842, 204346 |
| 1109 | ABG37596 | 15140 | 45644 | 76148, 106652, 137156, 167660, 198164 | 7292 | AEW10696 | 21323 | 51827 | 82331, 112835, 143339, 173843, 204347 |

FIG. 3 continued

| | | | | | | | | | |
|---|---|---|---|---|---|---|---|---|---|
| 1110 | ABG37607 | 15141 | 45645 | 76149, 106653, 137157, 167661, 198165 | 7293 | AEW10706 | 21324 | 51828 | 82332, 112836, 143340, 173844, 204348 |
| 1111 | ABG37618 | 15142 | 45646 | 76150, 106654, 137158, 167662, 198166 | 7294 | AEW10716 | 21325 | 51829 | 82333, 112837, 143341, 173845, 204349 |
| 1112 | ABG47810 | 15143 | 45647 | 76151, 106655, 137159, 167663, 198167 | 7295 | AEW10726 | 21326 | 51830 | 82334, 112838, 143342, 173846, 204350 |
| 1113 | ABG47832 | 15144 | 45648 | 76152, 106656, 137160, 167664, 198168 | 7296 | AEW10736 | 21327 | 51831 | 82335, 112839, 143343, 173847, 204351 |
| 1114 | ABG47843 | 15145 | 45649 | 76153, 106657, 137161, 167665, 198169 | 7297 | AEW10746 | 21328 | 51832 | 82336, 112840, 143344, 173848, 204352 |
| 1115 | ABG47865 | 15146 | 45650 | 76154, 106658, 137162, 167666, 198170 | 7298 | AEW10756 | 21329 | 51833 | 82337, 112841, 143345, 173849, 204353 |
| 1116 | ABG47876 | 15147 | 45651 | 76155, 106659, 137163, 167667, 198171 | 7299 | AEW10766 | 21330 | 51834 | 82338, 112842, 143346, 173850, 204354 |
| 1117 | ABG47887 | 15148 | 45652 | 76156, 106660, 137164, 167668, 198172 | 7300 | AEW10776 | 21331 | 51835 | 82339, 112843, 143347, 173851, 204355 |
| 1118 | ABG47898 | 15149 | 45653 | 76157, 106661, 137165, 167669, 198173 | 7301 | AEW10786 | 21332 | 51836 | 82340, 112844, 143348, 173852, 204356 |
| 1119 | ABG47909 | 15150 | 45654 | 76158, 106662, 137166, 167670, 198174 | 7302 | AEW10796 | 21333 | 51837 | 82341, 112845, 143349, 173853, 204357 |
| 1120 | ABG47920 | 15151 | 45655 | 76159, 106663, 137167, 167671, 198175 | 7303 | AEW10806 | 21334 | 51838 | 82342, 112846, 143350, 173854, 204358 |
| 1121 | ABG47931 | 15152 | 45656 | 76160, 106664, 137168, 167672, 198176 | 7304 | AEW10816 | 21335 | 51839 | 82343, 112847, 143351, 173855, 204359 |
| 1122 | ABG47942 | 15153 | 45657 | 76161, 106665, 137169, 167673, 198177 | 7305 | AEW10826 | 21336 | 51840 | 82344, 112848, 143352, 173856, 204360 |
| 1123 | ABG47953 | 15154 | 45658 | 76162, 106666, 137170, 167674, 198178 | 7306 | AEW10836 | 21337 | 51841 | 82345, 112849, 143353, 173857, 204361 |
| 1124 | ABG47964 | 15155 | 45659 | 76163, 106667, 137171, 167675, 198179 | 7307 | AEW10846 | 21338 | 51842 | 82346, 112850, 143354, 173858, 204362 |
| 1125 | ABG47975 | 15156 | 45660 | 76164, 106668, 137172, 167676, 198180 | 7308 | AEW10856 | 21339 | 51843 | 82347, 112851, 143355, 173859, 204363 |
| 1126 | ABG47986 | 15157 | 45661 | 76165, 106669, 137173, 167677, 198181 | 7309 | AEW10866 | 21340 | 51844 | 82348, 112852, 143356, 173860, 204364 |
| 1127 | ABG47997 | 15158 | 45662 | 76166, 106670, 137174, 167678, 198182 | 7310 | AEW10876 | 21341 | 51845 | 82349, 112853, 143357, 173861, 204365 |

FIG. 3 continued

| | | | | | | | | | |
|---|---|---|---|---|---|---|---|---|---|
| 1128 | ABG48008 | 15159 | 45663 | 76167, 106671, 137175, 167679, 198183 | 7311 | AEW10886 | 21342 | 51846 | 82350, 112854, 143358, 173862, 204366 |
| 1129 | ABG48019 | 15160 | 45664 | 76168, 106672, 137176, 167680, 198184 | 7312 | AEW10896 | 21343 | 51847 | 82351, 112855, 143359, 173863, 204367 |
| 1130 | ABG48030 | 15161 | 45665 | 76169, 106673, 137177, 167681, 198185 | 7313 | AEW10906 | 21344 | 51848 | 82352, 112856, 143360, 173864, 204368 |
| 1131 | ABG48041 | 15162 | 45666 | 76170, 106674, 137178, 167682, 198186 | 7314 | AEW10916 | 21345 | 51849 | 82353, 112857, 143361, 173865, 204369 |
| 1132 | ABG48052 | 15163 | 45667 | 76171, 106675, 137179, 167683, 198187 | 7315 | AEW10926 | 21346 | 51850 | 82354, 112858, 143362, 173866, 204370 |
| 1133 | ABG48063 | 15164 | 45668 | 76172, 106676, 137180, 167684, 198188 | 7316 | AEW10936 | 21347 | 51851 | 82355, 112859, 143363, 173867, 204371 |
| 1134 | ABG48074 | 15165 | 45669 | 76173, 106677, 137181, 167685, 198189 | 7317 | AEW10946 | 21348 | 51852 | 82356, 112860, 143364, 173868, 204372 |
| 1135 | ABG48085 | 15166 | 45670 | 76174, 106678, 137182, 167686, 198190 | 7318 | AEW10956 | 21349 | 51853 | 82357, 112861, 143365, 173869, 204373 |
| 1136 | ABG48107 | 15167 | 45671 | 76175, 106679, 137183, 167687, 198191 | 7319 | AEW10966 | 21350 | 51854 | 82358, 112862, 143366, 173870, 204374 |
| 1137 | ABG48118 | 15168 | 45672 | 76176, 106680, 137184, 167688, 198192 | 7320 | AEW10976 | 21351 | 51855 | 82359, 112863, 143367, 173871, 204375 |
| 1138 | ABG48129 | 15169 | 45673 | 76177, 106681, 137185, 167689, 198193 | 7321 | AEW10986 | 21352 | 51856 | 82360, 112864, 143368, 173872, 204376 |
| 1139 | ABG48140 | 15170 | 45674 | 76178, 106682, 137186, 167690, 198194 | 7322 | AEW10996 | 21353 | 51857 | 82361, 112865, 143369, 173873, 204377 |
| 1140 | ABG48151 | 15171 | 45675 | 76179, 106683, 137187, 167691, 198195 | 7323 | AEW11006 | 21354 | 51858 | 82362, 112866, 143370, 173874, 204378 |
| 1141 | ABG48173 | 15172 | 45676 | 76180, 106684, 137188, 167692, 198196 | 7324 | AEW11016 | 21355 | 51859 | 82363, 112867, 143371, 173875, 204379 |
| 1142 | ABG48184 | 15173 | 45677 | 76181, 106685, 137189, 167693, 198197 | 7325 | AEW11026 | 21356 | 51860 | 82364, 112868, 143372, 173876, 204380 |
| 1143 | ABG48195 | 15174 | 45678 | 76182, 106686, 137190, 167694, 198198 | 7326 | AEW11036 | 21357 | 51861 | 82365, 112869, 143373, 173877, 204381 |
| 1144 | ABG48206 | 15175 | 45679 | 76183, 106687, 137191, 167695, 198199 | 7327 | AEW11046 | 21358 | 51862 | 82366, 112870, 143374, 173878, 204382 |
| 1145 | ABG48217 | 15176 | 45680 | 76184, 106688, 137192, 167696, 198200 | 7328 | AEW11056 | 21359 | 51863 | 82367, 112871, 143375, 173879, 204383 |

FIG. 3 continued

| | | | | | | | | | |
|---|---|---|---|---|---|---|---|---|---|
| 1146 | ABG48228 | 15177 | 45681 | 76185, 106689, 137193, 167697, 198201 | 7329 | AEW11066 | 21360 | 51864 | 82368, 112872, 143376, 173880, 204384 |
| 1147 | ABG48239 | 15178 | 45682 | 76186, 106690, 137194, 167698, 198202 | 7330 | AEW11076 | 21361 | 51865 | 82369, 112873, 143377, 173881, 204385 |
| 1148 | ABG48250 | 15179 | 45683 | 76187, 106691, 137195, 167699, 198203 | 7331 | AEW11086 | 21362 | 51866 | 82370, 112874, 143378, 173882, 204386 |
| 1149 | ABG48272 | 15180 | 45684 | 76188, 106692, 137196, 167700, 198204 | 7332 | AEW11096 | 21363 | 51867 | 82371, 112875, 143379, 173883, 204387 |
| 1150 | ABG48294 | 15181 | 45685 | 76189, 106693, 137197, 167701, 198205 | 7333 | AEW11106 | 21364 | 51868 | 82372, 112876, 143380, 173884, 204388 |
| 1151 | ABG48305 | 15182 | 45686 | 76190, 106694, 137198, 167702, 198206 | 7334 | AEW11116 | 21365 | 51869 | 82373, 112877, 143381, 173885, 204389 |
| 1152 | ABG48316 | 15183 | 45687 | 76191, 106695, 137199, 167703, 198207 | 7335 | AEW11126 | 21366 | 51870 | 82374, 112878, 143382, 173886, 204390 |
| 1153 | ABG48327 | 15184 | 45688 | 76192, 106696, 137200, 167704, 198208 | 7336 | AEW11136 | 21367 | 51871 | 82375, 112879, 143383, 173887, 204391 |
| 1154 | ABG48338 | 15185 | 45689 | 76193, 106697, 137201, 167705, 198209 | 7337 | AEW11146 | 21368 | 51872 | 82376, 112880, 143384, 173888, 204392 |
| 1155 | ABG48349 | 15186 | 45690 | 76194, 106698, 137202, 167706, 198210 | 7338 | AEW11156 | 21369 | 51873 | 82377, 112881, 143385, 173889, 204393 |
| 1156 | ABG48360 | 15187 | 45691 | 76195, 106699, 137203, 167707, 198211 | 7339 | AEW11166 | 21370 | 51874 | 82378, 112882, 143386, 173890, 204394 |
| 1157 | ABG48371 | 15188 | 45692 | 76196, 106700, 137204, 167708, 198212 | 7340 | AEW11176 | 21371 | 51875 | 82379, 112883, 143387, 173891, 204395 |
| 1158 | ABG67138 | 15189 | 45693 | 76197, 106701, 137205, 167709, 198213 | 7341 | AEW11186 | 21372 | 51876 | 82380, 112884, 143388, 173892, 204396 |
| 1159 | ABG67149 | 15190 | 45694 | 76198, 106702, 137206, 167710, 198214 | 7342 | AEW11196 | 21373 | 51877 | 82381, 112885, 143389, 173893, 204397 |
| 1160 | ABG67160 | 15191 | 45695 | 76199, 106703, 137207, 167711, 198215 | 7343 | AEW11206 | 21374 | 51878 | 82382, 112886, 143390, 173894, 204398 |
| 1161 | ABG67171 | 15192 | 45696 | 76200, 106704, 137208, 167712, 198216 | 7344 | AEW11216 | 21375 | 51879 | 82383, 112887, 143391, 173895, 204399 |
| 1162 | ABG67182 | 15193 | 45697 | 76201, 106705, 137209, 167713, 198217 | 7345 | AEW11226 | 21376 | 51880 | 82384, 112888, 143392, 173896, 204400 |
| 1163 | ABG67193 | 15194 | 45698 | 76202, 106706, 137210, 167714, 198218 | 7346 | AEW11236 | 21377 | 51881 | 82385, 112889, 143393, 173897, 204401 |

FIG. 3 continued

| | | | | | | | | | |
|---|---|---|---|---|---|---|---|---|---|
| 1164 | ABG67204 | 15195 | 45699 | 76203, 106707, 137211, 167715, 198219 | 7347 | AEW11246 | 21378 | 51882 | 82386, 112890, 143394, 173898, 204402 |
| 1165 | ABG67215 | 15196 | 45700 | 76204, 106708, 137212, 167716, 198220 | 7348 | AEW11255 | 21379 | 51883 | 82387, 112891, 143395, 173899, 204403 |
| 1166 | ABG67226 | 15197 | 45701 | 76205, 106709, 137213, 167717, 198221 | 7349 | AEW11265 | 21380 | 51884 | 82388, 112892, 143396, 173900, 204404 |
| 1167 | ABG67248 | 15198 | 45702 | 76206, 106710, 137214, 167718, 198222 | 7350 | AEW11275 | 21381 | 51885 | 82389, 112893, 143397, 173901, 204405 |
| 1168 | ABG67480 | 15199 | 45703 | 76207, 106711, 137215, 167719, 198223 | 7351 | AEW11285 | 21382 | 51886 | 82390, 112894, 143398, 173902, 204406 |
| 1169 | ABG67494 | 15200 | 45704 | 76208, 106712, 137216, 167720, 198224 | 7352 | AEW11295 | 21383 | 51887 | 82391, 112895, 143399, 173903, 204407 |
| 1170 | ABG67505 | 15201 | 45705 | 76209, 106713, 137217, 167721, 198225 | 7353 | AEW11305 | 21384 | 51888 | 82392, 112896, 143400, 173904, 204408 |
| 1171 | ABG67516 | 15202 | 45706 | 76210, 106714, 137218, 167722, 198226 | 7354 | AEW11315 | 21385 | 51889 | 82393, 112897, 143401, 173905, 204409 |
| 1172 | ABG67527 | 15203 | 45707 | 76211, 106715, 137219, 167723, 198227 | 7355 | AEW11325 | 21386 | 51890 | 82394, 112898, 143402, 173906, 204410 |
| 1173 | ABG67538 | 15204 | 45708 | 76212, 106716, 137220, 167724, 198228 | 7356 | AEW25299 | 21387 | 51891 | 82395, 112899, 143403, 173907, 204411 |
| 1174 | ABG67549 | 15205 | 45709 | 76213, 106717, 137221, 167725, 198229 | 7357 | AEW25308 | 21388 | 51892 | 82396, 112900, 143404, 173908, 204412 |
| 1175 | ABG67560 | 15206 | 45710 | 76214, 106718, 137222, 167726, 198230 | 7358 | AEW25317 | 21389 | 51893 | 82397, 112901, 143405, 173909, 204413 |
| 1176 | ABG67571 | 15207 | 45711 | 76215, 106719, 137223, 167727, 198231 | 7359 | AEW25324 | 21390 | 51894 | 82398, 112902, 143406, 173910, 204414 |
| 1177 | ABG67582 | 15208 | 45712 | 76216, 106720, 137224, 167728, 198232 | 7360 | AEW25327 | 21391 | 51895 | 82399, 112903, 143407, 173911, 204415 |
| 1178 | ABG67593 | 15209 | 45713 | 76217, 106721, 137225, 167729, 198233 | 7361 | AEW25333 | 21392 | 51896 | 82400, 112904, 143408, 173912, 204416 |
| 1179 | ABG67604 | 15210 | 45714 | 76218, 106722, 137226, 167730, 198234 | 7362 | AEW25338 | 21393 | 51897 | 82401, 112905, 143409, 173913, 204417 |
| 1180 | ABG67615 | 15211 | 45715 | 76219, 106723, 137227, 167731, 198235 | 7363 | AEW25343 | 21394 | 51898 | 82402, 112906, 143410, 173914, 204418 |
| 1181 | ABG67626 | 15212 | 45716 | 76220, 106724, 137228, 167732, 198236 | 7364 | AEW25351 | 21395 | 51899 | 82403, 112907, 143411, 173915, 204419 |

FIG. 3 continued

| | | | | | | | | | |
|---|---|---|---|---|---|---|---|---|---|
| 1182 | ABG67637 | 15213 | 45717 | 76221, 106725, 137229, 167733, 198237 | 7365 | AEW25358 | 21396 | 51900 | 82404, 112908, 143412, 173916, 204420 |
| 1183 | ABG67648 | 15214 | 45718 | 76222, 106726, 137230, 167734, 198238 | 7366 | AEW25361 | 21397 | 51901 | 82405, 112909, 143413, 173917, 204421 |
| 1184 | ABG67659 | 15215 | 45719 | 76223, 106727, 137231, 167735, 198239 | 7367 | AEW25379 | 21398 | 51902 | 82406, 112910, 143414, 173918, 204422 |
| 1185 | ABG67670 | 15216 | 45720 | 76224, 106728, 137232, 167736, 198240 | 7368 | AEW25387 | 21399 | 51903 | 82407, 112911, 143415, 173919, 204423 |
| 1186 | ABG79944 | 15217 | 45721 | 76225, 106729, 137233, 167737, 198241 | 7369 | AEW25392 | 21400 | 51904 | 82408, 112912, 143416, 173920, 204424 |
| 1187 | ABG79955 | 15218 | 45722 | 76226, 106730, 137234, 167738, 198242 | 7370 | AEW25397 | 21401 | 51905 | 82409, 112913, 143417, 173921, 204425 |
| 1188 | ABG79966 | 15219 | 45723 | 76227, 106731, 137235, 167739, 198243 | 7371 | AEW25402 | 21402 | 51906 | 82410, 112914, 143418, 173922, 204426 |
| 1189 | ABG79977 | 15220 | 45724 | 76228, 106732, 137236, 167740, 198244 | 7372 | AEW25407 | 21403 | 51907 | 82411, 112915, 143419, 173923, 204427 |
| 1190 | ABG79988 | 15221 | 45725 | 76229, 106733, 137237, 167741, 198245 | 7373 | AEW25418 | 21404 | 51908 | 82412, 112916, 143420, 173924, 204428 |
| 1191 | ABG79999 | 15222 | 45726 | 76230, 106734, 137238, 167742, 198246 | 7374 | AEW25423 | 21405 | 51909 | 82413, 112917, 143421, 173925, 204429 |
| 1192 | ABG80010 | 15223 | 45727 | 76231, 106735, 137239, 167743, 198247 | 7375 | AEW25426 | 21406 | 51910 | 82414, 112918, 143422, 173926, 204430 |
| 1193 | ABG80021 | 15224 | 45728 | 76232, 106736, 137240, 167744, 198248 | 7376 | AEW25432 | 21407 | 51911 | 82415, 112919, 143423, 173927, 204431 |
| 1194 | ABG80032 | 15225 | 45729 | 76233, 106737, 137241, 167745, 198249 | 7377 | AEW25436 | 21408 | 51912 | 82416, 112920, 143424, 173928, 204432 |
| 1195 | ABG80043 | 15226 | 45730 | 76234, 106738, 137242, 167746, 198250 | 7378 | AEW25440 | 21409 | 51913 | 82417, 112921, 143425, 173929, 204433 |
| 1196 | ABG80054 | 15227 | 45731 | 76235, 106739, 137243, 167747, 198251 | 7379 | AEW25448 | 21410 | 51914 | 82418, 112922, 143426, 173930, 204434 |
| 1197 | ABG80065 | 15228 | 45732 | 76236, 106740, 137244, 167748, 198252 | 7380 | AEW25456 | 21411 | 51915 | 82419, 112923, 143427, 173931, 204435 |
| 1198 | ABG80076 | 15229 | 45733 | 76237, 106741, 137245, 167749, 198253 | 7381 | AEW25464 | 21412 | 51916 | 82420, 112924, 143428, 173932, 204436 |
| 1199 | ABG80087 | 15230 | 45734 | 76238, 106742, 137246, 167750, 198254 | 7382 | AEW25474 | 21413 | 51917 | 82421, 112925, 143429, 173933, 204437 |

FIG. 3 continued

| | | | | | | | | | |
|---|---|---|---|---|---|---|---|---|---|
| 1200 | ABG80098 | 15231 | 45735 | 76239, 106743, 137247, 167751, 198255 | 7383 | AEW25484 | 21414 | 51918 | 82422, 112926, 143430, 173934, 204438 |
| 1201 | ABG80109 | 15232 | 45736 | 76240, 106744, 137248, 167752, 198256 | 7384 | AEW25494 | 21415 | 51919 | 82423, 112927, 143431, 173935, 204439 |
| 1202 | ABG80120 | 15233 | 45737 | 76241, 106745, 137249, 167753, 198257 | 7385 | AEW25503 | 21416 | 51920 | 82424, 112928, 143432, 173936, 204440 |
| 1203 | ABG80131 | 15234 | 45738 | 76242, 106746, 137250, 167754, 198258 | 7386 | AEW25511 | 21417 | 51921 | 82425, 112929, 143433, 173937, 204441 |
| 1204 | ABG80142 | 15235 | 45739 | 76243, 106747, 137251, 167755, 198259 | 7387 | AEW25530 | 21418 | 51922 | 82426, 112930, 143434, 173938, 204442 |
| 1205 | ABG80153 | 15236 | 45740 | 76244, 106748, 137252, 167756, 198260 | 7388 | AEW25537 | 21419 | 51923 | 82427, 112931, 143435, 173939, 204443 |
| 1206 | ABG80164 | 15237 | 45741 | 76245, 106749, 137253, 167757, 198261 | 7389 | AEW25547 | 21420 | 51924 | 82428, 112932, 143436, 173940, 204444 |
| 1207 | ABG80186 | 15238 | 45742 | 76246, 106750, 137254, 167758, 198262 | 7390 | AEW25556 | 21421 | 51925 | 82429, 112933, 143437, 173941, 204445 |
| 1208 | ABG80197 | 15239 | 45743 | 76247, 106751, 137255, 167759, 198263 | 7391 | AEW25566 | 21422 | 51926 | 82430, 112934, 143438, 173942, 204446 |
| 1209 | ABG80219 | 15240 | 45744 | 76248, 106752, 137256, 167760, 198264 | 7392 | AEW25584 | 21423 | 51927 | 82431, 112935, 143439, 173943, 204447 |
| 1210 | ABG80230 | 15241 | 45745 | 76249, 106753, 137257, 167761, 198265 | 7393 | AEW25592 | 21424 | 51928 | 82432, 112936, 143440, 173944, 204448 |
| 1211 | ABG80241 | 15242 | 45746 | 76250, 106754, 137258, 167762, 198266 | 7394 | AEW25602 | 21425 | 51929 | 82433, 112937, 143441, 173945, 204449 |
| 1212 | ABG80252 | 15243 | 45747 | 76251, 106755, 137259, 167763, 198267 | 7395 | AEW25612 | 21426 | 51930 | 82434, 112938, 143442, 173946, 204450 |
| 1213 | ABG80263 | 15244 | 45748 | 76252, 106756, 137260, 167764, 198268 | 7396 | AEW25622 | 21427 | 51931 | 82435, 112939, 143443, 173947, 204451 |
| 1214 | ABG80274 | 15245 | 45749 | 76253, 106757, 137261, 167765, 198269 | 7397 | AEW25631 | 21428 | 51932 | 82436, 112940, 143444, 173948, 204452 |
| 1215 | ABG80285 | 15246 | 45750 | 76254, 106758, 137262, 167766, 198270 | 7398 | AEW25639 | 21429 | 51933 | 82437, 112941, 143445, 173949, 204453 |
| 1216 | ABG80296 | 15247 | 45751 | 76255, 106759, 137263, 167767, 198271 | 7399 | AEW25648 | 21430 | 51934 | 82438, 112942, 143446, 173950, 204454 |
| 1217 | ABG80307 | 15248 | 45752 | 76256, 106760, 137264, 167768, 198272 | 7400 | AEW25656 | 21431 | 51935 | 82439, 112943, 143447, 173951, 204455 |

FIG. 3 continued

| | | | | | | | | | |
|---|---|---|---|---|---|---|---|---|---|
| 1218 | ABG80318 | 15249 | 45753 | 76257, 106761, 137265, 167769, 198273 | 7401 | AEW25664 | 21432 | 51936 | 82440, 112944, 143448, 173952, 204456 |
| 1219 | ABG80329 | 15250 | 45754 | 76258, 106762, 137266, 167770, 198274 | 7402 | AEW25671 | 21433 | 51937 | 82441, 112945, 143449, 173953, 204457 |
| 1220 | ABG80340 | 15251 | 45755 | 76259, 106763, 137267, 167771, 198275 | 7403 | AEW25680 | 21434 | 51938 | 82442, 112946, 143450, 173954, 204458 |
| 1221 | ABG80351 | 15252 | 45756 | 76260, 106764, 137268, 167772, 198276 | 7404 | AEW25689 | 21435 | 51939 | 82443, 112947, 143451, 173955, 204459 |
| 1222 | ABG80373 | 15253 | 45757 | 76261, 106765, 137269, 167773, 198277 | 7405 | AEW25698 | 21436 | 51940 | 82444, 112948, 143452, 173956, 204460 |
| 1223 | ABG80384 | 15254 | 45758 | 76262, 106766, 137270, 167774, 198278 | 7406 | AEW25708 | 21437 | 51941 | 82445, 112949, 143453, 173957, 204461 |
| 1224 | ABG80395 | 15255 | 45759 | 76263, 106767, 137271, 167775, 198279 | 7407 | AEX09177 | 21438 | 51942 | 82446, 112950, 143454, 173958, 204462 |
| 1225 | ABG80406 | 15256 | 45760 | 76264, 106768, 137272, 167776, 198280 | 7408 | AEX33324 | 21439 | 51943 | 82447, 112951, 143455, 173959, 204463 |
| 1226 | ABG80417 | 15257 | 45761 | 76265, 106769, 137273, 167777, 198281 | 7409 | AEX33368 | 21440 | 51944 | 82448, 112952, 143456, 173960, 204464 |
| 1227 | ABG80428 | 15258 | 45762 | 76266, 106770, 137274, 167778, 198282 | 7410 | AEX33379 | 21441 | 51945 | 82449, 112953, 143457, 173961, 204465 |
| 1228 | ABG88292 | 15259 | 45763 | 76267, 106771, 137275, 167779, 198283 | 7411 | AEX33390 | 21442 | 51946 | 82450, 112954, 143458, 173962, 204466 |
| 1229 | ABG88314 | 15260 | 45764 | 76268, 106772, 137276, 167780, 198284 | 7412 | AEX33401 | 21443 | 51947 | 82451, 112955, 143459, 173963, 204467 |
| 1230 | ABG88325 | 15261 | 45765 | 76269, 106773, 137277, 167781, 198285 | 7413 | AEX33412 | 21444 | 51948 | 82452, 112956, 143460, 173964, 204468 |
| 1231 | ABG88336 | 15262 | 45766 | 76270, 106774, 137278, 167782, 198286 | 7414 | AEX33423 | 21445 | 51949 | 82453, 112957, 143461, 173965, 204469 |
| 1232 | ABG88347 | 15263 | 45767 | 76271, 106775, 137279, 167783, 198287 | 7415 | AEX33434 | 21446 | 51950 | 82454, 112958, 143462, 173966, 204470 |
| 1233 | ABG88358 | 15264 | 45768 | 76272, 106776, 137280, 167784, 198288 | 7416 | AEX33445 | 21447 | 51951 | 82455, 112959, 143463, 173967, 204471 |
| 1234 | ABG88369 | 15265 | 45769 | 76273, 106777, 137281, 167785, 198289 | 7417 | AEX33544 | 21448 | 51952 | 82456, 112960, 143464, 173968, 204472 |
| 1235 | ABG88380 | 15266 | 45770 | 76274, 106778, 137282, 167786, 198290 | 7418 | AEX33555 | 21449 | 51953 | 82457, 112961, 143465, 173969, 204473 |

FIG. 3 continued

| | | | | | | | | | |
|---|---|---|---|---|---|---|---|---|---|
| 1236 | ABG88391 | 15267 | 45771 | 76275, 106779, 137283, 167787, 198291 | 7419 | AEX33610 | 21450 | 51954 | 82458, 112962, 143466, 173970, 204474 |
| 1237 | ABG88402 | 15268 | 45772 | 76276, 106780, 137284, 167788, 198292 | 7420 | AEX33828 | 21451 | 51955 | 82459, 112963, 143467, 173971, 204475 |
| 1238 | ABG88413 | 15269 | 45773 | 76277, 106781, 137285, 167789, 198293 | 7421 | AEX33839 | 21452 | 51956 | 82460, 112964, 143468, 173972, 204476 |
| 1239 | ABG88424 | 15270 | 45774 | 76278, 106782, 137286, 167790, 198294 | 7422 | AEX33861 | 21453 | 51957 | 82461, 112965, 143469, 173973, 204477 |
| 1240 | ABG88435 | 15271 | 45775 | 76279, 106783, 137287, 167791, 198295 | 7423 | AEX33872 | 21454 | 51958 | 82462, 112966, 143470, 173974, 204478 |
| 1241 | ABG88446 | 15272 | 45776 | 76280, 106784, 137288, 167792, 198296 | 7424 | AEX33883 | 21455 | 51959 | 82463, 112967, 143471, 173975, 204479 |
| 1242 | ABG88457 | 15273 | 45777 | 76281, 106785, 137289, 167793, 198297 | 7425 | AEX33894 | 21456 | 51960 | 82464, 112968, 143472, 173976, 204480 |
| 1243 | ABG88468 | 15274 | 45778 | 76282, 106786, 137290, 167794, 198298 | 7426 | AEX33916 | 21457 | 51961 | 82465, 112969, 143473, 173977, 204481 |
| 1244 | ABG88479 | 15275 | 45779 | 76283, 106787, 137291, 167795, 198299 | 7427 | AEX33927 | 21458 | 51962 | 82466, 112970, 143474, 173978, 204482 |
| 1245 | ABG88490 | 15276 | 45780 | 76284, 106788, 137292, 167796, 198300 | 7428 | AEX33938 | 21459 | 51963 | 82467, 112971, 143475, 173979, 204483 |
| 1246 | ABG88501 | 15277 | 45781 | 76285, 106789, 137293, 167797, 198301 | 7429 | AEX33949 | 21460 | 51964 | 82468, 112972, 143476, 173980, 204484 |
| 1247 | ABG88512 | 15278 | 45782 | 76286, 106790, 137294, 167798, 198302 | 7430 | AEX33971 | 21461 | 51965 | 82469, 112973, 143477, 173981, 204485 |
| 1248 | ABG88523 | 15279 | 45783 | 76287, 106791, 137295, 167799, 198303 | 7431 | AEX33993 | 21462 | 51966 | 82470, 112974, 143478, 173982, 204486 |
| 1249 | ABG88534 | 15280 | 45784 | 76288, 106792, 137296, 167800, 198304 | 7432 | AEX34026 | 21463 | 51967 | 82471, 112975, 143479, 173983, 204487 |
| 1250 | ABG88567 | 15281 | 45785 | 76289, 106793, 137297, 167801, 198305 | 7433 | AEX34036 | 21464 | 51968 | 82472, 112976, 143480, 173984, 204488 |
| 1251 | ABG88600 | 15282 | 45786 | 76290, 106794, 137298, 167802, 198306 | 7434 | AEX34058 | 21465 | 51969 | 82473, 112977, 143481, 173985, 204489 |
| 1252 | ABG88611 | 15283 | 45787 | 76291, 106795, 137299, 167803, 198307 | 7435 | AEX34103 | 21466 | 51970 | 82474, 112978, 143482, 173986, 204490 |
| 1253 | ABG88622 | 15284 | 45788 | 76292, 106796, 137300, 167804, 198308 | 7436 | AEX34114 | 21467 | 51971 | 82475, 112979, 143483, 173987, 204491 |

FIG. 3 continued

| | | | | | | | | | |
|---|---|---|---|---|---|---|---|---|---|
| 1254 | ABG88633 | 15285 | 45789 | 76293, 106797, 137301, 167805, 198309 | 7437 | AEX34137 | 21468 | 51972 | 82476, 112980, 143484, 173988, 204492 |
| 1255 | ABG88655 | 15286 | 45790 | 76294, 106798, 137302, 167806, 198310 | 7438 | AEX34191 | 21469 | 51973 | 82477, 112981, 143485, 173989, 204493 |
| 1256 | ABG88666 | 15287 | 45791 | 76295, 106799, 137303, 167807, 198311 | 7439 | AEX34224 | 21470 | 51974 | 82478, 112982, 143486, 173990, 204494 |
| 1257 | ABG88677 | 15288 | 45792 | 76296, 106800, 137304, 167808, 198312 | 7440 | AEX34235 | 21471 | 51975 | 82479, 112983, 143487, 173991, 204495 |
| 1258 | ABG88688 | 15289 | 45793 | 76297, 106801, 137305, 167809, 198313 | 7441 | AEX34246 | 21472 | 51976 | 82480, 112984, 143488, 173992, 204496 |
| 1259 | ABG88699 | 15290 | 45794 | 76298, 106802, 137306, 167810, 198314 | 7442 | AEX34257 | 21473 | 51977 | 82481, 112985, 143489, 173993, 204497 |
| 1260 | ABG88710 | 15291 | 45795 | 76299, 106803, 137307, 167811, 198315 | 7443 | AEX34268 | 21474 | 51978 | 82482, 112986, 143490, 173994, 204498 |
| 1261 | ABG88721 | 15292 | 45796 | 76300, 106804, 137308, 167812, 198316 | 7444 | AEX34278 | 21475 | 51979 | 82483, 112987, 143491, 173995, 204499 |
| 1262 | ABG88732 | 15293 | 45797 | 76301, 106805, 137309, 167813, 198317 | 7445 | AEX34310 | 21476 | 51980 | 82484, 112988, 143492, 173996, 204500 |
| 1263 | ABG88743 | 15294 | 45798 | 76302, 106806, 137310, 167814, 198318 | 7446 | AEX34321 | 21477 | 51981 | 82485, 112989, 143493, 173997, 204501 |
| 1264 | ABG88754 | 15295 | 45799 | 76303, 106807, 137311, 167815, 198319 | 7447 | AEX34356 | 21478 | 51982 | 82486, 112990, 143494, 173998, 204502 |
| 1265 | ABG88765 | 15296 | 45800 | 76304, 106808, 137312, 167816, 198320 | 7448 | AEX34367 | 21479 | 51983 | 82487, 112991, 143495, 173999, 204503 |
| 1266 | ABG88776 | 15297 | 45801 | 76305, 106809, 137313, 167817, 198321 | 7449 | AEX34378 | 21480 | 51984 | 82488, 112992, 143496, 174000, 204504 |
| 1267 | ABG88787 | 15298 | 45802 | 76306, 106810, 137314, 167818, 198322 | 7450 | AEX34400 | 21481 | 51985 | 82489, 112993, 143497, 174001, 204505 |
| 1268 | ABG88820 | 15299 | 45803 | 76307, 106811, 137315, 167819, 198323 | 7451 | AEX34432 | 21482 | 51986 | 82490, 112994, 143498, 174002, 204506 |
| 1269 | ABI16506 | 15300 | 45804 | 76308, 106812, 137316, 167820, 198324 | 7452 | AEX34443 | 21483 | 51987 | 82491, 112995, 143499, 174003, 204507 |
| 1270 | ABI20840 | 15301 | 45805 | 76309, 106813, 137317, 167821, 198325 | 7453 | AEX34454 | 21484 | 51988 | 82492, 112996, 143500, 174004, 204508 |
| 1271 | ABI20862 | 15302 | 45806 | 76310, 106814, 137318, 167822, 198326 | 7454 | AEX34465 | 21485 | 51989 | 82493, 112997, 143501, 174005, 204509 |

FIG. 3 continued

| | | | | | | | | | |
|---|---|---|---|---|---|---|---|---|---|
| 1272 | ABI20873 | 15303 | 45807 | 76311, 106815, 137319, 167823, 198327 | 7455 | AEX34476 | 21486 | 51990 | 82494, 112998, 143502, 174006, 204510 |
| 1273 | ABI20895 | 15304 | 45808 | 76312, 106816, 137320, 167824, 198328 | 7456 | AEX34487 | 21487 | 51991 | 82495, 112999, 143503, 174007, 204511 |
| 1274 | ABI20906 | 15305 | 45809 | 76313, 106817, 137321, 167825, 198329 | 7457 | AEX34498 | 21488 | 51992 | 82496, 113000, 143504, 174008, 204512 |
| 1275 | ABI20928 | 15306 | 45810 | 76314, 106818, 137322, 167826, 198330 | 7458 | AEX34509 | 21489 | 51993 | 82497, 113001, 143505, 174009, 204513 |
| 1276 | ABI20939 | 15307 | 45811 | 76315, 106819, 137323, 167827, 198331 | 7459 | AEX34520 | 21490 | 51994 | 82498, 113002, 143506, 174010, 204514 |
| 1277 | ABI20950 | 15308 | 45812 | 76316, 106820, 137324, 167828, 198332 | 7460 | AEX34531 | 21491 | 51995 | 82499, 113003, 143507, 174011, 204515 |
| 1278 | ABI20961 | 15309 | 45813 | 76317, 106821, 137325, 167829, 198333 | 7461 | AEX34542 | 21492 | 51996 | 82500, 113004, 143508, 174012, 204516 |
| 1279 | ABI20983 | 15310 | 45814 | 76318, 106822, 137326, 167830, 198334 | 7462 | AEX34553 | 21493 | 51997 | 82501, 113005, 143509, 174013, 204517 |
| 1280 | ABI20994 | 15311 | 45815 | 76319, 106823, 137327, 167831, 198335 | 7463 | AEX34564 | 21494 | 51998 | 82502, 113006, 143510, 174014, 204518 |
| 1281 | ABI21005 | 15312 | 45816 | 76320, 106824, 137328, 167832, 198336 | 7464 | AEX34575 | 21495 | 51999 | 82503, 113007, 143511, 174015, 204519 |
| 1282 | ABI21016 | 15313 | 45817 | 76321, 106825, 137329, 167833, 198337 | 7465 | AEX34586 | 21496 | 52000 | 82504, 113008, 143512, 174016, 204520 |
| 1283 | ABI21027 | 15314 | 45818 | 76322, 106826, 137330, 167834, 198338 | 7466 | AEX34597 | 21497 | 52001 | 82505, 113009, 143513, 174017, 204521 |
| 1284 | ABI21038 | 15315 | 45819 | 76323, 106827, 137331, 167835, 198339 | 7467 | AEX34608 | 21498 | 52002 | 82506, 113010, 143514, 174018, 204522 |
| 1285 | ABI21049 | 15316 | 45820 | 76324, 106828, 137332, 167836, 198340 | 7468 | AEX34619 | 21499 | 52003 | 82507, 113011, 143515, 174019, 204523 |
| 1286 | ABI21060 | 15317 | 45821 | 76325, 106829, 137333, 167837, 198341 | 7469 | AEX34630 | 21500 | 52004 | 82508, 113012, 143516, 174020, 204524 |
| 1287 | ABI21071 | 15318 | 45822 | 76326, 106830, 137334, 167838, 198342 | 7470 | AEX34641 | 21501 | 52005 | 82509, 113013, 143517, 174021, 204525 |
| 1288 | ABI21082 | 15319 | 45823 | 76327, 106831, 137335, 167839, 198343 | 7471 | AEX34653 | 21502 | 52006 | 82510, 113014, 143518, 174022, 204526 |
| 1289 | ABI21093 | 15320 | 45824 | 76328, 106832, 137336, 167840, 198344 | 7472 | AEX34664 | 21503 | 52007 | 82511, 113015, 143519, 174023, 204527 |

FIG. 3 continued

| | | | | | | | | | |
|---|---|---|---|---|---|---|---|---|---|
| 1290 | ABI21104 | 15321 | 45825 | 76329, 106833, 137337, 167841, 198345 | 7473 | AEX34686 | 21504 | 52008 | 82512, 113016, 143520, 174024, 204528 |
| 1291 | ABI21115 | 15322 | 45826 | 76330, 106834, 137338, 167842, 198346 | 7474 | AEX34760 | 21505 | 52009 | 82513, 113017, 143521, 174025, 204529 |
| 1292 | ABI21126 | 15323 | 45827 | 76331, 106835, 137339, 167843, 198347 | 7475 | AEX34771 | 21506 | 52010 | 82514, 113018, 143522, 174026, 204530 |
| 1293 | ABI21137 | 15324 | 45828 | 76332, 106836, 137340, 167844, 198348 | 7476 | AEX34782 | 21507 | 52011 | 82515, 113019, 143523, 174027, 204531 |
| 1294 | ABI21148 | 15325 | 45829 | 76333, 106837, 137341, 167845, 198349 | 7477 | AEX34793 | 21508 | 52012 | 82516, 113020, 143524, 174028, 204532 |
| 1295 | ABI21159 | 15326 | 45830 | 76334, 106838, 137342, 167846, 198350 | 7478 | AEX34804 | 21509 | 52013 | 82517, 113021, 143525, 174029, 204533 |
| 1296 | ABI21170 | 15327 | 45831 | 76335, 106839, 137343, 167847, 198351 | 7479 | AEX34815 | 21510 | 52014 | 82518, 113022, 143526, 174030, 204534 |
| 1297 | ABI21181 | 15328 | 45832 | 76336, 106840, 137344, 167848, 198352 | 7480 | AEX34826 | 21511 | 52015 | 82519, 113023, 143527, 174031, 204535 |
| 1298 | ABI21192 | 15329 | 45833 | 76337, 106841, 137345, 167849, 198353 | 7481 | AEX34837 | 21512 | 52016 | 82520, 113024, 143528, 174032, 204536 |
| 1299 | ABI21203 | 15330 | 45834 | 76338, 106842, 137346, 167850, 198354 | 7482 | AEX34859 | 21513 | 52017 | 82521, 113025, 143529, 174033, 204537 |
| 1300 | ABI21214 | 15331 | 45835 | 76339, 106843, 137347, 167851, 198355 | 7483 | AEX34870 | 21514 | 52018 | 82522, 113026, 143530, 174034, 204538 |
| 1301 | ABI21247 | 15332 | 45836 | 76340, 106844, 137348, 167852, 198356 | 7484 | AEX34881 | 21515 | 52019 | 82523, 113027, 143531, 174035, 204539 |
| 1302 | ABI21258 | 15333 | 45837 | 76341, 106845, 137349, 167853, 198357 | 7485 | AEX34892 | 21516 | 52020 | 82524, 113028, 143532, 174036, 204540 |
| 1303 | ABI21269 | 15334 | 45838 | 76342, 106846, 137350, 167854, 198358 | 7486 | AEX34903 | 21517 | 52021 | 82525, 113029, 143533, 174037, 204541 |
| 1304 | ABI21280 | 15335 | 45839 | 76343, 106847, 137351, 167855, 198359 | 7487 | AEX34914 | 21518 | 52022 | 82526, 113030, 143534, 174038, 204542 |
| 1305 | ABI21302 | 15336 | 45840 | 76344, 106848, 137352, 167856, 198360 | 7488 | AEX34925 | 21519 | 52023 | 82527, 113031, 143535, 174039, 204543 |
| 1306 | ABI21313 | 15337 | 45841 | 76345, 106849, 137353, 167857, 198361 | 7489 | AEX34936 | 21520 | 52024 | 82528, 113032, 143536, 174040, 204544 |
| 1307 | ABI21324 | 15338 | 45842 | 76346, 106850, 137354, 167858, 198362 | 7490 | AEX34947 | 21521 | 52025 | 82529, 113033, 143537, 174041, 204545 |

FIG. 3 continued

| | | | | | | | | | |
|---|---|---|---|---|---|---|---|---|---|
| 1308 | ABI21335 | 15339 | 45843 | 76347, 106851, 137355, 167859, 198363 | 7491 | AEX34958 | 21522 | 52026 | 82530, 113034, 143538, 174042, 204546 |
| 1309 | ABI21346 | 15340 | 45844 | 76348, 106852, 137356, 167860, 198364 | 7492 | AEX34969 | 21523 | 52027 | 82531, 113035, 143539, 174043, 204547 |
| 1310 | ABI21357 | 15341 | 45845 | 76349, 106853, 137357, 167861, 198365 | 7493 | AEX34980 | 21524 | 52028 | 82532, 113036, 143540, 174044, 204548 |
| 1311 | ABI21368 | 15342 | 45846 | 76350, 106854, 137358, 167862, 198366 | 7494 | AEX34991 | 21525 | 52029 | 82533, 113037, 143541, 174045, 204549 |
| 1312 | ABI21379 | 15343 | 45847 | 76351, 106855, 137359, 167863, 198367 | 7495 | AEX35002 | 21526 | 52030 | 82534, 113038, 143542, 174046, 204550 |
| 1313 | ABI21390 | 15344 | 45848 | 76352, 106856, 137360, 167864, 198368 | 7496 | AEX35013 | 21527 | 52031 | 82535, 113039, 143543, 174047, 204551 |
| 1314 | ABI21401 | 15345 | 45849 | 76353, 106857, 137361, 167865, 198369 | 7497 | AEX35024 | 21528 | 52032 | 82536, 113040, 143544, 174048, 204552 |
| 1315 | ABI21412 | 15346 | 45850 | 76354, 106858, 137362, 167866, 198370 | 7498 | AEX35035 | 21529 | 52033 | 82537, 113041, 143545, 174049, 204553 |
| 1316 | ABI21423 | 15347 | 45851 | 76355, 106859, 137363, 167867, 198371 | 7499 | AEX35046 | 21530 | 52034 | 82538, 113042, 143546, 174050, 204554 |
| 1317 | ABI21434 | 15348 | 45852 | 76356, 106860, 137364, 167868, 198372 | 7500 | AEX35057 | 21531 | 52035 | 82539, 113043, 143547, 174051, 204555 |
| 1318 | ABI21445 | 15349 | 45853 | 76357, 106861, 137365, 167869, 198373 | 7501 | AEX35068 | 21532 | 52036 | 82540, 113044, 143548, 174052, 204556 |
| 1319 | ABI21456 | 15350 | 45854 | 76358, 106862, 137366, 167870, 198374 | 7502 | AEX35079 | 21533 | 52037 | 82541, 113045, 143549, 174053, 204557 |
| 1320 | ABI21467 | 15351 | 45855 | 76359, 106863, 137367, 167871, 198375 | 7503 | AEX35090 | 21534 | 52038 | 82542, 113046, 143550, 174054, 204558 |
| 1321 | ABI21478 | 15352 | 45856 | 76360, 106864, 137368, 167872, 198376 | 7504 | AEX35101 | 21535 | 52039 | 82543, 113047, 143551, 174055, 204559 |
| 1322 | ABI21489 | 15353 | 45857 | 76361, 106865, 137369, 167873, 198377 | 7505 | AEX35112 | 21536 | 52040 | 82544, 113048, 143552, 174056, 204560 |
| 1323 | ABI21500 | 15354 | 45858 | 76362, 106866, 137370, 167874, 198378 | 7506 | AEX35123 | 21537 | 52041 | 82545, 113049, 143553, 174057, 204561 |
| 1324 | ABI21511 | 15355 | 45859 | 76363, 106867, 137371, 167875, 198379 | 7507 | AEX35145 | 21538 | 52042 | 82546, 113050, 143554, 174058, 204562 |
| 1325 | ABI21533 | 15356 | 45860 | 76364, 106868, 137372, 167876, 198380 | 7508 | AEX35156 | 21539 | 52043 | 82547, 113051, 143555, 174059, 204563 |

FIG. 3 continued

| | | | | | | | | | |
|---|---|---|---|---|---|---|---|---|---|
| 1326 | ABI21544 | 15357 | 45861 | 76365, 106869, 137373, 167877, 198381 | 7509 | AEX35167 | 21540 | 52044 | 82548, 113052, 143556, 174060, 204564 |
| 1327 | ABI21555 | 15358 | 45862 | 76366, 106870, 137374, 167878, 198382 | 7510 | AEX35178 | 21541 | 52045 | 82549, 113053, 143557, 174061, 204565 |
| 1328 | ABI21566 | 15359 | 45863 | 76367, 106871, 137375, 167879, 198383 | 7511 | AEX35189 | 21542 | 52046 | 82550, 113054, 143558, 174062, 204566 |
| 1329 | ABI21577 | 15360 | 45864 | 76368, 106872, 137376, 167880, 198384 | 7512 | AEX35200 | 21543 | 52047 | 82551, 113055, 143559, 174063, 204567 |
| 1330 | ABI22112 | 15361 | 45865 | 76369, 106873, 137377, 167881, 198385 | 7513 | AEX35211 | 21544 | 52048 | 82552, 113056, 143560, 174064, 204568 |
| 1331 | ABI22162 | 15362 | 45866 | 76370, 106874, 137378, 167882, 198386 | 7514 | AEX35222 | 21545 | 52049 | 82553, 113057, 143561, 174065, 204569 |
| 1332 | ABI23981 | 15363 | 45867 | 76371, 106875, 137379, 167883, 198387 | 7515 | AEX35233 | 21546 | 52050 | 82554, 113058, 143562, 174066, 204570 |
| 1333 | ABI26649 | 15364 | 45868 | 76372, 106876, 137380, 167884, 198388 | 7516 | AEX35244 | 21547 | 52051 | 82555, 113059, 143563, 174067, 204571 |
| 1334 | ABI30370 | 15365 | 45869 | 76373, 106877, 137381, 167885, 198389 | 7517 | AEX35255 | 21548 | 52052 | 82556, 113060, 143564, 174068, 204572 |
| 1335 | ABI30392 | 15366 | 45870 | 76374, 106878, 137382, 167886, 198390 | 7518 | AEX35266 | 21549 | 52053 | 82557, 113061, 143565, 174069, 204573 |
| 1336 | ABI30403 | 15367 | 45871 | 76375, 106879, 137383, 167887, 198391 | 7519 | AEX35277 | 21550 | 52054 | 82558, 113062, 143566, 174070, 204574 |
| 1337 | ABI30414 | 15368 | 45872 | 76376, 106880, 137384, 167888, 198392 | 7520 | AEX35288 | 21551 | 52055 | 82559, 113063, 143567, 174071, 204575 |
| 1338 | ABI30425 | 15369 | 45873 | 76377, 106881, 137385, 167889, 198393 | 7521 | AEX35299 | 21552 | 52056 | 82560, 113064, 143568, 174072, 204576 |
| 1339 | ABI30436 | 15370 | 45874 | 76378, 106882, 137386, 167890, 198394 | 7522 | AEX35310 | 21553 | 52057 | 82561, 113065, 143569, 174073, 204577 |
| 1340 | ABI30447 | 15371 | 45875 | 76379, 106883, 137387, 167891, 198395 | 7523 | AEX35321 | 21554 | 52058 | 82562, 113066, 143570, 174074, 204578 |
| 1341 | ABI30458 | 15372 | 45876 | 76380, 106884, 137388, 167892, 198396 | 7524 | AEX35332 | 21555 | 52059 | 82563, 113067, 143571, 174075, 204579 |
| 1342 | ABI30469 | 15373 | 45877 | 76381, 106885, 137389, 167893, 198397 | 7525 | AEX35343 | 21556 | 52060 | 82564, 113068, 143572, 174076, 204580 |
| 1343 | ABI30480 | 15374 | 45878 | 76382, 106886, 137390, 167894, 198398 | 7526 | AEX35354 | 21557 | 52061 | 82565, 113069, 143573, 174077, 204581 |

FIG. 3 continued

| | | | | | | | | | |
|---|---|---|---|---|---|---|---|---|---|
| 1344 | ABI30491 | 15375 | 45879 | 76383, 106887, 137391, 167895, 198399 | 7527 | AEX35365 | 21558 | 52062 | 82566, 113070, 143574, 174078, 204582 |
| 1345 | ABI30502 | 15376 | 45880 | 76384, 106888, 137392, 167896, 198400 | 7528 | AEX35376 | 21559 | 52063 | 82567, 113071, 143575, 174079, 204583 |
| 1346 | ABI30513 | 15377 | 45881 | 76385, 106889, 137393, 167897, 198401 | 7529 | AEX35387 | 21560 | 52064 | 82568, 113072, 143576, 174080, 204584 |
| 1347 | ABI30524 | 15378 | 45882 | 76386, 106890, 137394, 167898, 198402 | 7530 | AEX35398 | 21561 | 52065 | 82569, 113073, 143577, 174081, 204585 |
| 1348 | ABI30535 | 15379 | 45883 | 76387, 106891, 137395, 167899, 198403 | 7531 | AEX35409 | 21562 | 52066 | 82570, 113074, 143578, 174082, 204586 |
| 1349 | ABI30546 | 15380 | 45884 | 76388, 106892, 137396, 167900, 198404 | 7532 | AEX35420 | 21563 | 52067 | 82571, 113075, 143579, 174083, 204587 |
| 1350 | ABI30557 | 15381 | 45885 | 76389, 106893, 137397, 167901, 198405 | 7533 | AEX35431 | 21564 | 52068 | 82572, 113076, 143580, 174084, 204588 |
| 1351 | ABI30579 | 15382 | 45886 | 76390, 106894, 137398, 167902, 198406 | 7534 | AEX35453 | 21565 | 52069 | 82573, 113077, 143581, 174085, 204589 |
| 1352 | ABI30590 | 15383 | 45887 | 76391, 106895, 137399, 167903, 198407 | 7535 | AEX35464 | 21566 | 52070 | 82574, 113078, 143582, 174086, 204590 |
| 1353 | ABI30601 | 15384 | 45888 | 76392, 106896, 137400, 167904, 198408 | 7536 | AEX35475 | 21567 | 52071 | 82575, 113079, 143583, 174087, 204591 |
| 1354 | ABI30612 | 15385 | 45889 | 76393, 106897, 137401, 167905, 198409 | 7537 | AEX35486 | 21568 | 52072 | 82576, 113080, 143584, 174088, 204592 |
| 1355 | ABI30623 | 15386 | 45890 | 76394, 106898, 137402, 167906, 198410 | 7538 | AEX35497 | 21569 | 52073 | 82577, 113081, 143585, 174089, 204593 |
| 1356 | ABI30736 | 15387 | 45891 | 76395, 106899, 137403, 167907, 198411 | 7539 | AEX35508 | 21570 | 52074 | 82578, 113082, 143586, 174090, 204594 |
| 1357 | ABI30758 | 15388 | 45892 | 76396, 106900, 137404, 167908, 198412 | 7540 | AEX35519 | 21571 | 52075 | 82579, 113083, 143587, 174091, 204595 |
| 1358 | ABI30769 | 15389 | 45893 | 76397, 106901, 137405, 167909, 198413 | 7541 | AEX35530 | 21572 | 52076 | 82580, 113084, 143588, 174092, 204596 |
| 1359 | ABI30780 | 15390 | 45894 | 76398, 106902, 137406, 167910, 198414 | 7542 | AEX35541 | 21573 | 52077 | 82581, 113085, 143589, 174093, 204597 |
| 1360 | ABI30791 | 15391 | 45895 | 76399, 106903, 137407, 167911, 198415 | 7543 | AEX35552 | 21574 | 52078 | 82582, 113086, 143590, 174094, 204598 |
| 1361 | ABI30802 | 15392 | 45896 | 76400, 106904, 137408, 167912, 198416 | 7544 | AEX35563 | 21575 | 52079 | 82583, 113087, 143591, 174095, 204599 |

FIG. 3 continued

| | | | | | | | | | |
|---|---|---|---|---|---|---|---|---|---|
| 1362 | ABI30813 | 15393 | 45897 | 76401, 106905, 137409, 167913, 198417 | 7545 | AEX35585 | 21576 | 52080 | 82584, 113088, 143592, 174096, 204600 |
| 1363 | ABI30824 | 15394 | 45898 | 76402, 106906, 137410, 167914, 198418 | 7546 | AEX35596 | 21577 | 52081 | 82585, 113089, 143593, 174097, 204601 |
| 1364 | ABI30835 | 15395 | 45899 | 76403, 106907, 137411, 167915, 198419 | 7547 | AEX35607 | 21578 | 52082 | 82586, 113090, 143594, 174098, 204602 |
| 1365 | ABI30846 | 15396 | 45900 | 76404, 106908, 137412, 167916, 198420 | 7548 | AEX35618 | 21579 | 52083 | 82587, 113091, 143595, 174099, 204603 |
| 1366 | ABI30857 | 15397 | 45901 | 76405, 106909, 137413, 167917, 198421 | 7549 | AEX35640 | 21580 | 52084 | 82588, 113092, 143596, 174100, 204604 |
| 1367 | ABI30868 | 15398 | 45902 | 76406, 106910, 137414, 167918, 198422 | 7550 | AEX35651 | 21581 | 52085 | 82589, 113093, 143597, 174101, 204605 |
| 1368 | ABI36157 | 15399 | 45903 | 76407, 106911, 137415, 167919, 198423 | 7551 | AEX36105 | 21582 | 52086 | 82590, 113094, 143598, 174102, 204606 |
| 1369 | ABI36168 | 15400 | 45904 | 76408, 106912, 137416, 167920, 198424 | 7552 | AEX36116 | 21583 | 52087 | 82591, 113095, 143599, 174103, 204607 |
| 1370 | ABI36179 | 15401 | 45905 | 76409, 106913, 137417, 167921, 198425 | 7553 | AEX36127 | 21584 | 52088 | 82592, 113096, 143600, 174104, 204608 |
| 1371 | ABI36189 | 15402 | 45906 | 76410, 106914, 137418, 167922, 198426 | 7554 | AEX36149 | 21585 | 52089 | 82593, 113097, 143601, 174105, 204609 |
| 1372 | ABI36278 | 15403 | 45907 | 76411, 106915, 137419, 167923, 198427 | 7555 | AEX36160 | 21586 | 52090 | 82594, 113098, 143602, 174106, 204610 |
| 1373 | ABI36287 | 15404 | 45908 | 76412, 106916, 137420, 167924, 198428 | 7556 | AEX36171 | 21587 | 52091 | 82595, 113099, 143603, 174107, 204611 |
| 1374 | ABI36298 | 15405 | 45909 | 76413, 106917, 137421, 167925, 198429 | 7557 | AEX36193 | 21588 | 52092 | 82596, 113100, 143604, 174108, 204612 |
| 1375 | ABI36314 | 15406 | 45910 | 76414, 106918, 137422, 167926, 198430 | 7558 | AEX36204 | 21589 | 52093 | 82597, 113101, 143605, 174109, 204613 |
| 1376 | ABI36336 | 15407 | 45911 | 76415, 106919, 137423, 167927, 198431 | 7559 | AEX36215 | 21590 | 52094 | 82598, 113102, 143606, 174110, 204614 |
| 1377 | ABI36358 | 15408 | 45912 | 76416, 106920, 137424, 167928, 198432 | 7560 | AEX36226 | 21591 | 52095 | 82599, 113103, 143607, 174111, 204615 |
| 1378 | ABI36369 | 15409 | 45913 | 76417, 106921, 137425, 167929, 198433 | 7561 | AEX36237 | 21592 | 52096 | 82600, 113104, 143608, 174112, 204616 |
| 1379 | ABI36391 | 15410 | 45914 | 76418, 106922, 137426, 167930, 198434 | 7562 | AEX36248 | 21593 | 52097 | 82601, 113105, 143609, 174113, 204617 |

FIG. 3 continued

| | | | | | | | | | |
|---|---|---|---|---|---|---|---|---|---|
| 1380 | ABI36402 | 15411 | 45915 | 76419, 106923, 137427, 167931, 198435 | 7563 | AEX36259 | 21594 | 52098 | 82602, 113106, 143610, 174114, 204618 |
| 1381 | ABI36413 | 15412 | 45916 | 76420, 106924, 137428, 167932, 198436 | 7564 | AEX36270 | 21595 | 52099 | 82603, 113107, 143611, 174115, 204619 |
| 1382 | ABI36446 | 15413 | 45917 | 76421, 106925, 137429, 167933, 198437 | 7565 | AEX36281 | 21596 | 52100 | 82604, 113108, 143612, 174116, 204620 |
| 1383 | ABI36457 | 15414 | 45918 | 76422, 106926, 137430, 167934, 198438 | 7566 | AEX36292 | 21597 | 52101 | 82605, 113109, 143613, 174117, 204621 |
| 1384 | ABI36476 | 15415 | 45919 | 76423, 106927, 137431, 167935, 198439 | 7567 | AEX36303 | 21598 | 52102 | 82606, 113110, 143614, 174118, 204622 |
| 1385 | ABI49409 | 15416 | 45920 | 76424, 106928, 137432, 167936, 198440 | 7568 | AEX36314 | 21599 | 52103 | 82607, 113111, 143615, 174119, 204623 |
| 1386 | ABI49417 | 15417 | 45921 | 76425, 106929, 137433, 167937, 198441 | 7569 | AEX36336 | 21600 | 52104 | 82608, 113112, 143616, 174120, 204624 |
| 1387 | ABI84962 | 15418 | 45922 | 76426, 106930, 137434, 167938, 198442 | 7570 | AEX36347 | 21601 | 52105 | 82609, 113113, 143617, 174121, 204625 |
| 1388 | ABI85003 | 15419 | 45923 | 76427, 106931, 137435, 167939, 198443 | 7571 | AEX36358 | 21602 | 52106 | 82610, 113114, 143618, 174122, 204626 |
| 1389 | ABI92294 | 15420 | 45924 | 76428, 106932, 137436, 167940, 198444 | 7572 | AEX36369 | 21603 | 52107 | 82611, 113115, 143619, 174123, 204627 |
| 1390 | ABI92305 | 15421 | 45925 | 76429, 106933, 137437, 167941, 198445 | 7573 | AEX36391 | 21604 | 52108 | 82612, 113116, 143620, 174124, 204628 |
| 1391 | ABI92316 | 15422 | 45926 | 76430, 106934, 137438, 167942, 198446 | 7574 | AEX36402 | 21605 | 52109 | 82613, 113117, 143621, 174125, 204629 |
| 1392 | ABI92327 | 15423 | 45927 | 76431, 106935, 137439, 167943, 198447 | 7575 | AEX36413 | 21606 | 52110 | 82614, 113118, 143622, 174126, 204630 |
| 1393 | ABI92338 | 15424 | 45928 | 76432, 106936, 137440, 167944, 198448 | 7576 | AEX36424 | 21607 | 52111 | 82615, 113119, 143623, 174127, 204631 |
| 1394 | ABI92349 | 15425 | 45929 | 76433, 106937, 137441, 167945, 198449 | 7577 | AEX36435 | 21608 | 52112 | 82616, 113120, 143624, 174128, 204632 |
| 1395 | ABI92360 | 15426 | 45930 | 76434, 106938, 137442, 167946, 198450 | 7578 | AEX36446 | 21609 | 52113 | 82617, 113121, 143625, 174129, 204633 |
| 1396 | ABI92371 | 15427 | 45931 | 76435, 106939, 137443, 167947, 198451 | 7579 | AEX36457 | 21610 | 52114 | 82618, 113122, 143626, 174130, 204634 |
| 1397 | ABI92382 | 15428 | 45932 | 76436, 106940, 137444, 167948, 198452 | 7580 | AEX36468 | 21611 | 52115 | 82619, 113123, 143627, 174131, 204635 |

FIG. 3 continued

| | | | | | | | | | |
|---|---|---|---|---|---|---|---|---|---|
| 1398 | ABI92393 | 15429 | 45933 | 76437, 106941, 137445, 167949, 198453 | 7581 | AEX36479 | 21612 | 52116 | 82620, 113124, 143628, 174132, 204636 |
| 1399 | ABI92404 | 15430 | 45934 | 76438, 106942, 137446, 167950, 198454 | 7582 | AEX36490 | 21613 | 52117 | 82621, 113125, 143629, 174133, 204637 |
| 1400 | ABI92415 | 15431 | 45935 | 76439, 106943, 137447, 167951, 198455 | 7583 | AEX36501 | 21614 | 52118 | 82622, 113126, 143630, 174134, 204638 |
| 1401 | ABI92426 | 15432 | 45936 | 76440, 106944, 137448, 167952, 198456 | 7584 | AEX36512 | 21615 | 52119 | 82623, 113127, 143631, 174135, 204639 |
| 1402 | ABI92437 | 15433 | 45937 | 76441, 106945, 137449, 167953, 198457 | 7585 | AEX36523 | 21616 | 52120 | 82624, 113128, 143632, 174136, 204640 |
| 1403 | ABI92448 | 15434 | 45938 | 76442, 106946, 137450, 167954, 198458 | 7586 | AEX36534 | 21617 | 52121 | 82625, 113129, 143633, 174137, 204641 |
| 1404 | ABI92459 | 15435 | 45939 | 76443, 106947, 137451, 167955, 198459 | 7587 | AEX36545 | 21618 | 52122 | 82626, 113130, 143634, 174138, 204642 |
| 1405 | ABI92470 | 15436 | 45940 | 76444, 106948, 137452, 167956, 198460 | 7588 | AEX36556 | 21619 | 52123 | 82627, 113131, 143635, 174139, 204643 |
| 1406 | ABI92481 | 15437 | 45941 | 76445, 106949, 137453, 167957, 198461 | 7589 | AEX36567 | 21620 | 52124 | 82628, 113132, 143636, 174140, 204644 |
| 1407 | ABI92492 | 15438 | 45942 | 76446, 106950, 137454, 167958, 198462 | 7590 | AEX36578 | 21621 | 52125 | 82629, 113133, 143637, 174141, 204645 |
| 1408 | ABI92503 | 15439 | 45943 | 76447, 106951, 137455, 167959, 198463 | 7591 | AEX36589 | 21622 | 52126 | 82630, 113134, 143638, 174142, 204646 |
| 1409 | ABI92514 | 15440 | 45944 | 76448, 106952, 137456, 167960, 198464 | 7592 | AEX36600 | 21623 | 52127 | 82631, 113135, 143639, 174143, 204647 |
| 1410 | ABI92525 | 15441 | 45945 | 76449, 106953, 137457, 167961, 198465 | 7593 | AEX36622 | 21624 | 52128 | 82632, 113136, 143640, 174144, 204648 |
| 1411 | ABI92536 | 15442 | 45946 | 76450, 106954, 137458, 167962, 198466 | 7594 | AEX63619 | 21625 | 52129 | 82633, 113137, 143641, 174145, 204649 |
| 1412 | ABI92547 | 15443 | 45947 | 76451, 106955, 137459, 167963, 198467 | 7595 | AEX92876 | 21626 | 52130 | 82634, 113138, 143642, 174146, 204650 |
| 1413 | ABI92558 | 15444 | 45948 | 76452, 106956, 137460, 167964, 198468 | 7596 | AEX92887 | 21627 | 52131 | 82635, 113139, 143643, 174147, 204651 |
| 1414 | ABI92569 | 15445 | 45949 | 76453, 106957, 137461, 167965, 198469 | 7597 | AEX92904 | 21628 | 52132 | 82636, 113140, 143644, 174148, 204652 |
| 1415 | ABI92580 | 15446 | 45950 | 76454, 106958, 137462, 167966, 198470 | 7598 | AEX96924 | 21629 | 52133 | 82637, 113141, 143645, 174149, 204653 |

FIG. 3 continued

| | | | | | | | | | |
|---|---|---|---|---|---|---|---|---|---|
| 1416 | ABI92591 | 15447 | 45951 | 76455, 106959, 137463, 167967, 198471 | 7599 | AEY69091 | 21630 | 52134 | 82638, 113142, 143646, 174150, 204654 |
| 1417 | ABI92602 | 15448 | 45952 | 76456, 106960, 137464, 167968, 198472 | 7600 | AEY69101 | 21631 | 52135 | 82639, 113143, 143647, 174151, 204655 |
| 1418 | ABI92613 | 15449 | 45953 | 76457, 106961, 137465, 167969, 198473 | 7601 | AEY69112 | 21632 | 52136 | 82640, 113144, 143648, 174152, 204656 |
| 1419 | ABI92624 | 15450 | 45954 | 76458, 106962, 137466, 167970, 198474 | 7602 | AEY69145 | 21633 | 52137 | 82641, 113145, 143649, 174153, 204657 |
| 1420 | ABI92635 | 15451 | 45955 | 76459, 106963, 137467, 167971, 198475 | 7603 | AEY69156 | 21634 | 52138 | 82642, 113146, 143650, 174154, 204658 |
| 1421 | ABI92646 | 15452 | 45956 | 76460, 106964, 137468, 167972, 198476 | 7604 | AEY69167 | 21635 | 52139 | 82643, 113147, 143651, 174155, 204659 |
| 1422 | ABI92657 | 15453 | 45957 | 76461, 106965, 137469, 167973, 198477 | 7605 | AEY69178 | 21636 | 52140 | 82644, 113148, 143652, 174156, 204660 |
| 1423 | ABI92668 | 15454 | 45958 | 76462, 106966, 137470, 167974, 198478 | 7606 | AEY69189 | 21637 | 52141 | 82645, 113149, 143653, 174157, 204661 |
| 1424 | ABI92679 | 15455 | 45959 | 76463, 106967, 137471, 167975, 198479 | 7607 | AEY69211 | 21638 | 52142 | 82646, 113150, 143654, 174158, 204662 |
| 1425 | ABI92701 | 15456 | 45960 | 76464, 106968, 137472, 167976, 198480 | 7608 | AEY69233 | 21639 | 52143 | 82647, 113151, 143655, 174159, 204663 |
| 1426 | ABI92712 | 15457 | 45961 | 76465, 106969, 137473, 167977, 198481 | 7609 | AEY69272 | 21640 | 52144 | 82648, 113152, 143656, 174160, 204664 |
| 1427 | ABI92723 | 15458 | 45962 | 76466, 106970, 137474, 167978, 198482 | 7610 | AEY69283 | 21641 | 52145 | 82649, 113153, 143657, 174161, 204665 |
| 1428 | ABI92734 | 15459 | 45963 | 76467, 106971, 137475, 167979, 198483 | 7611 | AEY69294 | 21642 | 52146 | 82650, 113154, 143658, 174162, 204666 |
| 1429 | ABI92745 | 15460 | 45964 | 76468, 106972, 137476, 167980, 198484 | 7612 | AEY69305 | 21643 | 52147 | 82651, 113155, 143659, 174163, 204667 |
| 1430 | ABI92756 | 15461 | 45965 | 76469, 106973, 137477, 167981, 198485 | 7613 | AEY69316 | 21644 | 52148 | 82652, 113156, 143660, 174164, 204668 |
| 1431 | ABI92767 | 15462 | 45966 | 76470, 106974, 137478, 167982, 198486 | 7614 | AEY69788 | 21645 | 52149 | 82653, 113157, 143661, 174165, 204669 |
| 1432 | ABI92778 | 15463 | 45967 | 76471, 106975, 137479, 167983, 198487 | 7615 | AEY69799 | 21646 | 52150 | 82654, 113158, 143662, 174166, 204670 |
| 1433 | ABI92789 | 15464 | 45968 | 76472, 106976, 137480, 167984, 198488 | 7616 | AEY69810 | 21647 | 52151 | 82655, 113159, 143663, 174167, 204671 |

FIG. 3 continued

| | | | | | | | | | |
|---|---|---|---|---|---|---|---|---|---|
| 1434 | ABI92800 | 15465 | 45969 | 76473, 106977, 137481, 167985, 198489 | 7617 | AEY69832 | 21648 | 52152 | 82656, 113160, 143664, 174168, 204672 |
| 1435 | ABI92811 | 15466 | 45970 | 76474, 106978, 137482, 167986, 198490 | 7618 | AEY69843 | 21649 | 52153 | 82657, 113161, 143665, 174169, 204673 |
| 1436 | ABI92822 | 15467 | 45971 | 76475, 106979, 137483, 167987, 198491 | 7619 | AEY69854 | 21650 | 52154 | 82658, 113162, 143666, 174170, 204674 |
| 1437 | ABI92844 | 15468 | 45972 | 76476, 106980, 137484, 167988, 198492 | 7620 | AEY69876 | 21651 | 52155 | 82659, 113163, 143667, 174171, 204675 |
| 1438 | ABI92855 | 15469 | 45973 | 76477, 106981, 137485, 167989, 198493 | 7621 | AEY69887 | 21652 | 52156 | 82660, 113164, 143668, 174172, 204676 |
| 1439 | ABI92866 | 15470 | 45974 | 76478, 106982, 137486, 167990, 198494 | 7622 | AEY69898 | 21653 | 52157 | 82661, 113165, 143669, 174173, 204677 |
| 1440 | ABI92877 | 15471 | 45975 | 76479, 106983, 137487, 167991, 198495 | 7623 | AEY69909 | 21654 | 52158 | 82662, 113166, 143670, 174174, 204678 |
| 1441 | ABI92888 | 15472 | 45976 | 76480, 106984, 137488, 167992, 198496 | 7624 | AEY69942 | 21655 | 52159 | 82663, 113167, 143671, 174175, 204679 |
| 1442 | ABI92899 | 15473 | 45977 | 76481, 106985, 137489, 167993, 198497 | 7625 | AEY69953 | 21656 | 52160 | 82664, 113168, 143672, 174176, 204680 |
| 1443 | ABI92910 | 15474 | 45978 | 76482, 106986, 137490, 167994, 198498 | 7626 | AEY69964 | 21657 | 52161 | 82665, 113169, 143673, 174177, 204681 |
| 1444 | ABI92921 | 15475 | 45979 | 76483, 106987, 137491, 167995, 198499 | 7627 | AEY69975 | 21658 | 52162 | 82666, 113170, 143674, 174178, 204682 |
| 1445 | ABI92932 | 15476 | 45980 | 76484, 106988, 137492, 167996, 198500 | 7628 | AEY69986 | 21659 | 52163 | 82667, 113171, 143675, 174179, 204683 |
| 1446 | ABI92943 | 15477 | 45981 | 76485, 106989, 137493, 167997, 198501 | 7629 | AEY69997 | 21660 | 52164 | 82668, 113172, 143676, 174180, 204684 |
| 1447 | ABI92954 | 15478 | 45982 | 76486, 106990, 137494, 167998, 198502 | 7630 | AEY70008 | 21661 | 52165 | 82669, 113173, 143677, 174181, 204685 |
| 1448 | ABI92965 | 15479 | 45983 | 76487, 106991, 137495, 167999, 198503 | 7631 | AEY70019 | 21662 | 52166 | 82670, 113174, 143678, 174182, 204686 |
| 1449 | ABI92976 | 15480 | 45984 | 76488, 106992, 137496, 168000, 198504 | 7632 | AEY70259 | 21663 | 52167 | 82671, 113175, 143679, 174183, 204687 |
| 1450 | ABI92987 | 15481 | 45985 | 76489, 106993, 137497, 168001, 198505 | 7633 | AEY70270 | 21664 | 52168 | 82672, 113176, 143680, 174184, 204688 |
| 1451 | ABI92998 | 15482 | 45986 | 76490, 106994, 137498, 168002, 198506 | 7634 | AEY70281 | 21665 | 52169 | 82673, 113177, 143681, 174185, 204689 |

FIG. 3 continued

| | | | | | | | | | |
|---|---|---|---|---|---|---|---|---|---|
| 1452 | ABI93009 | 15483 | 45987 | 76491, 106995, 137499, 168003, 198507 | 7635 | AEY70303 | 21666 | 52170 | 82674, 113178, 143682, 174186, 204690 |
| 1453 | ABI93020 | 15484 | 45988 | 76492, 106996, 137500, 168004, 198508 | 7636 | AEY70314 | 21667 | 52171 | 82675, 113179, 143683, 174187, 204691 |
| 1454 | ABI93031 | 15485 | 45989 | 76493, 106997, 137501, 168005, 198509 | 7637 | AEY70325 | 21668 | 52172 | 82676, 113180, 143684, 174188, 204692 |
| 1455 | ABI93042 | 15486 | 45990 | 76494, 106998, 137502, 168006, 198510 | 7638 | AEY70336 | 21669 | 52173 | 82677, 113181, 143685, 174189, 204693 |
| 1456 | ABI93053 | 15487 | 45991 | 76495, 106999, 137503, 168007, 198511 | 7639 | AEY70358 | 21670 | 52174 | 82678, 113182, 143686, 174190, 204694 |
| 1457 | ABI93064 | 15488 | 45992 | 76496, 107000, 137504, 168008, 198512 | 7640 | AEY70379 | 21671 | 52175 | 82679, 113183, 143687, 174191, 204695 |
| 1458 | ABI93075 | 15489 | 45993 | 76497, 107001, 137505, 168009, 198513 | 7641 | AFB70139 | 21672 | 52176 | 82680, 113184, 143688, 174192, 204696 |
| 1459 | ABI93086 | 15490 | 45994 | 76498, 107002, 137506, 168010, 198514 | 7642 | AFB70141 | 21673 | 52177 | 82681, 113185, 143689, 174193, 204697 |
| 1460 | ABI93097 | 15491 | 45995 | 76499, 107003, 137507, 168011, 198515 | 7643 | AFB70147 | 21674 | 52178 | 82682, 113186, 143690, 174194, 204698 |
| 1461 | ABI93108 | 15492 | 45996 | 76500, 107004, 137508, 168012, 198516 | 7644 | AFB70153 | 21675 | 52179 | 82683, 113187, 143691, 174195, 204699 |
| 1462 | ABI93119 | 15493 | 45997 | 76501, 107005, 137509, 168013, 198517 | 7645 | AFB70155 | 21676 | 52180 | 82684, 113188, 143692, 174196, 204700 |
| 1463 | ABI94584 | 15494 | 45998 | 76502, 107006, 137510, 168014, 198518 | 7646 | AFB70157 | 21677 | 52181 | 82685, 113189, 143693, 174197, 204701 |
| 1464 | ABI95220 | 15495 | 45999 | 76503, 107007, 137511, 168015, 198519 | 7647 | AFB70159 | 21678 | 52182 | 82686, 113190, 143694, 174198, 204702 |
| 1465 | ABI95242 | 15496 | 46000 | 76504, 107008, 137512, 168016, 198520 | 7648 | AFB70161 | 21679 | 52183 | 82687, 113191, 143695, 174199, 204703 |
| 1466 | ABI95253 | 15497 | 46001 | 76505, 107009, 137513, 168017, 198521 | 7649 | AFB70163 | 21680 | 52184 | 82688, 113192, 143696, 174200, 204704 |
| 1467 | ABI95264 | 15498 | 46002 | 76506, 107010, 137514, 168018, 198522 | 7650 | AFB70169 | 21681 | 52185 | 82689, 113193, 143697, 174201, 204705 |
| 1468 | ABI95275 | 15499 | 46003 | 76507, 107011, 137515, 168019, 198523 | 7651 | AFB70199 | 21682 | 52186 | 82690, 113194, 143698, 174202, 204706 |
| 1469 | ABI95286 | 15500 | 46004 | 76508, 107012, 137516, 168020, 198524 | 7652 | AFB70209 | 21683 | 52187 | 82691, 113195, 143699, 174203, 204707 |

FIG. 3 continued

| | | | | | | | | | |
|---|---|---|---|---|---|---|---|---|---|
| 1470 | ABI95297 | 15501 | 46005 | 76509, 107013, 137517, 168021, 198525 | 7653 | AFB70219 | 21684 | 52188 | 82692, 113196, 143700, 174204, 204708 |
| 1471 | ABI95308 | 15502 | 46006 | 76510, 107014, 137518, 168022, 198526 | 7654 | AFB70229 | 21685 | 52189 | 82693, 113197, 143701, 174205, 204709 |
| 1472 | ABI96131 | 15503 | 46007 | 76511, 107015, 137519, 168023, 198527 | 7655 | AFB70239 | 21686 | 52190 | 82694, 113198, 143702, 174206, 204710 |
| 1473 | ABI96133 | 15504 | 46008 | 76512, 107016, 137520, 168024, 198528 | 7656 | AFB70249 | 21687 | 52191 | 82695, 113199, 143703, 174207, 204711 |
| 1474 | ABI96136 | 15505 | 46009 | 76513, 107017, 137521, 168025, 198529 | 7657 | AFB70259 | 21688 | 52192 | 82696, 113200, 143704, 174208, 204712 |
| 1475 | ABJ09110 | 15506 | 46010 | 76514, 107018, 137522, 168026, 198530 | 7658 | AFB70269 | 21689 | 52193 | 82697, 113201, 143705, 174209, 204713 |
| 1476 | ABJ09143 | 15507 | 46011 | 76515, 107019, 137523, 168027, 198531 | 7659 | AFB70279 | 21690 | 52194 | 82698, 113202, 143706, 174210, 204714 |
| 1477 | ABJ09154 | 15508 | 46012 | 76516, 107020, 137524, 168028, 198532 | 7660 | AFB70289 | 21691 | 52195 | 82699, 113203, 143707, 174211, 204715 |
| 1478 | ABJ09165 | 15509 | 46013 | 76517, 107021, 137525, 168029, 198533 | 7661 | AFB70299 | 21692 | 52196 | 82700, 113204, 143708, 174212, 204716 |
| 1479 | ABJ09176 | 15510 | 46014 | 76518, 107022, 137526, 168030, 198534 | 7662 | AFB70309 | 21693 | 52197 | 82701, 113205, 143709, 174213, 204717 |
| 1480 | ABJ09198 | 15511 | 46015 | 76519, 107023, 137527, 168031, 198535 | 7663 | AFB70319 | 21694 | 52198 | 82702, 113206, 143710, 174214, 204718 |
| 1481 | ABJ09209 | 15512 | 46016 | 76520, 107024, 137528, 168032, 198536 | 7664 | AFB70329 | 21695 | 52199 | 82703, 113207, 143711, 174215, 204719 |
| 1482 | ABJ09220 | 15513 | 46017 | 76521, 107025, 137529, 168033, 198537 | 7665 | AFB70349 | 21696 | 52200 | 82704, 113208, 143712, 174216, 204720 |
| 1483 | ABJ09231 | 15514 | 46018 | 76522, 107026, 137530, 168034, 198538 | 7666 | AFB70359 | 21697 | 52201 | 82705, 113209, 143713, 174217, 204721 |
| 1484 | ABJ09242 | 15515 | 46019 | 76523, 107027, 137531, 168035, 198539 | 7667 | AFB70369 | 21698 | 52202 | 82706, 113210, 143714, 174218, 204722 |
| 1485 | ABJ09253 | 15516 | 46020 | 76524, 107028, 137532, 168036, 198540 | 7668 | AFB70379 | 21699 | 52203 | 82707, 113211, 143715, 174219, 204723 |
| 1486 | ABJ09264 | 15517 | 46021 | 76525, 107029, 137533, 168037, 198541 | 7669 | AFB70389 | 21700 | 52204 | 82708, 113212, 143716, 174220, 204724 |
| 1487 | ABJ09286 | 15518 | 46022 | 76526, 107030, 137534, 168038, 198542 | 7670 | AFB70399 | 21701 | 52205 | 82709, 113213, 143717, 174221, 204725 |

FIG. 3 continued

| | | | | | | | | | |
|---|---|---|---|---|---|---|---|---|---|
| 1488 | ABJ09308 | 15519 | 46023 | 76527, 107031, 137535, 168039, 198543 | 7671 | AFB70409 | 21702 | 52206 | 82710, 113214, 143718, 174222, 204726 |
| 1489 | ABJ09319 | 15520 | 46024 | 76528, 107032, 137536, 168040, 198544 | 7672 | AFB77614 | 21703 | 52207 | 82711, 113215, 143719, 174223, 204727 |
| 1490 | ABJ09330 | 15521 | 46025 | 76529, 107033, 137537, 168041, 198545 | 7673 | AFB77615 | 21704 | 52208 | 82712, 113216, 143720, 174224, 204728 |
| 1491 | ABJ09341 | 15522 | 46026 | 76530, 107034, 137538, 168042, 198546 | 7674 | AFB78128 | 21705 | 52209 | 82713, 113217, 143721, 174225, 204729 |
| 1492 | ABJ09352 | 15523 | 46027 | 76531, 107035, 137539, 168043, 198547 | 7675 | AFC62078 | 21706 | 52210 | 82714, 113218, 143722, 174226, 204730 |
| 1493 | ABJ09374 | 15524 | 46028 | 76532, 107036, 137540, 168044, 198548 | 7676 | AFC62079 | 21707 | 52211 | 82715, 113219, 143723, 174227, 204731 |
| 1494 | ABJ09385 | 15525 | 46029 | 76533, 107037, 137541, 168045, 198549 | 7677 | AFC62080 | 21708 | 52212 | 82716, 113220, 143724, 174228, 204732 |
| 1495 | ABJ16590 | 15526 | 46030 | 76534, 107038, 137542, 168046, 198550 | 7678 | AFC62082 | 21709 | 52213 | 82717, 113221, 143725, 174229, 204733 |
| 1496 | ABJ16601 | 15527 | 46031 | 76535, 107039, 137543, 168047, 198551 | 7679 | AFD63529 | 21710 | 52214 | 82718, 113222, 143726, 174230, 204734 |
| 1497 | ABJ16612 | 15528 | 46032 | 76536, 107040, 137544, 168048, 198552 | 7680 | AFD63540 | 21711 | 52215 | 82719, 113223, 143727, 174231, 204735 |
| 1498 | ABJ16623 | 15529 | 46033 | 76537, 107041, 137545, 168049, 198553 | 7681 | AFD63551 | 21712 | 52216 | 82720, 113224, 143728, 174232, 204736 |
| 1499 | ABJ16634 | 15530 | 46034 | 76538, 107042, 137546, 168050, 198554 | 7682 | AFD63562 | 21713 | 52217 | 82721, 113225, 143729, 174233, 204737 |
| 1500 | ABJ16656 | 15531 | 46035 | 76539, 107043, 137547, 168051, 198555 | 7683 | AFD63573 | 21714 | 52218 | 82722, 113226, 143730, 174234, 204738 |
| 1501 | ABJ16667 | 15532 | 46036 | 76540, 107044, 137548, 168052, 198556 | 7684 | AFD63584 | 21715 | 52219 | 82723, 113227, 143731, 174235, 204739 |
| 1502 | ABJ16678 | 15533 | 46037 | 76541, 107045, 137549, 168053, 198557 | 7685 | AFD63595 | 21716 | 52220 | 82724, 113228, 143732, 174236, 204740 |
| 1503 | ABJ16689 | 15534 | 46038 | 76542, 107046, 137550, 168054, 198558 | 7686 | AFD63606 | 21717 | 52221 | 82725, 113229, 143733, 174237, 204741 |
| 1504 | ABJ16700 | 15535 | 46039 | 76543, 107047, 137551, 168055, 198559 | 7687 | AFD63628 | 21718 | 52222 | 82726, 113230, 143734, 174238, 204742 |
| 1505 | ABJ16711 | 15536 | 46040 | 76544, 107048, 137552, 168056, 198560 | 7688 | AFD63639 | 21719 | 52223 | 82727, 113231, 143735, 174239, 204743 |

FIG. 3 continued

| | | | | | | | | | |
|---|---|---|---|---|---|---|---|---|---|
| 1506 | ABJ16733 | 15537 | 46041 | 76545, 107049, 137553, 168057, 198561 | 7689 | AFD63650 | 21720 | 52224 | 82728, 113232, 143736, 174240, 204744 |
| 1507 | ABJ16744 | 15538 | 46042 | 76546, 107050, 137554, 168058, 198562 | 7690 | AFD63661 | 21721 | 52225 | 82729, 113233, 143737, 174241, 204745 |
| 1508 | ABJ16755 | 15539 | 46043 | 76547, 107051, 137555, 168059, 198563 | 7691 | AFD63672 | 21722 | 52226 | 82730, 113234, 143738, 174242, 204746 |
| 1509 | ABJ16766 | 15540 | 46044 | 76548, 107052, 137556, 168060, 198564 | 7692 | AFD63683 | 21723 | 52227 | 82731, 113235, 143739, 174243, 204747 |
| 1510 | ABJ16777 | 15541 | 46045 | 76549, 107053, 137557, 168061, 198565 | 7693 | AFD63694 | 21724 | 52228 | 82732, 113236, 143740, 174244, 204748 |
| 1511 | ABJ16788 | 15542 | 46046 | 76550, 107054, 137558, 168062, 198566 | 7694 | AFD63705 | 21725 | 52229 | 82733, 113237, 143741, 174245, 204749 |
| 1512 | ABJ53441 | 15543 | 46047 | 76551, 107055, 137559, 168063, 198567 | 7695 | AFD63716 | 21726 | 52230 | 82734, 113238, 143742, 174246, 204750 |
| 1513 | ABJ53452 | 15544 | 46048 | 76552, 107056, 137560, 168064, 198568 | 7696 | AFD63727 | 21727 | 52231 | 82735, 113239, 143743, 174247, 204751 |
| 1514 | ABJ53463 | 15545 | 46049 | 76553, 107057, 137561, 168065, 198569 | 7697 | AFD63738 | 21728 | 52232 | 82736, 113240, 143744, 174248, 204752 |
| 1515 | ABJ53474 | 15546 | 46050 | 76554, 107058, 137562, 168066, 198570 | 7698 | AFD63749 | 21729 | 52233 | 82737, 113241, 143745, 174249, 204753 |
| 1516 | ABJ53485 | 15547 | 46051 | 76555, 107059, 137563, 168067, 198571 | 7699 | AFD63760 | 21730 | 52234 | 82738, 113242, 143746, 174250, 204754 |
| 1517 | ABJ53496 | 15548 | 46052 | 76556, 107060, 137564, 168068, 198572 | 7700 | AFD63771 | 21731 | 52235 | 82739, 113243, 143747, 174251, 204755 |
| 1518 | ABJ53507 | 15549 | 46053 | 76557, 107061, 137565, 168069, 198573 | 7701 | AFD63782 | 21732 | 52236 | 82740, 113244, 143748, 174252, 204756 |
| 1519 | ABJ53518 | 15550 | 46054 | 76558, 107062, 137566, 168070, 198574 | 7702 | AFD63793 | 21733 | 52237 | 82741, 113245, 143749, 174253, 204757 |
| 1520 | ABK39965 | 15551 | 46055 | 76559, 107063, 137567, 168071, 198575 | 7703 | AFD63804 | 21734 | 52238 | 82742, 113246, 143750, 174254, 204758 |
| 1521 | ABK39976 | 15552 | 46056 | 76560, 107064, 137568, 168072, 198576 | 7704 | AFD63815 | 21735 | 52239 | 82743, 113247, 143751, 174255, 204759 |
| 1522 | ABK39987 | 15553 | 46057 | 76561, 107065, 137569, 168073, 198577 | 7705 | AFD63826 | 21736 | 52240 | 82744, 113248, 143752, 174256, 204760 |
| 1523 | ABK39998 | 15554 | 46058 | 76562, 107066, 137570, 168074, 198578 | 7706 | AFD63837 | 21737 | 52241 | 82745, 113249, 143753, 174257, 204761 |

FIG. 3 continued

| | | | | | | | | | |
|---|---|---|---|---|---|---|---|---|---|
| 1524 | ABK40020 | 15555 | 46059 | 76563, 107067, 137571, 168075, 198579 | 7707 | AFD63848 | 21738 | 52242 | 82746, 113250, 143754, 174258, 204762 |
| 1525 | ABK40031 | 15556 | 46060 | 76564, 107068, 137572, 168076, 198580 | 7708 | AFD63859 | 21739 | 52243 | 82747, 113251, 143755, 174259, 204763 |
| 1526 | ABK40042 | 15557 | 46061 | 76565, 107069, 137573, 168077, 198581 | 7709 | AFD63870 | 21740 | 52244 | 82748, 113252, 143756, 174260, 204764 |
| 1527 | ABK40053 | 15558 | 46062 | 76566, 107070, 137574, 168078, 198582 | 7710 | AFD63881 | 21741 | 52245 | 82749, 113253, 143757, 174261, 204765 |
| 1528 | ABK40064 | 15559 | 46063 | 76567, 107071, 137575, 168079, 198583 | 7711 | AFD63892 | 21742 | 52246 | 82750, 113254, 143758, 174262, 204766 |
| 1529 | ABK40078 | 15560 | 46064 | 76568, 107072, 137576, 168080, 198584 | 7712 | AFD63903 | 21743 | 52247 | 82751, 113255, 143759, 174263, 204767 |
| 1530 | ABK40513 | 15561 | 46065 | 76569, 107073, 137577, 168081, 198585 | 7713 | AFD63914 | 21744 | 52248 | 82752, 113256, 143760, 174264, 204768 |
| 1531 | ABK40538 | 15562 | 46066 | 76570, 107074, 137578, 168082, 198586 | 7714 | AFD63925 | 21745 | 52249 | 82753, 113257, 143761, 174265, 204769 |
| 1532 | ABK40549 | 15563 | 46067 | 76571, 107075, 137579, 168083, 198587 | 7715 | AFD63936 | 21746 | 52250 | 82754, 113258, 143762, 174266, 204770 |
| 1533 | ABK40560 | 15564 | 46068 | 76572, 107076, 137580, 168084, 198588 | 7716 | AFD63947 | 21747 | 52251 | 82755, 113259, 143763, 174267, 204771 |
| 1534 | ABK40571 | 15565 | 46069 | 76573, 107077, 137581, 168085, 198589 | 7717 | AFD63958 | 21748 | 52252 | 82756, 113260, 143764, 174268, 204772 |
| 1535 | ABK40582 | 15566 | 46070 | 76574, 107078, 137582, 168086, 198590 | 7718 | AFD63969 | 21749 | 52253 | 82757, 113261, 143765, 174269, 204773 |
| 1536 | ABK40593 | 15567 | 46071 | 76575, 107079, 137583, 168087, 198591 | 7719 | AFD63980 | 21750 | 52254 | 82758, 113262, 143766, 174270, 204774 |
| 1537 | ABK40604 | 15568 | 46072 | 76576, 107080, 137584, 168088, 198592 | 7720 | AFD64002 | 21751 | 52255 | 82759, 113263, 143767, 174271, 204775 |
| 1538 | ABK40615 | 15569 | 46073 | 76577, 107081, 137585, 168089, 198593 | 7721 | AFD64013 | 21752 | 52256 | 82760, 113264, 143768, 174272, 204776 |
| 1539 | ABK40626 | 15570 | 46074 | 76578, 107082, 137586, 168090, 198594 | 7722 | AFD64024 | 21753 | 52257 | 82761, 113265, 143769, 174273, 204777 |
| 1540 | ABK40648 | 15571 | 46075 | 76579, 107083, 137587, 168091, 198595 | 7723 | AFD64035 | 21754 | 52258 | 82762, 113266, 143770, 174274, 204778 |
| 1541 | ABK40659 | 15572 | 46076 | 76580, 107084, 137588, 168092, 198596 | 7724 | AFD64046 | 21755 | 52259 | 82763, 113267, 143771, 174275, 204779 |

FIG. 3 continued

| | | | | | | | | | |
|---|---|---|---|---|---|---|---|---|---|
| 1542 | ABK40681 | 15573 | 46077 | 76581, 107085, 137589, 168093, 198597 | 7725 | AFD64057 | 21756 | 52260 | 82764, 113268, 143772, 174276, 204780 |
| 1543 | ABK40692 | 15574 | 46078 | 76582, 107086, 137590, 168094, 198598 | 7726 | AFD64068 | 21757 | 52261 | 82765, 113269, 143773, 174277, 204781 |
| 1544 | ABK40703 | 15575 | 46079 | 76583, 107087, 137591, 168095, 198599 | 7727 | AFD64079 | 21758 | 52262 | 82766, 113270, 143774, 174278, 204782 |
| 1545 | ABK40714 | 15576 | 46080 | 76584, 107088, 137592, 168096, 198600 | 7728 | AFD64090 | 21759 | 52263 | 82767, 113271, 143775, 174279, 204783 |
| 1546 | ABK40725 | 15577 | 46081 | 76585, 107089, 137593, 168097, 198601 | 7729 | AFD64101 | 21760 | 52264 | 82768, 113272, 143776, 174280, 204784 |
| 1547 | ABK40736 | 15578 | 46082 | 76586, 107090, 137594, 168098, 198602 | 7730 | AFD64112 | 21761 | 52265 | 82769, 113273, 143777, 174281, 204785 |
| 1548 | ABK40747 | 15579 | 46083 | 76587, 107091, 137595, 168099, 198603 | 7731 | AFD64123 | 21762 | 52266 | 82770, 113274, 143778, 174282, 204786 |
| 1549 | ABK79951 | 15580 | 46084 | 76588, 107092, 137596, 168100, 198604 | 7732 | AFD64134 | 21763 | 52267 | 82771, 113275, 143779, 174283, 204787 |
| 1550 | ABK79973 | 15581 | 46085 | 76589, 107093, 137597, 168101, 198605 | 7733 | AFD64145 | 21764 | 52268 | 82772, 113276, 143780, 174284, 204788 |
| 1551 | ABK79984 | 15582 | 46086 | 76590, 107094, 137598, 168102, 198606 | 7734 | AFD64156 | 21765 | 52269 | 82773, 113277, 143781, 174285, 204789 |
| 1552 | ABK79995 | 15583 | 46087 | 76591, 107095, 137599, 168103, 198607 | 7735 | AFD64167 | 21766 | 52270 | 82774, 113278, 143782, 174286, 204790 |
| 1553 | ABK80028 | 15584 | 46088 | 76592, 107096, 137600, 168104, 198608 | 7736 | AFD64181 | 21767 | 52271 | 82775, 113279, 143783, 174287, 204791 |
| 1554 | ABK80039 | 15585 | 46089 | 76593, 107097, 137601, 168105, 198609 | 7737 | AFD64192 | 21768 | 52272 | 82776, 113280, 143784, 174288, 204792 |
| 1555 | ABK80050 | 15586 | 46090 | 76594, 107098, 137602, 168106, 198610 | 7738 | AFD64203 | 21769 | 52273 | 82777, 113281, 143785, 174289, 204793 |
| 1556 | ABK80061 | 15587 | 46091 | 76595, 107099, 137603, 168107, 198611 | 7739 | AFD64214 | 21770 | 52274 | 82778, 113282, 143786, 174290, 204794 |
| 1557 | ABK80072 | 15588 | 46092 | 76596, 107100, 137604, 168108, 198612 | 7740 | AFD64225 | 21771 | 52275 | 82779, 113283, 143787, 174291, 204795 |
| 1558 | ABK80083 | 15589 | 46093 | 76597, 107101, 137605, 168109, 198613 | 7741 | AFD64317 | 21772 | 52276 | 82780, 113284, 143788, 174292, 204796 |
| 1559 | ABK80094 | 15590 | 46094 | 76598, 107102, 137606, 168110, 198614 | 7742 | AFD64328 | 21773 | 52277 | 82781, 113285, 143789, 174293, 204797 |

FIG. 3 continued

| | | | | | | | | | |
|---|---|---|---|---|---|---|---|---|---|
| 1560 | ABK80105 | 15591 | 46095 | 76599, 107103, 137607, 168111, 198615 | 7743 | AFD64339 | 21774 | 52278 | 82782, 113286, 143790, 174294, 204798 |
| 1561 | ABK80138 | 15592 | 46096 | 76600, 107104, 137608, 168112, 198616 | 7744 | AFD64350 | 21775 | 52279 | 82783, 113287, 143791, 174295, 204799 |
| 1562 | ABK80149 | 15593 | 46097 | 76601, 107105, 137609, 168113, 198617 | 7745 | AFD64361 | 21776 | 52280 | 82784, 113288, 143792, 174296, 204800 |
| 1563 | ABK80160 | 15594 | 46098 | 76602, 107106, 137610, 168114, 198618 | 7746 | AFD64372 | 21777 | 52281 | 82785, 113289, 143793, 174297, 204801 |
| 1564 | ABK80171 | 15595 | 46099 | 76603, 107107, 137611, 168115, 198619 | 7747 | AFD64383 | 21778 | 52282 | 82786, 113290, 143794, 174298, 204802 |
| 1565 | ABK80182 | 15596 | 46100 | 76604, 107108, 137612, 168116, 198620 | 7748 | AFD64394 | 21779 | 52283 | 82787, 113291, 143795, 174299, 204803 |
| 1566 | ABK80193 | 15597 | 46101 | 76605, 107109, 137613, 168117, 198621 | 7749 | AFD64405 | 21780 | 52284 | 82788, 113292, 143796, 174300, 204804 |
| 1567 | ABK80204 | 15598 | 46102 | 76606, 107110, 137614, 168118, 198622 | 7750 | AFD64416 | 21781 | 52285 | 82789, 113293, 143797, 174301, 204805 |
| 1568 | ABK80215 | 15599 | 46103 | 76607, 107111, 137615, 168119, 198623 | 7751 | AFD64427 | 21782 | 52286 | 82790, 113294, 143798, 174302, 204806 |
| 1569 | ABK80226 | 15600 | 46104 | 76608, 107112, 137616, 168120, 198624 | 7752 | AFD64438 | 21783 | 52287 | 82791, 113295, 143799, 174303, 204807 |
| 1570 | ABK80237 | 15601 | 46105 | 76609, 107113, 137617, 168121, 198625 | 7753 | AFD64449 | 21784 | 52288 | 82792, 113296, 143800, 174304, 204808 |
| 1571 | ABK80259 | 15602 | 46106 | 76610, 107114, 137618, 168122, 198626 | 7754 | AFD64460 | 21785 | 52289 | 82793, 113297, 143801, 174305, 204809 |
| 1572 | ABK80270 | 15603 | 46107 | 76611, 107115, 137619, 168123, 198627 | 7755 | AFD98098 | 21786 | 52290 | 82794, 113298, 143802, 174306, 204810 |
| 1573 | ABK80281 | 15604 | 46108 | 76612, 107116, 137620, 168124, 198628 | 7756 | AFD98120 | 21787 | 52291 | 82795, 113299, 143803, 174307, 204811 |
| 1574 | ABK80292 | 15605 | 46109 | 76613, 107117, 137621, 168125, 198629 | 7757 | AFD98131 | 21788 | 52292 | 82796, 113300, 143804, 174308, 204812 |
| 1575 | ABK80303 | 15606 | 46110 | 76614, 107118, 137622, 168126, 198630 | 7758 | AFD98142 | 21789 | 52293 | 82797, 113301, 143805, 174309, 204813 |
| 1576 | ABK80314 | 15607 | 46111 | 76615, 107119, 137623, 168127, 198631 | 7759 | AFD98164 | 21790 | 52294 | 82798, 113302, 143806, 174310, 204814 |
| 1577 | ABL07021 | 15608 | 46112 | 76616, 107120, 137624, 168128, 198632 | 7760 | AFD98175 | 21791 | 52295 | 82799, 113303, 143807, 174311, 204815 |

FIG. 3 continued

| | | | | | | | | | |
|---|---|---|---|---|---|---|---|---|---|
| 1578 | ABL07032 | 15609 | 46113 | 76617, 107121, 137625, 168129, 198633 | 7761 | AFD98186 | 21792 | 52296 | 82800, 113304, 143808, 174312, 204816 |
| 1579 | ABL31746 | 15610 | 46114 | 76618, 107122, 137626, 168130, 198634 | 7762 | AFD98197 | 21793 | 52297 | 82801, 113305, 143809, 174313, 204817 |
| 1580 | ABL31757 | 15611 | 46115 | 76619, 107123, 137627, 168131, 198635 | 7763 | AFD98208 | 21794 | 52298 | 82802, 113306, 143810, 174314, 204818 |
| 1581 | ABL31768 | 15612 | 46116 | 76620, 107124, 137628, 168132, 198636 | 7764 | AFD98218 | 21795 | 52299 | 82803, 113307, 143811, 174315, 204819 |
| 1582 | ABL67168 | 15613 | 46117 | 76621, 107125, 137629, 168133, 198637 | 7765 | AFD98229 | 21796 | 52300 | 82804, 113308, 143812, 174316, 204820 |
| 1583 | ABL67179 | 15614 | 46118 | 76622, 107126, 137630, 168134, 198638 | 7766 | AFD98240 | 21797 | 52301 | 82805, 113309, 143813, 174317, 204821 |
| 1584 | ABL67190 | 15615 | 46119 | 76623, 107127, 137631, 168135, 198639 | 7767 | AFD98251 | 21798 | 52302 | 82806, 113310, 143814, 174318, 204822 |
| 1585 | ABL67201 | 15616 | 46120 | 76624, 107128, 137632, 168136, 198640 | 7768 | AFD98262 | 21799 | 52303 | 82807, 113311, 143815, 174319, 204823 |
| 1586 | ABL67212 | 15617 | 46121 | 76625, 107129, 137633, 168137, 198641 | 7769 | AFD98273 | 21800 | 52304 | 82808, 113312, 143816, 174320, 204824 |
| 1587 | ABL67256 | 15618 | 46122 | 76626, 107130, 137634, 168138, 198642 | 7770 | AFD98283 | 21801 | 52305 | 82809, 113313, 143817, 174321, 204825 |
| 1588 | ABL67267 | 15619 | 46123 | 76627, 107131, 137635, 168139, 198643 | 7771 | AFD98293 | 21802 | 52306 | 82810, 113314, 143818, 174322, 204826 |
| 1589 | ABL67278 | 15620 | 46124 | 76628, 107132, 137636, 168140, 198644 | 7772 | AFD98313 | 21803 | 52307 | 82811, 113315, 143819, 174323, 204827 |
| 1590 | ABL67289 | 15621 | 46125 | 76629, 107133, 137637, 168141, 198645 | 7773 | AFD98323 | 21804 | 52308 | 82812, 113316, 143820, 174324, 204828 |
| 1591 | ABL67300 | 15622 | 46126 | 76630, 107134, 137638, 168142, 198646 | 7774 | AFD98333 | 21805 | 52309 | 82813, 113317, 143821, 174325, 204829 |
| 1592 | ABL67311 | 15623 | 46127 | 76631, 107135, 137639, 168143, 198647 | 7775 | AFD98343 | 21806 | 52310 | 82814, 113318, 143822, 174326, 204830 |
| 1593 | ABL67322 | 15624 | 46128 | 76632, 107136, 137640, 168144, 198648 | 7776 | AFD98354 | 21807 | 52311 | 82815, 113319, 143823, 174327, 204831 |
| 1594 | ABL67333 | 15625 | 46129 | 76633, 107137, 137641, 168145, 198649 | 7777 | AFD98365 | 21808 | 52312 | 82816, 113320, 143824, 174328, 204832 |
| 1595 | ABL67344 | 15626 | 46130 | 76634, 107138, 137642, 168146, 198650 | 7778 | AFD98376 | 21809 | 52313 | 82817, 113321, 143825, 174329, 204833 |

FIG. 3 continued

| | | | | | | | | | |
|---|---|---|---|---|---|---|---|---|---|
| 1596 | ABL67355 | 15627 | 46131 | 76635, 107139, 137643, 168147, 198651 | 7779 | AFD98387 | 21810 | 52314 | 82818, 113322, 143826, 174330, 204834 |
| 1597 | ABL67366 | 15628 | 46132 | 76636, 107140, 137644, 168148, 198652 | 7780 | AFD98398 | 21811 | 52315 | 82819, 113323, 143827, 174331, 204835 |
| 1598 | ABL67377 | 15629 | 46133 | 76637, 107141, 137645, 168149, 198653 | 7781 | AFD98409 | 21812 | 52316 | 82820, 113324, 143828, 174332, 204836 |
| 1599 | ABL67388 | 15630 | 46134 | 76638, 107142, 137646, 168150, 198654 | 7782 | AFD98420 | 21813 | 52317 | 82821, 113325, 143829, 174333, 204837 |
| 1600 | ABL67399 | 15631 | 46135 | 76639, 107143, 137647, 168151, 198655 | 7783 | AFD98431 | 21814 | 52318 | 82822, 113326, 143830, 174334, 204838 |
| 1601 | ABL67410 | 15632 | 46136 | 76640, 107144, 137648, 168152, 198656 | 7784 | AFD98442 | 21815 | 52319 | 82823, 113327, 143831, 174335, 204839 |
| 1602 | ABL67421 | 15633 | 46137 | 76641, 107145, 137649, 168153, 198657 | 7785 | AFD98452 | 21816 | 52320 | 82824, 113328, 143832, 174336, 204840 |
| 1603 | ABL67772 | 15634 | 46138 | 76642, 107146, 137650, 168154, 198658 | 7786 | AFD98463 | 21817 | 52321 | 82825, 113329, 143833, 174337, 204841 |
| 1604 | ABL67783 | 15635 | 46139 | 76643, 107147, 137651, 168155, 198659 | 7787 | AFD98474 | 21818 | 52322 | 82826, 113330, 143834, 174338, 204842 |
| 1605 | ABL67796 | 15636 | 46140 | 76644, 107148, 137652, 168156, 198660 | 7788 | AFD98484 | 21819 | 52323 | 82827, 113331, 143835, 174339, 204843 |
| 1606 | ABL67807 | 15637 | 46141 | 76645, 107149, 137653, 168157, 198661 | 7789 | AFD98495 | 21820 | 52324 | 82828, 113332, 143836, 174340, 204844 |
| 1607 | ABL67818 | 15638 | 46142 | 76646, 107150, 137654, 168158, 198662 | 7790 | AFD98506 | 21821 | 52325 | 82829, 113333, 143837, 174341, 204845 |
| 1608 | ABL67829 | 15639 | 46143 | 76647, 107151, 137655, 168159, 198663 | 7791 | AFD98517 | 21822 | 52326 | 82830, 113334, 143838, 174342, 204846 |
| 1609 | ABM22018 | 15640 | 46144 | 76648, 107152, 137656, 168160, 198664 | 7792 | AFD98528 | 21823 | 52327 | 82831, 113335, 143839, 174343, 204847 |
| 1610 | ABM22029 | 15641 | 46145 | 76649, 107153, 137657, 168161, 198665 | 7793 | AFD98539 | 21824 | 52328 | 82832, 113336, 143840, 174344, 204848 |
| 1611 | ABM22040 | 15642 | 46146 | 76650, 107154, 137658, 168162, 198666 | 7794 | AFD98550 | 21825 | 52329 | 82833, 113337, 143841, 174345, 204849 |
| 1612 | ABM22062 | 15643 | 46147 | 76651, 107155, 137659, 168163, 198667 | 7795 | AFD98561 | 21826 | 52330 | 82834, 113338, 143842, 174346, 204850 |
| 1613 | ABM22073 | 15644 | 46148 | 76652, 107156, 137660, 168164, 198668 | 7796 | AFD98572 | 21827 | 52331 | 82835, 113339, 143843, 174347, 204851 |

FIG. 3 continued

| | | | | | | | | | |
|---|---|---|---|---|---|---|---|---|---|
| 1614 | ABM22084 | 15645 | 46149 | 76653, 107157, 137661, 168165, 198669 | 7797 | AFD98583 | 21828 | 52332 | 82836, 113340, 143844, 174348, 204852 |
| 1615 | ABM22095 | 15646 | 46150 | 76654, 107158, 137662, 168166, 198670 | 7798 | AFE02944 | 21829 | 52333 | 82837, 113341, 143845, 174349, 204853 |
| 1616 | ABM22106 | 15647 | 46151 | 76655, 107159, 137663, 168167, 198671 | 7799 | AFE47627 | 21830 | 52334 | 82838, 113342, 143846, 174350, 204854 |
| 1617 | ABM22117 | 15648 | 46152 | 76656, 107160, 137664, 168168, 198672 | 7800 | AFF18509 | 21831 | 52335 | 82839, 113343, 143847, 174351, 204855 |
| 1618 | ABM22128 | 15649 | 46153 | 76657, 107161, 137665, 168169, 198673 | 7801 | AFF57129 | 21832 | 52336 | 82840, 113344, 143848, 174352, 204856 |
| 1619 | ABM22139 | 15650 | 46154 | 76658, 107162, 137666, 168170, 198674 | 7802 | AFF57133 | 21833 | 52337 | 82841, 113345, 143849, 174353, 204857 |
| 1620 | ABM22150 | 15651 | 46155 | 76659, 107163, 137667, 168171, 198675 | 7803 | AFF57137 | 21834 | 52338 | 82842, 113346, 143850, 174354, 204858 |
| 1621 | ABM22161 | 15652 | 46156 | 76660, 107164, 137668, 168172, 198676 | 7804 | AFF57141 | 21835 | 52339 | 82843, 113347, 143851, 174355, 204859 |
| 1622 | ABM22172 | 15653 | 46157 | 76661, 107165, 137669, 168173, 198677 | 7805 | AFF57145 | 21836 | 52340 | 82844, 113348, 143852, 174356, 204860 |
| 1623 | ABM22183 | 15654 | 46158 | 76662, 107166, 137670, 168174, 198678 | 7806 | AFF57149 | 21837 | 52341 | 82845, 113349, 143853, 174357, 204861 |
| 1624 | ABM22194 | 15655 | 46159 | 76663, 107167, 137671, 168175, 198679 | 7807 | AFF57153 | 21838 | 52342 | 82846, 113350, 143854, 174358, 204862 |
| 1625 | ABM22205 | 15656 | 46160 | 76664, 107168, 137672, 168176, 198680 | 7808 | AFF57157 | 21839 | 52343 | 82847, 113351, 143855, 174359, 204863 |
| 1626 | ABM22216 | 15657 | 46161 | 76665, 107169, 137673, 168177, 198681 | 7809 | AFF57161 | 21840 | 52344 | 82848, 113352, 143856, 174360, 204864 |
| 1627 | ABM22227 | 15658 | 46162 | 76666, 107170, 137674, 168178, 198682 | 7810 | AFF57165 | 21841 | 52345 | 82849, 113353, 143857, 174361, 204865 |
| 1628 | ABM22238 | 15659 | 46163 | 76667, 107171, 137675, 168179, 198683 | 7811 | AFF57169 | 21842 | 52346 | 82850, 113354, 143858, 174362, 204866 |
| 1629 | ABM22271 | 15660 | 46164 | 76668, 107172, 137676, 168180, 198684 | 7812 | AFF57173 | 21843 | 52347 | 82851, 113355, 143859, 174363, 204867 |
| 1630 | ABM22282 | 15661 | 46165 | 76669, 107173, 137677, 168181, 198685 | 7813 | AFF57177 | 21844 | 52348 | 82852, 113356, 143860, 174364, 204868 |
| 1631 | ABM22304 | 15662 | 46166 | 76670, 107174, 137678, 168182, 198686 | 7814 | AFF57181 | 21845 | 52349 | 82853, 113357, 143861, 174365, 204869 |

FIG. 3 continued

| | | | | | | | | | |
|---|---|---|---|---|---|---|---|---|---|
| 1632 | ABM22315 | 15663 | 46167 | 76671, 107175, 137679, 168183, 198687 | 7815 | AFF57185 | 21846 | 52350 | 82854, 113358, 143862, 174366, 204870 |
| 1633 | ABM22326 | 15664 | 46168 | 76672, 107176, 137680, 168184, 198688 | 7816 | AFF57189 | 21847 | 52351 | 82855, 113359, 143863, 174367, 204871 |
| 1634 | ABM22337 | 15665 | 46169 | 76673, 107177, 137681, 168185, 198689 | 7817 | AFF60789 | 21848 | 52352 | 82856, 113360, 143864, 174368, 204872 |
| 1635 | ABM22348 | 15666 | 46170 | 76674, 107178, 137682, 168186, 198690 | 7818 | AFG29043 | 21849 | 52353 | 82857, 113361, 143865, 174369, 204873 |
| 1636 | ABM22359 | 15667 | 46171 | 76675, 107179, 137683, 168187, 198691 | 7819 | AFG29045 | 21850 | 52354 | 82858, 113362, 143866, 174370, 204874 |
| 1637 | ABM22370 | 15668 | 46172 | 76676, 107180, 137684, 168188, 198692 | 7820 | AFG31063 | 21851 | 52355 | 82859, 113363, 143867, 174371, 204875 |
| 1638 | ABM66867 | 15669 | 46173 | 76677, 107181, 137685, 168189, 198693 | 7821 | AFG31073 | 21852 | 52356 | 82860, 113364, 143868, 174372, 204876 |
| 1639 | ABM66900 | 15670 | 46174 | 76678, 107182, 137686, 168190, 198694 | 7822 | AFG31083 | 21853 | 52357 | 82861, 113365, 143869, 174373, 204877 |
| 1640 | ABM66911 | 15671 | 46175 | 76679, 107183, 137687, 168191, 198695 | 7823 | AFG31093 | 21854 | 52358 | 82862, 113366, 143870, 174374, 204878 |
| 1641 | ABM66922 | 15672 | 46176 | 76680, 107184, 137688, 168192, 198696 | 7824 | AFG31103 | 21855 | 52359 | 82863, 113367, 143871, 174375, 204879 |
| 1642 | ABM66933 | 15673 | 46177 | 76681, 107185, 137689, 168193, 198697 | 7825 | AFG31113 | 21856 | 52360 | 82864, 113368, 143872, 174376, 204880 |
| 1643 | ABM66944 | 15674 | 46178 | 76682, 107186, 137690, 168194, 198698 | 7826 | AFG31123 | 21857 | 52361 | 82865, 113369, 143873, 174377, 204881 |
| 1644 | ABM66955 | 15675 | 46179 | 76683, 107187, 137691, 168195, 198699 | 7827 | AFG31133 | 21858 | 52362 | 82866, 113370, 143874, 174378, 204882 |
| 1645 | ABM66966 | 15676 | 46180 | 76684, 107188, 137692, 168196, 198700 | 7828 | AFG31143 | 21859 | 52363 | 82867, 113371, 143875, 174379, 204883 |
| 1646 | ABM66977 | 15677 | 46181 | 76685, 107189, 137693, 168197, 198701 | 7829 | AFG31153 | 21860 | 52364 | 82868, 113372, 143876, 174380, 204884 |
| 1647 | ABM66988 | 15678 | 46182 | 76686, 107190, 137694, 168198, 198702 | 7830 | AFG31163 | 21861 | 52365 | 82869, 113373, 143877, 174381, 204885 |
| 1648 | ABM66999 | 15679 | 46183 | 76687, 107191, 137695, 168199, 198703 | 7831 | AFG31173 | 21862 | 52366 | 82870, 113374, 143878, 174382, 204886 |
| 1649 | ABM67010 | 15680 | 46184 | 76688, 107192, 137696, 168200, 198704 | 7832 | AFG31183 | 21863 | 52367 | 82871, 113375, 143879, 174383, 204887 |

FIG. 3 continued

| | | | | | | | | | |
|---|---|---|---|---|---|---|---|---|---|
| 1650 | ABM67021 | 15681 | 46185 | 76689, 107193, 137697, 168201, 198705 | 7833 | AFG31193 | 21864 | 52368 | 82872, 113376, 143880, 174384, 204888 |
| 1651 | ABM67054 | 15682 | 46186 | 76690, 107194, 137698, 168202, 198706 | 7834 | AFG31203 | 21865 | 52369 | 82873, 113377, 143881, 174385, 204889 |
| 1652 | ABM68048 | 15683 | 46187 | 76691, 107195, 137699, 168203, 198707 | 7835 | AFG31213 | 21866 | 52370 | 82874, 113378, 143882, 174386, 204890 |
| 1653 | ABM68049 | 15684 | 46188 | 76692, 107196, 137700, 168204, 198708 | 7836 | AFG31223 | 21867 | 52371 | 82875, 113379, 143883, 174387, 204891 |
| 1654 | ABM90436 | 15685 | 46189 | 76693, 107197, 137701, 168205, 198709 | 7837 | AFG31233 | 21868 | 52372 | 82876, 113380, 143884, 174388, 204892 |
| 1655 | ABM90447 | 15686 | 46190 | 76694, 107198, 137702, 168206, 198710 | 7838 | AFG31243 | 21869 | 52373 | 82877, 113381, 143885, 174389, 204893 |
| 1656 | ABM90458 | 15687 | 46191 | 76695, 107199, 137703, 168207, 198711 | 7839 | AFG31253 | 21870 | 52374 | 82878, 113382, 143886, 174390, 204894 |
| 1657 | ABM90469 | 15688 | 46192 | 76696, 107200, 137704, 168208, 198712 | 7840 | AFG31263 | 21871 | 52375 | 82879, 113383, 143887, 174391, 204895 |
| 1658 | ABM90491 | 15689 | 46193 | 76697, 107201, 137705, 168209, 198713 | 7841 | AFG31273 | 21872 | 52376 | 82880, 113384, 143888, 174392, 204896 |
| 1659 | ABM90502 | 15690 | 46194 | 76698, 107202, 137706, 168210, 198714 | 7842 | AFG31283 | 21873 | 52377 | 82881, 113385, 143889, 174393, 204897 |
| 1660 | ABM90524 | 15691 | 46195 | 76699, 107203, 137707, 168211, 198715 | 7843 | AFG31293 | 21874 | 52378 | 82882, 113386, 143890, 174394, 204898 |
| 1661 | ABM90535 | 15692 | 46196 | 76700, 107204, 137708, 168212, 198716 | 7844 | AFG31303 | 21875 | 52379 | 82883, 113387, 143891, 174395, 204899 |
| 1662 | ABM90546 | 15693 | 46197 | 76701, 107205, 137709, 168213, 198717 | 7845 | AFG31313 | 21876 | 52380 | 82884, 113388, 143892, 174396, 204900 |
| 1663 | ABN50759 | 15694 | 46198 | 76702, 107206, 137710, 168214, 198718 | 7846 | AFG31326 | 21877 | 52381 | 82885, 113389, 143893, 174397, 204901 |
| 1664 | ABN50770 | 15695 | 46199 | 76703, 107207, 137711, 168215, 198719 | 7847 | AFG31336 | 21878 | 52382 | 82886, 113390, 143894, 174398, 204902 |
| 1665 | ABN50903 | 15696 | 46200 | 76704, 107208, 137712, 168216, 198720 | 7848 | AFG31346 | 21879 | 52383 | 82887, 113391, 143895, 174399, 204903 |
| 1666 | ABN50920 | 15697 | 46201 | 76705, 107209, 137713, 168217, 198721 | 7849 | AFG31356 | 21880 | 52384 | 82888, 113392, 143896, 174400, 204904 |
| 1667 | ABN50931 | 15698 | 46202 | 76706, 107210, 137714, 168218, 198722 | 7850 | AFG31366 | 21881 | 52385 | 82889, 113393, 143897, 174401, 204905 |

FIG. 3 continued

| | | | | | | | | | |
|---|---|---|---|---|---|---|---|---|---|
| 1668 | ABN50943 | 15699 | 46203 | 76707, 107211, 137715, 168219, 198723 | 7851 | AFG31379 | 21882 | 52386 | 82890, 113394, 143898, 174402, 204906 |
| 1669 | ABN50954 | 15700 | 46204 | 76708, 107212, 137716, 168220, 198724 | 7852 | AFG31389 | 21883 | 52387 | 82891, 113395, 143899, 174403, 204907 |
| 1670 | ABN50965 | 15701 | 46205 | 76709, 107213, 137717, 168221, 198725 | 7853 | AFG31399 | 21884 | 52388 | 82892, 113396, 143900, 174404, 204908 |
| 1671 | ABN50976 | 15702 | 46206 | 76710, 107214, 137718, 168222, 198726 | 7854 | AFG31409 | 21885 | 52389 | 82893, 113397, 143901, 174405, 204909 |
| 1672 | ABN50987 | 15703 | 46207 | 76711, 107215, 137719, 168223, 198727 | 7855 | AFG31419 | 21886 | 52390 | 82894, 113398, 143902, 174406, 204910 |
| 1673 | ABN50998 | 15704 | 46208 | 76712, 107216, 137720, 168224, 198728 | 7856 | AFG31429 | 21887 | 52391 | 82895, 113399, 143903, 174407, 204911 |
| 1674 | ABN51013 | 15705 | 46209 | 76713, 107217, 137721, 168225, 198729 | 7857 | AFG31439 | 21888 | 52392 | 82896, 113400, 143904, 174408, 204912 |
| 1675 | ABN51024 | 15706 | 46210 | 76714, 107218, 137722, 168226, 198730 | 7858 | AFG31449 | 21889 | 52393 | 82897, 113401, 143905, 174409, 204913 |
| 1676 | ABN51035 | 15707 | 46211 | 76715, 107219, 137723, 168227, 198731 | 7859 | AFG31459 | 21890 | 52394 | 82898, 113402, 143906, 174410, 204914 |
| 1677 | ABN51046 | 15708 | 46212 | 76716, 107220, 137724, 168228, 198732 | 7860 | AFG31469 | 21891 | 52395 | 82899, 113403, 143907, 174411, 204915 |
| 1678 | ABN51069 | 15709 | 46213 | 76717, 107221, 137725, 168229, 198733 | 7861 | AFG31479 | 21892 | 52396 | 82900, 113404, 143908, 174412, 204916 |
| 1679 | ABN51080 | 15710 | 46214 | 76718, 107222, 137726, 168230, 198734 | 7862 | AFG31499 | 21893 | 52397 | 82901, 113405, 143909, 174413, 204917 |
| 1680 | ABN51091 | 15711 | 46215 | 76719, 107223, 137727, 168231, 198735 | 7863 | AFG31509 | 21894 | 52398 | 82902, 113406, 143910, 174414, 204918 |
| 1681 | ABN51102 | 15712 | 46216 | 76720, 107224, 137728, 168232, 198736 | 7864 | AFG31519 | 21895 | 52399 | 82903, 113407, 143911, 174415, 204919 |
| 1682 | ABN51113 | 15713 | 46217 | 76721, 107225, 137729, 168233, 198737 | 7865 | AFG31529 | 21896 | 52400 | 82904, 113408, 143912, 174416, 204920 |
| 1683 | ABN51124 | 15714 | 46218 | 76722, 107226, 137730, 168234, 198738 | 7866 | AFG31539 | 21897 | 52401 | 82905, 113409, 143913, 174417, 204921 |
| 1684 | ABN51135 | 15715 | 46219 | 76723, 107227, 137731, 168235, 198739 | 7867 | AFG31549 | 21898 | 52402 | 82906, 113410, 143914, 174418, 204922 |
| 1685 | ABN51146 | 15716 | 46220 | 76724, 107228, 137732, 168236, 198740 | 7868 | AFG31559 | 21899 | 52403 | 82907, 113411, 143915, 174419, 204923 |

FIG. 3 continued

| | | | | | | | | | |
|---|---|---|---|---|---|---|---|---|---|
| 1686 | ABN51157 | 15717 | 46221 | 76725, 107229, 137733, 168237, 198741 | 7869 | AFG31569 | 21900 | 52404 | 82908, 113412, 143916, 174420, 204924 |
| 1687 | ABN59393 | 15718 | 46222 | 76726, 107230, 137734, 168238, 198742 | 7870 | AFG31579 | 21901 | 52405 | 82909, 113413, 143917, 174421, 204925 |
| 1688 | ABN59415 | 15719 | 46223 | 76727, 107231, 137735, 168239, 198743 | 7871 | AFG31589 | 21902 | 52406 | 82910, 113414, 143918, 174422, 204926 |
| 1689 | ABN59426 | 15720 | 46224 | 76728, 107232, 137736, 168240, 198744 | 7872 | AFG31599 | 21903 | 52407 | 82911, 113415, 143919, 174423, 204927 |
| 1690 | ABO32659 | 15721 | 46225 | 76729, 107233, 137737, 168241, 198745 | 7873 | AFG31609 | 21904 | 52408 | 82912, 113416, 143920, 174424, 204928 |
| 1691 | ABO32670 | 15722 | 46226 | 76730, 107234, 137738, 168242, 198746 | 7874 | AFG31619 | 21905 | 52409 | 82913, 113417, 143921, 174425, 204929 |
| 1692 | ABO32681 | 15723 | 46227 | 76731, 107235, 137739, 168243, 198747 | 7875 | AFG31629 | 21906 | 52410 | 82914, 113418, 143922, 174426, 204930 |
| 1693 | ABO32695 | 15724 | 46228 | 76732, 107236, 137740, 168244, 198748 | 7876 | AFG31639 | 21907 | 52411 | 82915, 113419, 143923, 174427, 204931 |
| 1694 | ABO32754 | 15725 | 46229 | 76733, 107237, 137741, 168245, 198749 | 7877 | AFG31649 | 21908 | 52412 | 82916, 113420, 143924, 174428, 204932 |
| 1695 | ABO32765 | 15726 | 46230 | 76734, 107238, 137742, 168246, 198750 | 7878 | AFG31659 | 21909 | 52413 | 82917, 113421, 143925, 174429, 204933 |
| 1696 | ABO32778 | 15727 | 46231 | 76735, 107239, 137743, 168247, 198751 | 7879 | AFG31669 | 21910 | 52414 | 82918, 113422, 143926, 174430, 204934 |
| 1697 | ABO32793 | 15728 | 46232 | 76736, 107240, 137744, 168248, 198752 | 7880 | AFG71868 | 21911 | 52415 | 82919, 113423, 143927, 174431, 204935 |
| 1698 | ABO32806 | 15729 | 46233 | 76737, 107241, 137745, 168249, 198753 | 7881 | AFG71890 | 21912 | 52416 | 82920, 113424, 143928, 174432, 204936 |
| 1699 | ABO32819 | 15730 | 46234 | 76738, 107242, 137746, 168250, 198754 | 7882 | AFG71901 | 21913 | 52417 | 82921, 113425, 143929, 174433, 204937 |
| 1700 | ABO32830 | 15731 | 46235 | 76739, 107243, 137747, 168251, 198755 | 7883 | AFG71912 | 21914 | 52418 | 82922, 113426, 143930, 174434, 204938 |
| 1701 | ABO32841 | 15732 | 46236 | 76740, 107244, 137748, 168252, 198756 | 7884 | AFG71934 | 21915 | 52419 | 82923, 113427, 143931, 174435, 204939 |
| 1702 | ABO32852 | 15733 | 46237 | 76741, 107245, 137749, 168253, 198757 | 7885 | AFG71945 | 21916 | 52420 | 82924, 113428, 143932, 174436, 204940 |
| 1703 | ABO32863 | 15734 | 46238 | 76742, 107246, 137750, 168254, 198758 | 7886 | AFG71967 | 21917 | 52421 | 82925, 113429, 143933, 174437, 204941 |

FIG. 3 continued

| | | | | | | | | | |
|---|---|---|---|---|---|---|---|---|---|
| 1704 | AB032874 | 15735 | 46239 | 76743, 107247, 137751, 168255, 198759 | 7887 | AFG71978 | 21918 | 52422 | 82926, 113430, 143934, 174438, 204942 |
| 1705 | AB032885 | 15736 | 46240 | 76744, 107248, 137752, 168256, 198760 | 7888 | AFG71988 | 21919 | 52423 | 82927, 113431, 143935, 174439, 204943 |
| 1706 | AB032896 | 15737 | 46241 | 76745, 107249, 137753, 168257, 198761 | 7889 | AFG71999 | 21920 | 52424 | 82928, 113432, 143936, 174440, 204944 |
| 1707 | AB032907 | 15738 | 46242 | 76746, 107250, 137754, 168258, 198762 | 7890 | AFG72021 | 21921 | 52425 | 82929, 113433, 143937, 174441, 204945 |
| 1708 | AB032918 | 15739 | 46243 | 76747, 107251, 137755, 168259, 198763 | 7891 | AFG72032 | 21922 | 52426 | 82930, 113434, 143938, 174442, 204946 |
| 1709 | AB032929 | 15740 | 46244 | 76748, 107252, 137756, 168260, 198764 | 7892 | AFG72088 | 21923 | 52427 | 82931, 113435, 143939, 174443, 204947 |
| 1710 | AB032940 | 15741 | 46245 | 76749, 107253, 137757, 168261, 198765 | 7893 | AFG72121 | 21924 | 52428 | 82932, 113436, 143940, 174444, 204948 |
| 1711 | AB032951 | 15742 | 46246 | 76750, 107254, 137758, 168262, 198766 | 7894 | AFG72143 | 21925 | 52429 | 82933, 113437, 143941, 174445, 204949 |
| 1712 | AB032962 | 15743 | 46247 | 76751, 107255, 137759, 168263, 198767 | 7895 | AFG72165 | 21926 | 52430 | 82934, 113438, 143942, 174446, 204950 |
| 1713 | AB032973 | 15744 | 46248 | 76752, 107256, 137760, 168264, 198768 | 7896 | AFG72176 | 21927 | 52431 | 82935, 113439, 143943, 174447, 204951 |
| 1714 | AB032984 | 15745 | 46249 | 76753, 107257, 137761, 168265, 198769 | 7897 | AFG72198 | 21928 | 52432 | 82936, 113440, 143944, 174448, 204952 |
| 1715 | AB032995 | 15746 | 46250 | 76754, 107258, 137762, 168266, 198770 | 7898 | AFG72209 | 21929 | 52433 | 82937, 113441, 143945, 174449, 204953 |
| 1716 | AB033009 | 15747 | 46251 | 76755, 107259, 137763, 168267, 198771 | 7899 | AFG72220 | 21930 | 52434 | 82938, 113442, 143946, 174450, 204954 |
| 1717 | AB033039 | 15748 | 46252 | 76756, 107260, 137764, 168268, 198772 | 7900 | AFG72231 | 21931 | 52435 | 82939, 113443, 143947, 174451, 204955 |
| 1718 | AB033050 | 15749 | 46253 | 76757, 107261, 137765, 168269, 198773 | 7901 | AFG72297 | 21932 | 52436 | 82940, 113444, 143948, 174452, 204956 |
| 1719 | AB033061 | 15750 | 46254 | 76758, 107262, 137766, 168270, 198774 | 7902 | AFG72308 | 21933 | 52437 | 82941, 113445, 143949, 174453, 204957 |
| 1720 | AB033072 | 15751 | 46255 | 76759, 107263, 137767, 168271, 198775 | 7903 | AFG72320 | 21934 | 52438 | 82942, 113446, 143950, 174454, 204958 |
| 1721 | AB037991 | 15752 | 46256 | 76760, 107264, 137768, 168272, 198776 | 7904 | AFG72331 | 21935 | 52439 | 82943, 113447, 143951, 174455, 204959 |

FIG. 3 continued

| | | | | | | | | | |
|---|---|---|---|---|---|---|---|---|---|
| 1722 | AB038013 | 15753 | 46257 | 76761, 107265, 137769, 168273, 198777 | 7905 | AFG72353 | 21936 | 52440 | 82944, 113448, 143952, 174456, 204960 |
| 1723 | AB038024 | 15754 | 46258 | 76762, 107266, 137770, 168274, 198778 | 7906 | AFG72364 | 21937 | 52441 | 82945, 113449, 143953, 174457, 204961 |
| 1724 | AB038035 | 15755 | 46259 | 76763, 107267, 137771, 168275, 198779 | 7907 | AFG72430 | 21938 | 52442 | 82946, 113450, 143954, 174458, 204962 |
| 1725 | AB038046 | 15756 | 46260 | 76764, 107268, 137772, 168276, 198780 | 7908 | AFG72452 | 21939 | 52443 | 82947, 113451, 143955, 174459, 204963 |
| 1726 | AB038068 | 15757 | 46261 | 76765, 107269, 137773, 168277, 198781 | 7909 | AFG72474 | 21940 | 52444 | 82948, 113452, 143956, 174460, 204964 |
| 1727 | AB038079 | 15758 | 46262 | 76766, 107270, 137774, 168278, 198782 | 7910 | AFG72485 | 21941 | 52445 | 82949, 113453, 143957, 174461, 204965 |
| 1728 | AB038090 | 15759 | 46263 | 76767, 107271, 137775, 168279, 198783 | 7911 | AFG72507 | 21942 | 52446 | 82950, 113454, 143958, 174462, 204966 |
| 1729 | AB038101 | 15760 | 46264 | 76768, 107272, 137776, 168280, 198784 | 7912 | AFG72529 | 21943 | 52447 | 82951, 113455, 143959, 174463, 204967 |
| 1730 | AB038233 | 15761 | 46265 | 76769, 107273, 137777, 168281, 198785 | 7913 | AFG72540 | 21944 | 52448 | 82952, 113456, 143960, 174464, 204968 |
| 1731 | AB038244 | 15762 | 46266 | 76770, 107274, 137778, 168282, 198786 | 7914 | AFG72562 | 21945 | 52449 | 82953, 113457, 143961, 174465, 204969 |
| 1732 | AB038255 | 15763 | 46267 | 76771, 107275, 137779, 168283, 198787 | 7915 | AFG72584 | 21946 | 52450 | 82954, 113458, 143962, 174466, 204970 |
| 1733 | AB038277 | 15764 | 46268 | 76772, 107276, 137780, 168284, 198788 | 7916 | AFG72606 | 21947 | 52451 | 82955, 113459, 143963, 174467, 204971 |
| 1734 | AB038288 | 15765 | 46269 | 76773, 107277, 137781, 168285, 198789 | 7917 | AFG72617 | 21948 | 52452 | 82956, 113460, 143964, 174468, 204972 |
| 1735 | AB038299 | 15766 | 46270 | 76774, 107278, 137782, 168286, 198790 | 7918 | AFG72628 | 21949 | 52453 | 82957, 113461, 143965, 174469, 204973 |
| 1736 | AB038310 | 15767 | 46271 | 76775, 107279, 137783, 168287, 198791 | 7919 | AFG72639 | 21950 | 52454 | 82958, 113462, 143966, 174470, 204974 |
| 1737 | AB038332 | 15768 | 46272 | 76776, 107280, 137784, 168288, 198792 | 7920 | AFG72650 | 21951 | 52455 | 82959, 113463, 143967, 174471, 204975 |
| 1738 | AB038343 | 15769 | 46273 | 76777, 107281, 137785, 168289, 198793 | 7921 | AFG72672 | 21952 | 52456 | 82960, 113464, 143968, 174472, 204976 |
| 1739 | AB038354 | 15770 | 46274 | 76778, 107282, 137786, 168290, 198794 | 7922 | AFG72683 | 21953 | 52457 | 82961, 113465, 143969, 174473, 204977 |

FIG. 3 continued

| | | | | | | | | | |
|---|---|---|---|---|---|---|---|---|---|
| 1740 | AB038365 | 15771 | 46275 | 76779, 107283, 137787, 168291, 198795 | 7923 | AFG72705 | 21954 | 52458 | 82962, 113466, 143970, 174474, 204978 |
| 1741 | AB038376 | 15772 | 46276 | 76780, 107284, 137788, 168292, 198796 | 7924 | AFG72716 | 21955 | 52459 | 82963, 113467, 143971, 174475, 204979 |
| 1742 | AB038387 | 15773 | 46277 | 76781, 107285, 137789, 168293, 198797 | 7925 | AFG72738 | 21956 | 52460 | 82964, 113468, 143972, 174476, 204980 |
| 1743 | AB038398 | 15774 | 46278 | 76782, 107286, 137790, 168294, 198798 | 7926 | AFG72749 | 21957 | 52461 | 82965, 113469, 143973, 174477, 204981 |
| 1744 | AB038420 | 15775 | 46279 | 76783, 107287, 137791, 168295, 198799 | 7927 | AFG72760 | 21958 | 52462 | 82966, 113470, 143974, 174478, 204982 |
| 1745 | AB038715 | 15776 | 46280 | 76784, 107288, 137792, 168296, 198800 | 7928 | AFG72771 | 21959 | 52463 | 82967, 113471, 143975, 174479, 204983 |
| 1746 | AB038726 | 15777 | 46281 | 76785, 107289, 137793, 168297, 198801 | 7929 | AFG72782 | 21960 | 52464 | 82968, 113472, 143976, 174480, 204984 |
| 1747 | AB044049 | 15778 | 46282 | 76786, 107290, 137794, 168298, 198802 | 7930 | AFG72793 | 21961 | 52465 | 82969, 113473, 143977, 174481, 204985 |
| 1748 | AB044060 | 15779 | 46283 | 76787, 107291, 137795, 168299, 198803 | 7931 | AFG72804 | 21962 | 52466 | 82970, 113474, 143978, 174482, 204986 |
| 1749 | AB044071 | 15780 | 46284 | 76788, 107292, 137796, 168300, 198804 | 7932 | AFG72826 | 21963 | 52467 | 82971, 113475, 143979, 174483, 204987 |
| 1750 | AB044082 | 15781 | 46285 | 76789, 107293, 137797, 168301, 198805 | 7933 | AFG72837 | 21964 | 52468 | 82972, 113476, 143980, 174484, 204988 |
| 1751 | AB044093 | 15782 | 46286 | 76790, 107294, 137798, 168302, 198806 | 7934 | AFG72848 | 21965 | 52469 | 82973, 113477, 143981, 174485, 204989 |
| 1752 | AB044104 | 15783 | 46287 | 76791, 107295, 137799, 168303, 198807 | 7935 | AFG72859 | 21966 | 52470 | 82974, 113478, 143982, 174486, 204990 |
| 1753 | AB044126 | 15784 | 46288 | 76792, 107296, 137800, 168304, 198808 | 7936 | AFG72870 | 21967 | 52471 | 82975, 113479, 143983, 174487, 204991 |
| 1754 | AB052228 | 15785 | 46289 | 76793, 107297, 137801, 168305, 198809 | 7937 | AFG72892 | 21968 | 52472 | 82976, 113480, 143984, 174488, 204992 |
| 1755 | AB052239 | 15786 | 46290 | 76794, 107298, 137802, 168306, 198810 | 7938 | AFG72903 | 21969 | 52473 | 82977, 113481, 143985, 174489, 204993 |
| 1756 | AB052250 | 15787 | 46291 | 76795, 107299, 137803, 168307, 198811 | 7939 | AFG72936 | 21970 | 52474 | 82978, 113482, 143986, 174490, 204994 |
| 1757 | AB052261 | 15788 | 46292 | 76796, 107300, 137804, 168308, 198812 | 7940 | AFG72958 | 21971 | 52475 | 82979, 113483, 143987, 174491, 204995 |

FIG. 3 continued

| | | | | | | | | | |
|---|---|---|---|---|---|---|---|---|---|
| 1758 | AB052283 | 15789 | 46293 | 76797, 107301, 137805, 168309, 198813 | 7941 | AFG98811 | 21972 | 52476 | 82980, 113484, 143988, 174492, 204996 |
| 1759 | AB052294 | 15790 | 46294 | 76798, 107302, 137806, 168310, 198814 | 7942 | AFG98822 | 21973 | 52477 | 82981, 113485, 143989, 174493, 204997 |
| 1760 | AB052316 | 15791 | 46295 | 76799, 107303, 137807, 168311, 198815 | 7943 | AFG98833 | 21974 | 52478 | 82982, 113486, 143990, 174494, 204998 |
| 1761 | AB052327 | 15792 | 46296 | 76800, 107304, 137808, 168312, 198816 | 7944 | AFG98844 | 21975 | 52479 | 82983, 113487, 143991, 174495, 204999 |
| 1762 | AB052338 | 15793 | 46297 | 76801, 107305, 137809, 168313, 198817 | 7945 | AFG98855 | 21976 | 52480 | 82984, 113488, 143992, 174496, 205000 |
| 1763 | AB052349 | 15794 | 46298 | 76802, 107306, 137810, 168314, 198818 | 7946 | AFG98866 | 21977 | 52481 | 82985, 113489, 143993, 174497, 205001 |
| 1764 | AB052360 | 15795 | 46299 | 76803, 107307, 137811, 168315, 198819 | 7947 | AFG98877 | 21978 | 52482 | 82986, 113490, 143994, 174498, 205002 |
| 1765 | AB052371 | 15796 | 46300 | 76804, 107308, 137812, 168316, 198820 | 7948 | AFG98888 | 21979 | 52483 | 82987, 113491, 143995, 174499, 205003 |
| 1766 | AB052800 | 15797 | 46301 | 76805, 107309, 137813, 168317, 198821 | 7949 | AFG98899 | 21980 | 52484 | 82988, 113492, 143996, 174500, 205004 |
| 1767 | ABP49220 | 15798 | 46302 | 76806, 107310, 137814, 168318, 198822 | 7950 | AFG98910 | 21981 | 52485 | 82989, 113493, 143997, 174501, 205005 |
| 1768 | ABP49319 | 15799 | 46303 | 76807, 107311, 137815, 168319, 198823 | 7951 | AFG98921 | 21982 | 52486 | 82990, 113494, 143998, 174502, 205006 |
| 1769 | ABP49330 | 15800 | 46304 | 76808, 107312, 137816, 168320, 198824 | 7952 | AFG98932 | 21983 | 52487 | 82991, 113495, 143999, 174503, 205007 |
| 1770 | ABP49352 | 15801 | 46305 | 76809, 107313, 137817, 168321, 198825 | 7953 | AFG98943 | 21984 | 52488 | 82992, 113496, 144000, 174504, 205008 |
| 1771 | ABP49363 | 15802 | 46306 | 76810, 107314, 137818, 168322, 198826 | 7954 | AFG98965 | 21985 | 52489 | 82993, 113497, 144001, 174505, 205009 |
| 1772 | ABP49374 | 15803 | 46307 | 76811, 107315, 137819, 168323, 198827 | 7955 | AFG98976 | 21986 | 52490 | 82994, 113498, 144002, 174506, 205010 |
| 1773 | ABP49385 | 15804 | 46308 | 76812, 107316, 137820, 168324, 198828 | 7956 | AFG98987 | 21987 | 52491 | 82995, 113499, 144003, 174507, 205011 |
| 1774 | ABP49396 | 15805 | 46309 | 76813, 107317, 137821, 168325, 198829 | 7957 | AFG98998 | 21988 | 52492 | 82996, 113500, 144004, 174508, 205012 |
| 1775 | ABP49407 | 15806 | 46310 | 76814, 107318, 137822, 168326, 198830 | 7958 | AFG99009 | 21989 | 52493 | 82997, 113501, 144005, 174509, 205013 |

FIG. 3 continued

| | | | | | | | | | |
|---|---|---|---|---|---|---|---|---|---|
| 1776 | ABP49418 | 15807 | 46311 | 76815, 107319, 137823, 168327, 198831 | 7959 | AFG99020 | 21990 | 52494 | 82998, 113502, 144006, 174510, 205014 |
| 1777 | ABP49429 | 15808 | 46312 | 76816, 107320, 137824, 168328, 198832 | 7960 | AFG99031 | 21991 | 52495 | 82999, 113503, 144007, 174511, 205015 |
| 1778 | ABP49440 | 15809 | 46313 | 76817, 107321, 137825, 168329, 198833 | 7961 | AFG99042 | 21992 | 52496 | 83000, 113504, 144008, 174512, 205016 |
| 1779 | ABP49451 | 15810 | 46314 | 76818, 107322, 137826, 168330, 198834 | 7962 | AFG99053 | 21993 | 52497 | 83001, 113505, 144009, 174513, 205017 |
| 1780 | ABP49462 | 15811 | 46315 | 76819, 107323, 137827, 168331, 198835 | 7963 | AFG99064 | 21994 | 52498 | 83002, 113506, 144010, 174514, 205018 |
| 1781 | ABP49473 | 15812 | 46316 | 76820, 107324, 137828, 168332, 198836 | 7964 | AFG99086 | 21995 | 52499 | 83003, 113507, 144011, 174515, 205019 |
| 1782 | ABP49495 | 15813 | 46317 | 76821, 107325, 137829, 168333, 198837 | 7965 | AFG99097 | 21996 | 52500 | 83004, 113508, 144012, 174516, 205020 |
| 1783 | ABP49506 | 15814 | 46318 | 76822, 107326, 137830, 168334, 198838 | 7966 | AFG99119 | 21997 | 52501 | 83005, 113509, 144013, 174517, 205021 |
| 1784 | ABP49517 | 15815 | 46319 | 76823, 107327, 137831, 168335, 198839 | 7967 | AFG99130 | 21998 | 52502 | 83006, 113510, 144014, 174518, 205022 |
| 1785 | ABQ01314 | 15816 | 46320 | 76824, 107328, 137832, 168336, 198840 | 7968 | AFG99141 | 21999 | 52503 | 83007, 113511, 144015, 174519, 205023 |
| 1786 | ABQ01325 | 15817 | 46321 | 76825, 107329, 137833, 168337, 198841 | 7969 | AFG99152 | 22000 | 52504 | 83008, 113512, 144016, 174520, 205024 |
| 1787 | ABQ01336 | 15818 | 46322 | 76826, 107330, 137834, 168338, 198842 | 7970 | AFG99163 | 22001 | 52505 | 83009, 113513, 144017, 174521, 205025 |
| 1788 | ABQ01347 | 15819 | 46323 | 76827, 107331, 137835, 168339, 198843 | 7971 | AFG99174 | 22002 | 52506 | 83010, 113514, 144018, 174522, 205026 |
| 1789 | ABQ01358 | 15820 | 46324 | 76828, 107332, 137836, 168340, 198844 | 7972 | AFG99185 | 22003 | 52507 | 83011, 113515, 144019, 174523, 205027 |
| 1790 | ABQ01369 | 15821 | 46325 | 76829, 107333, 137837, 168341, 198845 | 7973 | AFG99196 | 22004 | 52508 | 83012, 113516, 144020, 174524, 205028 |
| 1791 | ABQ44386 | 15822 | 46326 | 76830, 107334, 137838, 168342, 198846 | 7974 | AFG99207 | 22005 | 52509 | 83013, 113517, 144021, 174525, 205029 |
| 1792 | ABQ44408 | 15823 | 46327 | 76831, 107335, 137839, 168343, 198847 | 7975 | AFG99218 | 22006 | 52510 | 83014, 113518, 144022, 174526, 205030 |
| 1793 | ABQ44419 | 15824 | 46328 | 76832, 107336, 137840, 168344, 198848 | 7976 | AFG99229 | 22007 | 52511 | 83015, 113519, 144023, 174527, 205031 |

FIG. 3 continued

| | | | | | | | | | |
|---|---|---|---|---|---|---|---|---|---|
| 1794 | ABQ44430 | 15825 | 46329 | 76833, 107337, 137841, 168345, 198849 | 7977 | AFG99240 | 22008 | 52512 | 83016, 113520, 144024, 174528, 205032 |
| 1795 | ABQ44441 | 15826 | 46330 | 76834, 107338, 137842, 168346, 198850 | 7978 | AFG99251 | 22009 | 52513 | 83017, 113521, 144025, 174529, 205033 |
| 1796 | ABQ44463 | 15827 | 46331 | 76835, 107339, 137843, 168347, 198851 | 7979 | AFG99273 | 22010 | 52514 | 83018, 113522, 144026, 174530, 205034 |
| 1797 | ABQ44474 | 15828 | 46332 | 76836, 107340, 137844, 168348, 198852 | 7980 | AFG99284 | 22011 | 52515 | 83019, 113523, 144027, 174531, 205035 |
| 1798 | ABR15800 | 15829 | 46333 | 76837, 107341, 137845, 168349, 198853 | 7981 | AFG99295 | 22012 | 52516 | 83020, 113524, 144028, 174532, 205036 |
| 1799 | ABR15811 | 15830 | 46334 | 76838, 107342, 137846, 168350, 198854 | 7982 | AFG99317 | 22013 | 52517 | 83021, 113525, 144029, 174533, 205037 |
| 1800 | ABR15910 | 15831 | 46335 | 76839, 107343, 137847, 168351, 198855 | 7983 | AFG99328 | 22014 | 52518 | 83022, 113526, 144030, 174534, 205038 |
| 1801 | ABR15932 | 15832 | 46336 | 76840, 107344, 137848, 168352, 198856 | 7984 | AFG99350 | 22015 | 52519 | 83023, 113527, 144031, 174535, 205039 |
| 1802 | ABR15943 | 15833 | 46337 | 76841, 107345, 137849, 168353, 198857 | 7985 | AFG99361 | 22016 | 52520 | 83024, 113528, 144032, 174536, 205040 |
| 1803 | ABR15954 | 15834 | 46338 | 76842, 107346, 137850, 168354, 198858 | 7986 | AFG99383 | 22017 | 52521 | 83025, 113529, 144033, 174537, 205041 |
| 1804 | ABR15965 | 15835 | 46339 | 76843, 107347, 137851, 168355, 198859 | 7987 | AFG99394 | 22018 | 52522 | 83026, 113530, 144034, 174538, 205042 |
| 1805 | ABR22243 | 15836 | 46340 | 76844, 107348, 137852, 168356, 198860 | 7988 | AFG99405 | 22019 | 52523 | 83027, 113531, 144035, 174539, 205043 |
| 1806 | ABR28518 | 15837 | 46341 | 76845, 107349, 137853, 168357, 198861 | 7989 | AFG99416 | 22020 | 52524 | 83028, 113532, 144036, 174540, 205044 |
| 1807 | ABR28595 | 15838 | 46342 | 76846, 107350, 137854, 168358, 198862 | 7990 | AFG99427 | 22021 | 52525 | 83029, 113533, 144037, 174541, 205045 |
| 1808 | ABR28771 | 15839 | 46343 | 76847, 107351, 137855, 168359, 198863 | 7991 | AFG99438 | 22022 | 52526 | 83030, 113534, 144038, 174542, 205046 |
| 1809 | ABR28782 | 15840 | 46344 | 76848, 107352, 137856, 168360, 198864 | 7992 | AFG99449 | 22023 | 52527 | 83031, 113535, 144039, 174543, 205047 |
| 1810 | ABR28793 | 15841 | 46345 | 76849, 107353, 137857, 168361, 198865 | 7993 | AFG99471 | 22024 | 52528 | 83032, 113536, 144040, 174544, 205048 |
| 1811 | ABR28804 | 15842 | 46346 | 76850, 107354, 137858, 168362, 198866 | 7994 | AFG99482 | 22025 | 52529 | 83033, 113537, 144041, 174545, 205049 |

FIG. 3 continued

| | | | | | | | | | |
|---|---|---|---|---|---|---|---|---|---|
| 1812 | ABR28815 | 15843 | 46347 | 76851, 107355, 137859, 168363, 198867 | 7995 | AFG99493 | 22026 | 52530 | 83034, 113538, 144042, 174546, 205050 |
| 1813 | ABR28826 | 15844 | 46348 | 76852, 107356, 137860, 168364, 198868 | 7996 | AFG99504 | 22027 | 52531 | 83035, 113539, 144043, 174547, 205051 |
| 1814 | ABR28837 | 15845 | 46349 | 76853, 107357, 137861, 168365, 198869 | 7997 | AFG99515 | 22028 | 52532 | 83036, 113540, 144044, 174548, 205052 |
| 1815 | ABR28848 | 15846 | 46350 | 76854, 107358, 137862, 168366, 198870 | 7998 | AFG99526 | 22029 | 52533 | 83037, 113541, 144045, 174549, 205053 |
| 1816 | ABR28859 | 15847 | 46351 | 76855, 107359, 137863, 168367, 198871 | 7999 | AFG99537 | 22030 | 52534 | 83038, 113542, 144046, 174550, 205054 |
| 1817 | ABR28870 | 15848 | 46352 | 76856, 107360, 137864, 168368, 198872 | 8000 | AFG99548 | 22031 | 52535 | 83039, 113543, 144047, 174551, 205055 |
| 1818 | ABR28881 | 15849 | 46353 | 76857, 107361, 137865, 168369, 198873 | 8001 | AFG99559 | 22032 | 52536 | 83040, 113544, 144048, 174552, 205056 |
| 1819 | ABR28892 | 15850 | 46354 | 76858, 107362, 137866, 168370, 198874 | 8002 | AFG99570 | 22033 | 52537 | 83041, 113545, 144049, 174553, 205057 |
| 1820 | ABR28903 | 15851 | 46355 | 76859, 107363, 137867, 168371, 198875 | 8003 | AFG99581 | 22034 | 52538 | 83042, 113546, 144050, 174554, 205058 |
| 1821 | ABR28925 | 15852 | 46356 | 76860, 107364, 137868, 168372, 198876 | 8004 | AFG99592 | 22035 | 52539 | 83043, 113547, 144051, 174555, 205059 |
| 1822 | ABR88082 | 15853 | 46357 | 76861, 107365, 137869, 168373, 198877 | 8005 | AFG99603 | 22036 | 52540 | 83044, 113548, 144052, 174556, 205060 |
| 1823 | ABS00324 | 15854 | 46358 | 76862, 107366, 137870, 168374, 198878 | 8006 | AFG99614 | 22037 | 52541 | 83045, 113549, 144053, 174557, 205061 |
| 1824 | ABS49902 | 15855 | 46359 | 76863, 107367, 137871, 168375, 198879 | 8007 | AFG99625 | 22038 | 52542 | 83046, 113550, 144054, 174558, 205062 |
| 1825 | ABS49913 | 15856 | 46360 | 76864, 107368, 137872, 168376, 198880 | 8008 | AFG99636 | 22039 | 52543 | 83047, 113551, 144055, 174559, 205063 |
| 1826 | ABS49968 | 15857 | 46361 | 76865, 107369, 137873, 168377, 198881 | 8009 | AFG99658 | 22040 | 52544 | 83048, 113552, 144056, 174560, 205064 |
| 1827 | ABS49979 | 15858 | 46362 | 76866, 107370, 137874, 168378, 198882 | 8010 | AFG99680 | 22041 | 52545 | 83049, 113553, 144057, 174561, 205065 |
| 1828 | ABS49990 | 15859 | 46363 | 76867, 107371, 137875, 168379, 198883 | 8011 | AFG99691 | 22042 | 52546 | 83050, 113554, 144058, 174562, 205066 |
| 1829 | ABS50001 | 15860 | 46364 | 76868, 107372, 137876, 168380, 198884 | 8012 | AFG99704 | 22043 | 52547 | 83051, 113555, 144059, 174563, 205067 |

FIG. 3 continued

| | | | | | | | | | |
|---|---|---|---|---|---|---|---|---|---|
| 1830 | ABS50012 | 15861 | 46365 | 76869, 107373, 137877, 168381, 198885 | 8013 | AFG99715 | 22044 | 52548 | 83052, 113556, 144060, 174564, 205068 |
| 1831 | ABS50023 | 15862 | 46366 | 76870, 107374, 137878, 168382, 198886 | 8014 | AFG99726 | 22045 | 52549 | 83053, 113557, 144061, 174565, 205069 |
| 1832 | ABS50034 | 15863 | 46367 | 76871, 107375, 137879, 168383, 198887 | 8015 | AFG99737 | 22046 | 52550 | 83054, 113558, 144062, 174566, 205070 |
| 1833 | ABS50045 | 15864 | 46368 | 76872, 107376, 137880, 168384, 198888 | 8016 | AFG99748 | 22047 | 52551 | 83055, 113559, 144063, 174567, 205071 |
| 1834 | ABS50056 | 15865 | 46369 | 76873, 107377, 137881, 168385, 198889 | 8017 | AFG99759 | 22048 | 52552 | 83056, 113560, 144064, 174568, 205072 |
| 1835 | ABS50067 | 15866 | 46370 | 76874, 107378, 137882, 168386, 198890 | 8018 | AFG99770 | 22049 | 52553 | 83057, 113561, 144065, 174569, 205073 |
| 1836 | ABS50078 | 15867 | 46371 | 76875, 107379, 137883, 168387, 198891 | 8019 | AFG99781 | 22050 | 52554 | 83058, 113562, 144066, 174570, 205074 |
| 1837 | ABS71644 | 15868 | 46372 | 76876, 107380, 137884, 168388, 198892 | 8020 | AFG99792 | 22051 | 52555 | 83059, 113563, 144067, 174571, 205075 |
| 1838 | ABS71646 | 15869 | 46373 | 76877, 107381, 137885, 168389, 198893 | 8021 | AFG99803 | 22052 | 52556 | 83060, 113564, 144068, 174572, 205076 |
| 1839 | ABS71647 | 15870 | 46374 | 76878, 107382, 137886, 168390, 198894 | 8022 | AFG99825 | 22053 | 52557 | 83061, 113565, 144069, 174573, 205077 |
| 1840 | ABS71648 | 15871 | 46375 | 76879, 107383, 137887, 168391, 198895 | 8023 | AFG99836 | 22054 | 52558 | 83062, 113566, 144070, 174574, 205078 |
| 1841 | ABS71649 | 15872 | 46376 | 76880, 107384, 137888, 168392, 198896 | 8024 | AFG99847 | 22055 | 52559 | 83063, 113567, 144071, 174575, 205079 |
| 1842 | ABS71651 | 15873 | 46377 | 76881, 107385, 137889, 168393, 198897 | 8025 | AFG99858 | 22056 | 52560 | 83064, 113568, 144072, 174576, 205080 |
| 1843 | ABS71652 | 15874 | 46378 | 76882, 107386, 137890, 168394, 198898 | 8026 | AFG99869 | 22057 | 52561 | 83065, 113569, 144073, 174577, 205081 |
| 1844 | ABS71653 | 15875 | 46379 | 76883, 107387, 137891, 168395, 198899 | 8027 | AFG99880 | 22058 | 52562 | 83066, 113570, 144074, 174578, 205082 |
| 1845 | ABS71655 | 15876 | 46380 | 76884, 107388, 137892, 168396, 198900 | 8028 | AFG99891 | 22059 | 52563 | 83067, 113571, 144075, 174579, 205083 |
| 1846 | ABS71657 | 15877 | 46381 | 76885, 107389, 137893, 168397, 198901 | 8029 | AFG99902 | 22060 | 52564 | 83068, 113572, 144076, 174580, 205084 |
| 1847 | ABS71659 | 15878 | 46382 | 76886, 107390, 137894, 168398, 198902 | 8030 | AFG99913 | 22061 | 52565 | 83069, 113573, 144077, 174581, 205085 |

FIG. 3 continued

| | | | | | | | | | |
|---|---|---|---|---|---|---|---|---|---|
| 1848 | ABS71660 | 15879 | 46383 | 76887, 107391, 137895, 168399, 198903 | 8031 | AFG99924 | 22062 | 52566 | 83070, 113574, 144078, 174582, 205086 |
| 1849 | ABS71661 | 15880 | 46384 | 76888, 107392, 137896, 168400, 198904 | 8032 | AFG99935 | 22063 | 52567 | 83071, 113575, 144079, 174583, 205087 |
| 1850 | ABS71662 | 15881 | 46385 | 76889, 107393, 137897, 168401, 198905 | 8033 | AFG99946 | 22064 | 52568 | 83072, 113576, 144080, 174584, 205088 |
| 1851 | ABS71663 | 15882 | 46386 | 76890, 107394, 137898, 168402, 198906 | 8034 | AFG99957 | 22065 | 52569 | 83073, 113577, 144081, 174585, 205089 |
| 1852 | ABU40956 | 15883 | 46387 | 76891, 107395, 137899, 168403, 198907 | 8035 | AFG99968 | 22066 | 52570 | 83074, 113578, 144082, 174586, 205090 |
| 1853 | ABU50651 | 15884 | 46388 | 76892, 107396, 137900, 168404, 198908 | 8036 | AFG99979 | 22067 | 52571 | 83075, 113579, 144083, 174587, 205091 |
| 1854 | ABU80180 | 15885 | 46389 | 76893, 107397, 137901, 168405, 198909 | 8037 | AFG99990 | 22068 | 52572 | 83076, 113580, 144084, 174588, 205092 |
| 1855 | ABU80301 | 15886 | 46390 | 76894, 107398, 137902, 168406, 198910 | 8038 | AFH00002 | 22069 | 52573 | 83077, 113581, 144085, 174589, 205093 |
| 1856 | ABU80312 | 15887 | 46391 | 76895, 107399, 137903, 168407, 198911 | 8039 | AFH00013 | 22070 | 52574 | 83078, 113582, 144086, 174590, 205094 |
| 1857 | ABU80323 | 15888 | 46392 | 76896, 107400, 137904, 168408, 198912 | 8040 | AFH00024 | 22071 | 52575 | 83079, 113583, 144087, 174591, 205095 |
| 1858 | ABU80334 | 15889 | 46393 | 76897, 107401, 137905, 168409, 198913 | 8041 | AFH00035 | 22072 | 52576 | 83080, 113584, 144088, 174592, 205096 |
| 1859 | ABU92762 | 15890 | 46394 | 76898, 107402, 137906, 168410, 198914 | 8042 | AFH00046 | 22073 | 52577 | 83081, 113585, 144089, 174593, 205097 |
| 1860 | ABU92764 | 15891 | 46395 | 76899, 107403, 137907, 168411, 198915 | 8043 | AFH00057 | 22074 | 52578 | 83082, 113586, 144090, 174594, 205098 |
| 1861 | ABU92765 | 15892 | 46396 | 76900, 107404, 137908, 168412, 198916 | 8044 | AFH00068 | 22075 | 52579 | 83083, 113587, 144091, 174595, 205099 |
| 1862 | ABU92766 | 15893 | 46397 | 76901, 107405, 137909, 168413, 198917 | 8045 | AFH00079 | 22076 | 52580 | 83084, 113588, 144092, 174596, 205100 |
| 1863 | ABU92767 | 15894 | 46398 | 76902, 107406, 137910, 168414, 198918 | 8046 | AFH00090 | 22077 | 52581 | 83085, 113589, 144093, 174597, 205101 |
| 1864 | ABU92768 | 15895 | 46399 | 76903, 107407, 137911, 168415, 198919 | 8047 | AFH00101 | 22078 | 52582 | 83086, 113590, 144094, 174598, 205102 |
| 1865 | ABU92769 | 15896 | 46400 | 76904, 107408, 137912, 168416, 198920 | 8048 | AFH00112 | 22079 | 52583 | 83087, 113591, 144095, 174599, 205103 |

FIG. 3 continued

| | | | | | | | | | |
|---|---|---|---|---|---|---|---|---|---|
| 1866 | ABU92770 | 15897 | 46401 | 76905, 107409, 137913, 168417, 198921 | 8049 | AFH00123 | 22080 | 52584 | 83088, 113592, 144096, 174600, 205104 |
| 1867 | ABU92771 | 15898 | 46402 | 76906, 107410, 137914, 168418, 198922 | 8050 | AFH00156 | 22081 | 52585 | 83089, 113593, 144097, 174601, 205105 |
| 1868 | ABU92772 | 15899 | 46403 | 76907, 107411, 137915, 168419, 198923 | 8051 | AFH00167 | 22082 | 52586 | 83090, 113594, 144098, 174602, 205106 |
| 1869 | ABU92773 | 15900 | 46404 | 76908, 107412, 137916, 168420, 198924 | 8052 | AFH00178 | 22083 | 52587 | 83091, 113595, 144099, 174603, 205107 |
| 1870 | ABU92774 | 15901 | 46405 | 76909, 107413, 137917, 168421, 198925 | 8053 | AFH00189 | 22084 | 52588 | 83092, 113596, 144100, 174604, 205108 |
| 1871 | ABU92775 | 15902 | 46406 | 76910, 107414, 137918, 168422, 198926 | 8054 | AFH00200 | 22085 | 52589 | 83093, 113597, 144101, 174605, 205109 |
| 1872 | ABU92777 | 15903 | 46407 | 76911, 107415, 137919, 168423, 198927 | 8055 | AFH00211 | 22086 | 52590 | 83094, 113598, 144102, 174606, 205110 |
| 1873 | ABU92778 | 15904 | 46408 | 76912, 107416, 137920, 168424, 198928 | 8056 | AFH00222 | 22087 | 52591 | 83095, 113599, 144103, 174607, 205111 |
| 1874 | ABU92779 | 15905 | 46409 | 76913, 107417, 137921, 168425, 198929 | 8057 | AFH00233 | 22088 | 52592 | 83096, 113600, 144104, 174608, 205112 |
| 1875 | ABU92780 | 15906 | 46410 | 76914, 107418, 137922, 168426, 198930 | 8058 | AFH00244 | 22089 | 52593 | 83097, 113601, 144105, 174609, 205113 |
| 1876 | ABU92781 | 15907 | 46411 | 76915, 107419, 137923, 168427, 198931 | 8059 | AFH00255 | 22090 | 52594 | 83098, 113602, 144106, 174610, 205114 |
| 1877 | ABU92782 | 15908 | 46412 | 76916, 107420, 137924, 168428, 198932 | 8060 | AFH00266 | 22091 | 52595 | 83099, 113603, 144107, 174611, 205115 |
| 1878 | ABU92783 | 15909 | 46413 | 76917, 107421, 137925, 168429, 198933 | 8061 | AFH00277 | 22092 | 52596 | 83100, 113604, 144108, 174612, 205116 |
| 1879 | ABU92784 | 15910 | 46414 | 76918, 107422, 137926, 168430, 198934 | 8062 | AFH00288 | 22093 | 52597 | 83101, 113605, 144109, 174613, 205117 |
| 1880 | ABU92785 | 15911 | 46415 | 76919, 107423, 137927, 168431, 198935 | 8063 | AFH00299 | 22094 | 52598 | 83102, 113606, 144110, 174614, 205118 |
| 1881 | ABU92786 | 15912 | 46416 | 76920, 107424, 137928, 168432, 198936 | 8064 | AFH00310 | 22095 | 52599 | 83103, 113607, 144111, 174615, 205119 |
| 1882 | ABU92787 | 15913 | 46417 | 76921, 107425, 137929, 168433, 198937 | 8065 | AFH00321 | 22096 | 52600 | 83104, 113608, 144112, 174616, 205120 |
| 1883 | ABU92789 | 15914 | 46418 | 76922, 107426, 137930, 168434, 198938 | 8066 | AFH00332 | 22097 | 52601 | 83105, 113609, 144113, 174617, 205121 |

FIG. 3 continued

| | | | | | | | | | |
|---|---|---|---|---|---|---|---|---|---|
| 1884 | ABU92790 | 15915 | 46419 | 76923, 107427, 137931, 168435, 198939 | 8067 | AFH00343 | 22098 | 52602 | 83106, 113610, 144114, 174618, 205122 |
| 1885 | ABU92791 | 15916 | 46420 | 76924, 107428, 137932, 168436, 198940 | 8068 | AFH00354 | 22099 | 52603 | 83107, 113611, 144115, 174619, 205123 |
| 1886 | ABU92792 | 15917 | 46421 | 76925, 107429, 137933, 168437, 198941 | 8069 | AFH00365 | 22100 | 52604 | 83108, 113612, 144116, 174620, 205124 |
| 1887 | ABU92793 | 15918 | 46422 | 76926, 107430, 137934, 168438, 198942 | 8070 | AFH00376 | 22101 | 52605 | 83109, 113613, 144117, 174621, 205125 |
| 1888 | ABU92794 | 15919 | 46423 | 76927, 107431, 137935, 168439, 198943 | 8071 | AFH00387 | 22102 | 52606 | 83110, 113614, 144118, 174622, 205126 |
| 1889 | ABU92795 | 15920 | 46424 | 76928, 107432, 137936, 168440, 198944 | 8072 | AFH00398 | 22103 | 52607 | 83111, 113615, 144119, 174623, 205127 |
| 1890 | ABU92796 | 15921 | 46425 | 76929, 107433, 137937, 168441, 198945 | 8073 | AFH00409 | 22104 | 52608 | 83112, 113616, 144120, 174624, 205128 |
| 1891 | ABU92797 | 15922 | 46426 | 76930, 107434, 137938, 168442, 198946 | 8074 | AFH00420 | 22105 | 52609 | 83113, 113617, 144121, 174625, 205129 |
| 1892 | ABU92798 | 15923 | 46427 | 76931, 107435, 137939, 168443, 198947 | 8075 | AFH00431 | 22106 | 52610 | 83114, 113618, 144122, 174626, 205130 |
| 1893 | ABU92799 | 15924 | 46428 | 76932, 107436, 137940, 168444, 198948 | 8076 | AFH00442 | 22107 | 52611 | 83115, 113619, 144123, 174627, 205131 |
| 1894 | ABU92800 | 15925 | 46429 | 76933, 107437, 137941, 168445, 198949 | 8077 | AFH00453 | 22108 | 52612 | 83116, 113620, 144124, 174628, 205132 |
| 1895 | ABU92801 | 15926 | 46430 | 76934, 107438, 137942, 168446, 198950 | 8078 | AFH00464 | 22109 | 52613 | 83117, 113621, 144125, 174629, 205133 |
| 1896 | ABU92802 | 15927 | 46431 | 76935, 107439, 137943, 168447, 198951 | 8079 | AFH00475 | 22110 | 52614 | 83118, 113622, 144126, 174630, 205134 |
| 1897 | ABU92804 | 15928 | 46432 | 76936, 107440, 137944, 168448, 198952 | 8080 | AFH00486 | 22111 | 52615 | 83119, 113623, 144127, 174631, 205135 |
| 1898 | ABU92805 | 15929 | 46433 | 76937, 107441, 137945, 168449, 198953 | 8081 | AFH00497 | 22112 | 52616 | 83120, 113624, 144128, 174632, 205136 |
| 1899 | ABU92806 | 15930 | 46434 | 76938, 107442, 137946, 168450, 198954 | 8082 | AFH00508 | 22113 | 52617 | 83121, 113625, 144129, 174633, 205137 |
| 1900 | ABU92808 | 15931 | 46435 | 76939, 107443, 137947, 168451, 198955 | 8083 | AFH00519 | 22114 | 52618 | 83122, 113626, 144130, 174634, 205138 |
| 1901 | ABU92809 | 15932 | 46436 | 76940, 107444, 137948, 168452, 198956 | 8084 | AFH00530 | 22115 | 52619 | 83123, 113627, 144131, 174635, 205139 |

FIG. 3 continued

| | | | | | | | | | |
|---|---|---|---|---|---|---|---|---|---|
| 1902 | ABU92810 | 15933 | 46437 | 76941, 107445, 137949, 168453, 198957 | 8085 | AFH00541 | 22116 | 52620 | 83124, 113628, 144132, 174636, 205140 |
| 1903 | ABU92811 | 15934 | 46438 | 76942, 107446, 137950, 168454, 198958 | 8086 | AFH00552 | 22117 | 52621 | 83125, 113629, 144133, 174637, 205141 |
| 1904 | ABU92814 | 15935 | 46439 | 76943, 107447, 137951, 168455, 198959 | 8087 | AFH00563 | 22118 | 52622 | 83126, 113630, 144134, 174638, 205142 |
| 1905 | ABU92815 | 15936 | 46440 | 76944, 107448, 137952, 168456, 198960 | 8088 | AFH00574 | 22119 | 52623 | 83127, 113631, 144135, 174639, 205143 |
| 1906 | ABU92816 | 15937 | 46441 | 76945, 107449, 137953, 168457, 198961 | 8089 | AFH00585 | 22120 | 52624 | 83128, 113632, 144136, 174640, 205144 |
| 1907 | ABU92817 | 15938 | 46442 | 76946, 107450, 137954, 168458, 198962 | 8090 | AFH00596 | 22121 | 52625 | 83129, 113633, 144137, 174641, 205145 |
| 1908 | ABU92818 | 15939 | 46443 | 76947, 107451, 137955, 168459, 198963 | 8091 | AFH00607 | 22122 | 52626 | 83130, 113634, 144138, 174642, 205146 |
| 1909 | ABU92819 | 15940 | 46444 | 76948, 107452, 137956, 168460, 198964 | 8092 | AFH00618 | 22123 | 52627 | 83131, 113635, 144139, 174643, 205147 |
| 1910 | ABU92821 | 15941 | 46445 | 76949, 107453, 137957, 168461, 198965 | 8093 | AFH00629 | 22124 | 52628 | 83132, 113636, 144140, 174644, 205148 |
| 1911 | ABU92822 | 15942 | 46446 | 76950, 107454, 137958, 168462, 198966 | 8094 | AFH00640 | 22125 | 52629 | 83133, 113637, 144141, 174645, 205149 |
| 1912 | ABU92823 | 15943 | 46447 | 76951, 107455, 137959, 168463, 198967 | 8095 | AFH00651 | 22126 | 52630 | 83134, 113638, 144142, 174646, 205150 |
| 1913 | ABU92824 | 15944 | 46448 | 76952, 107456, 137960, 168464, 198968 | 8096 | AFH00662 | 22127 | 52631 | 83135, 113639, 144143, 174647, 205151 |
| 1914 | ABU92825 | 15945 | 46449 | 76953, 107457, 137961, 168465, 198969 | 8097 | AFH00673 | 22128 | 52632 | 83136, 113640, 144144, 174648, 205152 |
| 1915 | ABU92826 | 15946 | 46450 | 76954, 107458, 137962, 168466, 198970 | 8098 | AFH00684 | 22129 | 52633 | 83137, 113641, 144145, 174649, 205153 |
| 1916 | ABU92827 | 15947 | 46451 | 76955, 107459, 137963, 168467, 198971 | 8099 | AFH00695 | 22130 | 52634 | 83138, 113642, 144146, 174650, 205154 |
| 1917 | ABU92828 | 15948 | 46452 | 76956, 107460, 137964, 168468, 198972 | 8100 | AFH00706 | 22131 | 52635 | 83139, 113643, 144147, 174651, 205155 |
| 1918 | ABU92829 | 15949 | 46453 | 76957, 107461, 137965, 168469, 198973 | 8101 | AFH00728 | 22132 | 52636 | 83140, 113644, 144148, 174652, 205156 |
| 1919 | ABU92830 | 15950 | 46454 | 76958, 107462, 137966, 168470, 198974 | 8102 | AFH00739 | 22133 | 52637 | 83141, 113645, 144149, 174653, 205157 |

FIG. 3 continued

| | | | | | | | | | |
|---|---|---|---|---|---|---|---|---|---|
| 1920 | ABU92831 | 15951 | 46455 | 76959, 107463, 137967, 168471, 198975 | 8103 | AFH00750 | 22134 | 52638 | 83142, 113646, 144150, 174654, 205158 |
| 1921 | ABU92832 | 15952 | 46456 | 76960, 107464, 137968, 168472, 198976 | 8104 | AFH00761 | 22135 | 52639 | 83143, 113647, 144151, 174655, 205159 |
| 1922 | ABU92833 | 15953 | 46457 | 76961, 107465, 137969, 168473, 198977 | 8105 | AFH00783 | 22136 | 52640 | 83144, 113648, 144152, 174656, 205160 |
| 1923 | ABU92834 | 15954 | 46458 | 76962, 107466, 137970, 168474, 198978 | 8106 | AFH00794 | 22137 | 52641 | 83145, 113649, 144153, 174657, 205161 |
| 1924 | ABU92835 | 15955 | 46459 | 76963, 107467, 137971, 168475, 198979 | 8107 | AFH00805 | 22138 | 52642 | 83146, 113650, 144154, 174658, 205162 |
| 1925 | ABU92836 | 15956 | 46460 | 76964, 107468, 137972, 168476, 198980 | 8108 | AFH00816 | 22139 | 52643 | 83147, 113651, 144155, 174659, 205163 |
| 1926 | ABU92837 | 15957 | 46461 | 76965, 107469, 137973, 168477, 198981 | 8109 | AFH00827 | 22140 | 52644 | 83148, 113652, 144156, 174660, 205164 |
| 1927 | ABU92838 | 15958 | 46462 | 76966, 107470, 137974, 168478, 198982 | 8110 | AFH01410 | 22141 | 52645 | 83149, 113653, 144157, 174661, 205165 |
| 1928 | ABU92839 | 15959 | 46463 | 76967, 107471, 137975, 168479, 198983 | 8111 | AFH34942 | 22142 | 52646 | 83150, 113654, 144158, 174662, 205166 |
| 1929 | ABU92840 | 15960 | 46464 | 76968, 107472, 137976, 168480, 198984 | 8112 | AFH34956 | 22143 | 52647 | 83151, 113655, 144159, 174663, 205167 |
| 1930 | ABU92841 | 15961 | 46465 | 76969, 107473, 137977, 168481, 198985 | 8113 | AFH34963 | 22144 | 52648 | 83152, 113656, 144160, 174664, 205168 |
| 1931 | ABU92842 | 15962 | 46466 | 76970, 107474, 137978, 168482, 198986 | 8114 | AFH34970 | 22145 | 52649 | 83153, 113657, 144161, 174665, 205169 |
| 1932 | ABU92843 | 15963 | 46467 | 76971, 107475, 137979, 168483, 198987 | 8115 | AFH34977 | 22146 | 52650 | 83154, 113658, 144162, 174666, 205170 |
| 1933 | ABU92844 | 15964 | 46468 | 76972, 107476, 137980, 168484, 198988 | 8116 | AFH74468 | 22147 | 52651 | 83155, 113659, 144163, 174667, 205171 |
| 1934 | ABU92845 | 15965 | 46469 | 76973, 107477, 137981, 168485, 198989 | 8117 | AFH74469 | 22148 | 52652 | 83156, 113660, 144164, 174668, 205172 |
| 1935 | ABU92846 | 15966 | 46470 | 76974, 107478, 137982, 168486, 198990 | 8118 | AFH74480 | 22149 | 52653 | 83157, 113661, 144165, 174669, 205173 |
| 1936 | ABU92847 | 15967 | 46471 | 76975, 107479, 137983, 168487, 198991 | 8119 | AFH74491 | 22150 | 52654 | 83158, 113662, 144166, 174670, 205174 |
| 1937 | ABU92848 | 15968 | 46472 | 76976, 107480, 137984, 168488, 198992 | 8120 | AFH74502 | 22151 | 52655 | 83159, 113663, 144167, 174671, 205175 |

FIG. 3 continued

| | | | | | | | | | |
|---|---|---|---|---|---|---|---|---|---|
| 1938 | ABU92849 | 15969 | 46473 | 76977, 107481, 137985, 168489, 198993 | 8121 | AFH74513 | 22152 | 52656 | 83160, 113664, 144168, 174672, 205176 |
| 1939 | ABU92850 | 15970 | 46474 | 76978, 107482, 137986, 168490, 198994 | 8122 | AFH74524 | 22153 | 52657 | 83161, 113665, 144169, 174673, 205177 |
| 1940 | ABU92851 | 15971 | 46475 | 76979, 107483, 137987, 168491, 198995 | 8123 | AFH74535 | 22154 | 52658 | 83162, 113666, 144170, 174674, 205178 |
| 1941 | ABU92852 | 15972 | 46476 | 76980, 107484, 137988, 168492, 198996 | 8124 | AFH74546 | 22155 | 52659 | 83163, 113667, 144171, 174675, 205179 |
| 1942 | ABU92853 | 15973 | 46477 | 76981, 107485, 137989, 168493, 198997 | 8125 | AFH74557 | 22156 | 52660 | 83164, 113668, 144172, 174676, 205180 |
| 1943 | ABU92854 | 15974 | 46478 | 76982, 107486, 137990, 168494, 198998 | 8126 | AFH74568 | 22157 | 52661 | 83165, 113669, 144173, 174677, 205181 |
| 1944 | ABU92855 | 15975 | 46479 | 76983, 107487, 137991, 168495, 198999 | 8127 | AFH74579 | 22158 | 52662 | 83166, 113670, 144174, 174678, 205182 |
| 1945 | ABU92856 | 15976 | 46480 | 76984, 107488, 137992, 168496, 199000 | 8128 | AFH74590 | 22159 | 52663 | 83167, 113671, 144175, 174679, 205183 |
| 1946 | ABU92857 | 15977 | 46481 | 76985, 107489, 137993, 168497, 199001 | 8129 | AFH74601 | 22160 | 52664 | 83168, 113672, 144176, 174680, 205184 |
| 1947 | ABU92858 | 15978 | 46482 | 76986, 107490, 137994, 168498, 199002 | 8130 | AFH74612 | 22161 | 52665 | 83169, 113673, 144177, 174681, 205185 |
| 1948 | ABU92859 | 15979 | 46483 | 76987, 107491, 137995, 168499, 199003 | 8131 | AFH74623 | 22162 | 52666 | 83170, 113674, 144178, 174682, 205186 |
| 1949 | ABU92860 | 15980 | 46484 | 76988, 107492, 137996, 168500, 199004 | 8132 | AFH74634 | 22163 | 52667 | 83171, 113675, 144179, 174683, 205187 |
| 1950 | ABU92861 | 15981 | 46485 | 76989, 107493, 137997, 168501, 199005 | 8133 | AFH74645 | 22164 | 52668 | 83172, 113676, 144180, 174684, 205188 |
| 1951 | ABU92862 | 15982 | 46486 | 76990, 107494, 137998, 168502, 199006 | 8134 | AFH74656 | 22165 | 52669 | 83173, 113677, 144181, 174685, 205189 |
| 1952 | ABU92863 | 15983 | 46487 | 76991, 107495, 137999, 168503, 199007 | 8135 | AFH74667 | 22166 | 52670 | 83174, 113678, 144182, 174686, 205190 |
| 1953 | ABU92865 | 15984 | 46488 | 76992, 107496, 138000, 168504, 199008 | 8136 | AFH74678 | 22167 | 52671 | 83175, 113679, 144183, 174687, 205191 |
| 1954 | ABU92866 | 15985 | 46489 | 76993, 107497, 138001, 168505, 199009 | 8137 | AFH74689 | 22168 | 52672 | 83176, 113680, 144184, 174688, 205192 |
| 1955 | ABU92867 | 15986 | 46490 | 76994, 107498, 138002, 168506, 199010 | 8138 | AFH74700 | 22169 | 52673 | 83177, 113681, 144185, 174689, 205193 |

FIG. 3 continued

| | | | | | | | | | |
|---|---|---|---|---|---|---|---|---|---|
| 1956 | ABU92868 | 15987 | 46491 | 76995, 107499, 138003, 168507, 199011 | 8139 | AFH74711 | 22170 | 52674 | 83178, 113682, 144186, 174690, 205194 |
| 1957 | ABU92869 | 15988 | 46492 | 76996, 107500, 138004, 168508, 199012 | 8140 | AFH74722 | 22171 | 52675 | 83179, 113683, 144187, 174691, 205195 |
| 1958 | ABU92870 | 15989 | 46493 | 76997, 107501, 138005, 168509, 199013 | 8141 | AFH74733 | 22172 | 52676 | 83180, 113684, 144188, 174692, 205196 |
| 1959 | ABU92872 | 15990 | 46494 | 76998, 107502, 138006, 168510, 199014 | 8142 | AFH74744 | 22173 | 52677 | 83181, 113685, 144189, 174693, 205197 |
| 1960 | ABU92873 | 15991 | 46495 | 76999, 107503, 138007, 168511, 199015 | 8143 | AFH74755 | 22174 | 52678 | 83182, 113686, 144190, 174694, 205198 |
| 1961 | ABU92874 | 15992 | 46496 | 77000, 107504, 138008, 168512, 199016 | 8144 | AFH74766 | 22175 | 52679 | 83183, 113687, 144191, 174695, 205199 |
| 1962 | ABU92875 | 15993 | 46497 | 77001, 107505, 138009, 168513, 199017 | 8145 | AFH74777 | 22176 | 52680 | 83184, 113688, 144192, 174696, 205200 |
| 1963 | ABU92876 | 15994 | 46498 | 77002, 107506, 138010, 168514, 199018 | 8146 | AFH74788 | 22177 | 52681 | 83185, 113689, 144193, 174697, 205201 |
| 1964 | ABU92877 | 15995 | 46499 | 77003, 107507, 138011, 168515, 199019 | 8147 | AFH74799 | 22178 | 52682 | 83186, 113690, 144194, 174698, 205202 |
| 1965 | ABU92878 | 15996 | 46500 | 77004, 107508, 138012, 168516, 199020 | 8148 | AFH74810 | 22179 | 52683 | 83187, 113691, 144195, 174699, 205203 |
| 1966 | ABU92879 | 15997 | 46501 | 77005, 107509, 138013, 168517, 199021 | 8149 | AFH74821 | 22180 | 52684 | 83188, 113692, 144196, 174700, 205204 |
| 1967 | ABU92880 | 15998 | 46502 | 77006, 107510, 138014, 168518, 199022 | 8150 | AFH74832 | 22181 | 52685 | 83189, 113693, 144197, 174701, 205205 |
| 1968 | ABU92881 | 15999 | 46503 | 77007, 107511, 138015, 168519, 199023 | 8151 | AFH74843 | 22182 | 52686 | 83190, 113694, 144198, 174702, 205206 |
| 1969 | ABU92882 | 16000 | 46504 | 77008, 107512, 138016, 168520, 199024 | 8152 | AFH74854 | 22183 | 52687 | 83191, 113695, 144199, 174703, 205207 |
| 1970 | ABU92883 | 16001 | 46505 | 77009, 107513, 138017, 168521, 199025 | 8153 | AFH74865 | 22184 | 52688 | 83192, 113696, 144200, 174704, 205208 |
| 1971 | ABU92884 | 16002 | 46506 | 77010, 107514, 138018, 168522, 199026 | 8154 | AFH74876 | 22185 | 52689 | 83193, 113697, 144201, 174705, 205209 |
| 1972 | ABU92885 | 16003 | 46507 | 77011, 107515, 138019, 168523, 199027 | 8155 | AFH74887 | 22186 | 52690 | 83194, 113698, 144202, 174706, 205210 |
| 1973 | ABU92886 | 16004 | 46508 | 77012, 107516, 138020, 168524, 199028 | 8156 | AFH74898 | 22187 | 52691 | 83195, 113699, 144203, 174707, 205211 |

FIG. 3 continued

| | | | | | | | | | |
|---|---|---|---|---|---|---|---|---|---|
| 1974 | ABU92887 | 16005 | 46509 | 77013, 107517, 138021, 168525, 199029 | 8157 | AFH74909 | 22188 | 52692 | 83196, 113700, 144204, 174708, 205212 |
| 1975 | ABU92888 | 16006 | 46510 | 77014, 107518, 138022, 168526, 199030 | 8158 | AFH74920 | 22189 | 52693 | 83197, 113701, 144205, 174709, 205213 |
| 1976 | ABU92889 | 16007 | 46511 | 77015, 107519, 138023, 168527, 199031 | 8159 | AFH74931 | 22190 | 52694 | 83198, 113702, 144206, 174710, 205214 |
| 1977 | ABU92890 | 16008 | 46512 | 77016, 107520, 138024, 168528, 199032 | 8160 | AFH74942 | 22191 | 52695 | 83199, 113703, 144207, 174711, 205215 |
| 1978 | ABU92891 | 16009 | 46513 | 77017, 107521, 138025, 168529, 199033 | 8161 | AFH74953 | 22192 | 52696 | 83200, 113704, 144208, 174712, 205216 |
| 1979 | ABU92892 | 16010 | 46514 | 77018, 107522, 138026, 168530, 199034 | 8162 | AFH74964 | 22193 | 52697 | 83201, 113705, 144209, 174713, 205217 |
| 1980 | ABU92893 | 16011 | 46515 | 77019, 107523, 138027, 168531, 199035 | 8163 | AFH75391 | 22194 | 52698 | 83202, 113706, 144210, 174714, 205218 |
| 1981 | ABU92895 | 16012 | 46516 | 77020, 107524, 138028, 168532, 199036 | 8164 | AFH97143 | 22195 | 52699 | 83203, 113707, 144211, 174715, 205219 |
| 1982 | ABU92896 | 16013 | 46517 | 77021, 107525, 138029, 168533, 199037 | 8165 | AFI56407 | 22196 | 52700 | 83204, 113708, 144212, 174716, 205220 |
| 1983 | ABU92897 | 16014 | 46518 | 77022, 107526, 138030, 168534, 199038 | 8166 | AFJ05141 | 22197 | 52701 | 83205, 113709, 144213, 174717, 205221 |
| 1984 | ABU92898 | 16015 | 46519 | 77023, 107527, 138031, 168535, 199039 | 8167 | AFJ05145 | 22198 | 52702 | 83206, 113710, 144214, 174718, 205222 |
| 1985 | ABU92899 | 16016 | 46520 | 77024, 107528, 138032, 168536, 199040 | 8168 | AFJ05635 | 22199 | 52703 | 83207, 113711, 144215, 174719, 205223 |
| 1986 | ABU92900 | 16017 | 46521 | 77025, 107529, 138033, 168537, 199041 | 8169 | AFJ11709 | 22200 | 52704 | 83208, 113712, 144216, 174720, 205224 |
| 1987 | ABU92901 | 16018 | 46522 | 77026, 107530, 138034, 168538, 199042 | 8170 | AFJ11720 | 22201 | 52705 | 83209, 113713, 144217, 174721, 205225 |
| 1988 | ABU92902 | 16019 | 46523 | 77027, 107531, 138035, 168539, 199043 | 8171 | AFJ11731 | 22202 | 52706 | 83210, 113714, 144218, 174722, 205226 |
| 1989 | ABU92903 | 16020 | 46524 | 77028, 107532, 138036, 168540, 199044 | 8172 | AFJ19845 | 22203 | 52707 | 83211, 113715, 144219, 174723, 205227 |
| 1990 | ABU92904 | 16021 | 46525 | 77029, 107533, 138037, 168541, 199045 | 8173 | AFJ44697 | 22204 | 52708 | 83212, 113716, 144220, 174724, 205228 |
| 1991 | ABU92905 | 16022 | 46526 | 77030, 107534, 138038, 168542, 199046 | 8174 | AFJ69989 | 22205 | 52709 | 83213, 113717, 144221, 174725, 205229 |

FIG. 3 continued

| | | | | | | | | | |
|---|---|---|---|---|---|---|---|---|---|
| 1992 | ABU92906 | 16023 | 46527 | 77031, 107535, 138039, 168543, 199047 | 8175 | AFJ69990 | 22206 | 52710 | 83214, 113718, 144222, 174726, 205230 |
| 1993 | ABU92907 | 16024 | 46528 | 77032, 107536, 138040, 168544, 199048 | 8176 | AFJ69991 | 22207 | 52711 | 83215, 113719, 144223, 174727, 205231 |
| 1994 | ABU92908 | 16025 | 46529 | 77033, 107537, 138041, 168545, 199049 | 8177 | AFJ69992 | 22208 | 52712 | 83216, 113720, 144224, 174728, 205232 |
| 1995 | ABU92909 | 16026 | 46530 | 77034, 107538, 138042, 168546, 199050 | 8178 | AFJ69993 | 22209 | 52713 | 83217, 113721, 144225, 174729, 205233 |
| 1996 | ABU92910 | 16027 | 46531 | 77035, 107539, 138043, 168547, 199051 | 8179 | AFJ69994 | 22210 | 52714 | 83218, 113722, 144226, 174730, 205234 |
| 1997 | ABU92911 | 16028 | 46532 | 77036, 107540, 138044, 168548, 199052 | 8180 | AFJ74389 | 22211 | 52715 | 83219, 113723, 144227, 174731, 205235 |
| 1998 | ABU92913 | 16029 | 46533 | 77037, 107541, 138045, 168549, 199053 | 8181 | AFJ74399 | 22212 | 52716 | 83220, 113724, 144228, 174732, 205236 |
| 1999 | ABV29560 | 16030 | 46534 | 77038, 107542, 138046, 168550, 199054 | 8182 | AFJ74410 | 22213 | 52717 | 83221, 113725, 144229, 174733, 205237 |
| 2000 | ABV29571 | 16031 | 46535 | 77039, 107543, 138047, 168551, 199055 | 8183 | AFJ74451 | 22214 | 52718 | 83222, 113726, 144230, 174734, 205238 |
| 2001 | ABV29582 | 16032 | 46536 | 77040, 107544, 138048, 168552, 199056 | 8184 | AFJ74462 | 22215 | 52719 | 83223, 113727, 144231, 174735, 205239 |
| 2002 | ABV29615 | 16033 | 46537 | 77041, 107545, 138049, 168553, 199057 | 8185 | AFJ74517 | 22216 | 52720 | 83224, 113728, 144232, 174736, 205240 |
| 2003 | ABV29637 | 16034 | 46538 | 77042, 107546, 138050, 168554, 199058 | 8186 | AFJ74564 | 22217 | 52721 | 83225, 113729, 144233, 174737, 205241 |
| 2004 | ABV29648 | 16035 | 46539 | 77043, 107547, 138051, 168555, 199059 | 8187 | AFJ74639 | 22218 | 52722 | 83226, 113730, 144234, 174738, 205242 |
| 2005 | ABV29659 | 16036 | 46540 | 77044, 107548, 138052, 168556, 199060 | 8188 | AFJ74640 | 22219 | 52723 | 83227, 113731, 144235, 174739, 205243 |
| 2006 | ABV29670 | 16037 | 46541 | 77045, 107549, 138053, 168557, 199061 | 8189 | AFJ74659 | 22220 | 52724 | 83228, 113732, 144236, 174740, 205244 |
| 2007 | ABV29681 | 16038 | 46542 | 77046, 107550, 138054, 168558, 199062 | 8190 | AFJ74679 | 22221 | 52725 | 83229, 113733, 144237, 174741, 205245 |
| 2008 | ABV29692 | 16039 | 46543 | 77047, 107551, 138055, 168559, 199063 | 8191 | AFJ74680 | 22222 | 52726 | 83230, 113734, 144238, 174742, 205246 |
| 2009 | ABV29703 | 16040 | 46544 | 77048, 107552, 138056, 168560, 199064 | 8192 | AFJ74701 | 22223 | 52727 | 83231, 113735, 144239, 174743, 205247 |

FIG. 3 continued

| | | | | | | | | | |
|---|---|---|---|---|---|---|---|---|---|
| 2010 | ABV29714 | 16041 | 46545 | 77049, 107553, 138057, 168561, 199065 | 8193 | AFJ74731 | 22224 | 52728 | 83232, 113736, 144240, 174744, 205248 |
| 2011 | ABV29725 | 16042 | 46546 | 77050, 107554, 138058, 168562, 199066 | 8194 | AFJ74766 | 22225 | 52729 | 83233, 113737, 144241, 174745, 205249 |
| 2012 | ABV29736 | 16043 | 46547 | 77051, 107555, 138059, 168563, 199067 | 8195 | AFJ74767 | 22226 | 52730 | 83234, 113738, 144242, 174746, 205250 |
| 2013 | ABV29747 | 16044 | 46548 | 77052, 107556, 138060, 168564, 199068 | 8196 | AFJ74783 | 22227 | 52731 | 83235, 113739, 144243, 174747, 205251 |
| 2014 | ABV29769 | 16045 | 46549 | 77053, 107557, 138061, 168565, 199069 | 8197 | AFJ74807 | 22228 | 52732 | 83236, 113740, 144244, 174748, 205252 |
| 2015 | ABV29780 | 16046 | 46550 | 77054, 107558, 138062, 168566, 199070 | 8198 | AFJ74822 | 22229 | 52733 | 83237, 113741, 144245, 174749, 205253 |
| 2016 | ABV29791 | 16047 | 46551 | 77055, 107559, 138063, 168567, 199071 | 8199 | AFJ74834 | 22230 | 52734 | 83238, 113742, 144246, 174750, 205254 |
| 2017 | ABV29802 | 16048 | 46552 | 77056, 107560, 138064, 168568, 199072 | 8200 | AFJ74845 | 22231 | 52735 | 83239, 113743, 144247, 174751, 205255 |
| 2018 | ABV29824 | 16049 | 46553 | 77057, 107561, 138065, 168569, 199073 | 8201 | AFJ75039 | 22232 | 52736 | 83240, 113744, 144248, 174752, 205256 |
| 2019 | ABV29835 | 16050 | 46554 | 77058, 107562, 138066, 168570, 199074 | 8202 | AFJ75050 | 22233 | 52737 | 83241, 113745, 144249, 174753, 205257 |
| 2020 | ABV29846 | 16051 | 46555 | 77059, 107563, 138067, 168571, 199075 | 8203 | AFJ75094 | 22234 | 52738 | 83242, 113746, 144250, 174754, 205258 |
| 2021 | ABV29879 | 16052 | 46556 | 77060, 107564, 138068, 168572, 199076 | 8204 | AFJ75104 | 22235 | 52739 | 83243, 113747, 144251, 174755, 205259 |
| 2022 | ABV29890 | 16053 | 46557 | 77061, 107565, 138069, 168573, 199077 | 8205 | AFJ75114 | 22236 | 52740 | 83244, 113748, 144252, 174756, 205260 |
| 2023 | ABV29901 | 16054 | 46558 | 77062, 107566, 138070, 168574, 199078 | 8206 | AFJ75452 | 22237 | 52741 | 83245, 113749, 144253, 174757, 205261 |
| 2024 | ABV29912 | 16055 | 46559 | 77063, 107567, 138071, 168575, 199079 | 8207 | AFJ75463 | 22238 | 52742 | 83246, 113750, 144254, 174758, 205262 |
| 2025 | ABV29923 | 16056 | 46560 | 77064, 107568, 138072, 168576, 199080 | 8208 | AFJ75552 | 22239 | 52743 | 83247, 113751, 144255, 174759, 205263 |
| 2026 | ABV29934 | 16057 | 46561 | 77065, 107569, 138073, 168577, 199081 | 8209 | AFJ75574 | 22240 | 52744 | 83248, 113752, 144256, 174760, 205264 |
| 2027 | ABV29945 | 16058 | 46562 | 77066, 107570, 138074, 168578, 199082 | 8210 | AFJ75585 | 22241 | 52745 | 83249, 113753, 144257, 174761, 205265 |

FIG. 3 continued

| | | | | | | | | | |
|---|---|---|---|---|---|---|---|---|---|
| 2028 | ABV29956 | 16059 | 46563 | 77067, 107571, 138075, 168579, 199083 | 8211 | AFJ75596 | 22242 | 52746 | 83250, 113754, 144258, 174762, 205266 |
| 2029 | ABV29989 | 16060 | 46564 | 77068, 107572, 138076, 168580, 199084 | 8212 | AFJ75607 | 22243 | 52747 | 83251, 113755, 144259, 174763, 205267 |
| 2030 | ABV30000 | 16061 | 46565 | 77069, 107573, 138077, 168581, 199085 | 8213 | AFJ75633 | 22244 | 52748 | 83252, 113756, 144260, 174764, 205268 |
| 2031 | ABV30011 | 16062 | 46566 | 77070, 107574, 138078, 168582, 199086 | 8214 | AFJ75654 | 22245 | 52749 | 83253, 113757, 144261, 174765, 205269 |
| 2032 | ABV30022 | 16063 | 46567 | 77071, 107575, 138079, 168583, 199087 | 8215 | AFJ75665 | 22246 | 52750 | 83254, 113758, 144262, 174766, 205270 |
| 2033 | ABV30044 | 16064 | 46568 | 77072, 107576, 138080, 168584, 199088 | 8216 | AFJ75676 | 22247 | 52751 | 83255, 113759, 144263, 174767, 205271 |
| 2034 | ABV30055 | 16065 | 46569 | 77073, 107577, 138081, 168585, 199089 | 8217 | AFJ75687 | 22248 | 52752 | 83256, 113760, 144264, 174768, 205272 |
| 2035 | ABV30077 | 16066 | 46570 | 77074, 107578, 138082, 168586, 199090 | 8218 | AFJ76122 | 22249 | 52753 | 83257, 113761, 144265, 174769, 205273 |
| 2036 | ABV30088 | 16067 | 46571 | 77075, 107579, 138083, 168587, 199091 | 8219 | AFJ76134 | 22250 | 52754 | 83258, 113762, 144266, 174770, 205274 |
| 2037 | ABV30099 | 16068 | 46572 | 77076, 107580, 138084, 168588, 199092 | 8220 | AFJ76146 | 22251 | 52755 | 83259, 113763, 144267, 174771, 205275 |
| 2038 | ABV30110 | 16069 | 46573 | 77077, 107581, 138085, 168589, 199093 | 8221 | AFJ76159 | 22252 | 52756 | 83260, 113764, 144268, 174772, 205276 |
| 2039 | ABV30132 | 16070 | 46574 | 77078, 107582, 138086, 168590, 199094 | 8222 | AFJ76173 | 22253 | 52757 | 83261, 113765, 144269, 174773, 205277 |
| 2040 | ABV30143 | 16071 | 46575 | 77079, 107583, 138087, 168591, 199095 | 8223 | AFJ76191 | 22254 | 52758 | 83262, 113766, 144270, 174774, 205278 |
| 2041 | ABV30154 | 16072 | 46576 | 77080, 107584, 138088, 168592, 199096 | 8224 | AFJ76192 | 22255 | 52759 | 83263, 113767, 144271, 174775, 205279 |
| 2042 | ABV30165 | 16073 | 46577 | 77081, 107585, 138089, 168593, 199097 | 8225 | AFJ76206 | 22256 | 52760 | 83264, 113768, 144272, 174776, 205280 |
| 2043 | ABV30187 | 16074 | 46578 | 77082, 107586, 138090, 168594, 199098 | 8226 | AFJ76216 | 22257 | 52761 | 83265, 113769, 144273, 174777, 205281 |
| 2044 | ABV30198 | 16075 | 46579 | 77083, 107587, 138091, 168595, 199099 | 8227 | AFJ77411 | 22258 | 52762 | 83266, 113770, 144274, 174778, 205282 |
| 2045 | ABV30209 | 16076 | 46580 | 77084, 107588, 138092, 168596, 199100 | 8228 | AFJ77422 | 22259 | 52763 | 83267, 113771, 144275, 174779, 205283 |

FIG. 3 continued

| | | | | | | | | | |
|---|---|---|---|---|---|---|---|---|---|
| 2046 | ABV30220 | 16077 | 46581 | 77085, 107589, 138093, 168597, 199101 | 8229 | AFJ77433 | 22260 | 52764 | 83268, 113772, 144276, 174780, 205284 |
| 2047 | ABV30231 | 16078 | 46582 | 77086, 107590, 138094, 168598, 199102 | 8230 | AFJ77443 | 22261 | 52765 | 83269, 113773, 144277, 174781, 205285 |
| 2048 | ABV30264 | 16079 | 46583 | 77087, 107591, 138095, 168599, 199103 | 8231 | AFJ77465 | 22262 | 52766 | 83270, 113774, 144278, 174782, 205286 |
| 2049 | ABV30275 | 16080 | 46584 | 77088, 107592, 138096, 168600, 199104 | 8232 | AFJ77476 | 22263 | 52767 | 83271, 113775, 144279, 174783, 205287 |
| 2050 | ABV30297 | 16081 | 46585 | 77089, 107593, 138097, 168601, 199105 | 8233 | AFJ77487 | 22264 | 52768 | 83272, 113776, 144280, 174784, 205288 |
| 2051 | ABV30308 | 16082 | 46586 | 77090, 107594, 138098, 168602, 199106 | 8234 | AFJ77498 | 22265 | 52769 | 83273, 113777, 144281, 174785, 205289 |
| 2052 | ABV30319 | 16083 | 46587 | 77091, 107595, 138099, 168603, 199107 | 8235 | AFJ77509 | 22266 | 52770 | 83274, 113778, 144282, 174786, 205290 |
| 2053 | ABV30330 | 16084 | 46588 | 77092, 107596, 138100, 168604, 199108 | 8236 | AFJ77520 | 22267 | 52771 | 83275, 113779, 144283, 174787, 205291 |
| 2054 | ABV30341 | 16085 | 46589 | 77093, 107597, 138101, 168605, 199109 | 8237 | AFJ77531 | 22268 | 52772 | 83276, 113780, 144284, 174788, 205292 |
| 2055 | ABV30363 | 16086 | 46590 | 77094, 107598, 138102, 168606, 199110 | 8238 | AFJ77542 | 22269 | 52773 | 83277, 113781, 144285, 174789, 205293 |
| 2056 | ABV30374 | 16087 | 46591 | 77095, 107599, 138103, 168607, 199111 | 8239 | AFJ77553 | 22270 | 52774 | 83278, 113782, 144286, 174790, 205294 |
| 2057 | ABV30385 | 16088 | 46592 | 77096, 107600, 138104, 168608, 199112 | 8240 | AFJ77564 | 22271 | 52775 | 83279, 113783, 144287, 174791, 205295 |
| 2058 | ABV30396 | 16089 | 46593 | 77097, 107601, 138105, 168609, 199113 | 8241 | AFJ77575 | 22272 | 52776 | 83280, 113784, 144288, 174792, 205296 |
| 2059 | ABV30407 | 16090 | 46594 | 77098, 107602, 138106, 168610, 199114 | 8242 | AFJ77597 | 22273 | 52777 | 83281, 113785, 144289, 174793, 205297 |
| 2060 | ABV30418 | 16091 | 46595 | 77099, 107603, 138107, 168611, 199115 | 8243 | AFJ77608 | 22274 | 52778 | 83282, 113786, 144290, 174794, 205298 |
| 2061 | ABV30429 | 16092 | 46596 | 77100, 107604, 138108, 168612, 199116 | 8244 | AFJ77619 | 22275 | 52779 | 83283, 113787, 144291, 174795, 205299 |
| 2062 | ABV30440 | 16093 | 46597 | 77101, 107605, 138109, 168613, 199117 | 8245 | AFJ77630 | 22276 | 52780 | 83284, 113788, 144292, 174796, 205300 |
| 2063 | ABV30451 | 16094 | 46598 | 77102, 107606, 138110, 168614, 199118 | 8246 | AFJ77641 | 22277 | 52781 | 83285, 113789, 144293, 174797, 205301 |

FIG. 3 continued

| | | | | | | | | | |
|---|---|---|---|---|---|---|---|---|---|
| 2064 | ABV30462 | 16095 | 46599 | 77103, 107607, 138111, 168615, 199119 | 8247 | AFJ77652 | 22278 | 52782 | 83286, 113790, 144294, 174798, 205302 |
| 2065 | ABV30473 | 16096 | 46600 | 77104, 107608, 138112, 168616, 199120 | 8248 | AFJ77663 | 22279 | 52783 | 83287, 113791, 144295, 174799, 205303 |
| 2066 | ABV30484 | 16097 | 46601 | 77105, 107609, 138113, 168617, 199121 | 8249 | AFJ77674 | 22280 | 52784 | 83288, 113792, 144296, 174800, 205304 |
| 2067 | ABV30495 | 16098 | 46602 | 77106, 107610, 138114, 168618, 199122 | 8250 | AFJ77685 | 22281 | 52785 | 83289, 113793, 144297, 174801, 205305 |
| 2068 | ABV30506 | 16099 | 46603 | 77107, 107611, 138115, 168619, 199123 | 8251 | AFJ77696 | 22282 | 52786 | 83290, 113794, 144298, 174802, 205306 |
| 2069 | ABV30517 | 16100 | 46604 | 77108, 107612, 138116, 168620, 199124 | 8252 | AFJ77707 | 22283 | 52787 | 83291, 113795, 144299, 174803, 205307 |
| 2070 | ABV30528 | 16101 | 46605 | 77109, 107613, 138117, 168621, 199125 | 8253 | AFJ77718 | 22284 | 52788 | 83292, 113796, 144300, 174804, 205308 |
| 2071 | ABV30539 | 16102 | 46606 | 77110, 107614, 138118, 168622, 199126 | 8254 | AFJ77729 | 22285 | 52789 | 83293, 113797, 144301, 174805, 205309 |
| 2072 | ABV30561 | 16103 | 46607 | 77111, 107615, 138119, 168623, 199127 | 8255 | AFJ77740 | 22286 | 52790 | 83294, 113798, 144302, 174806, 205310 |
| 2073 | ABV30572 | 16104 | 46608 | 77112, 107616, 138120, 168624, 199128 | 8256 | AFJ77751 | 22287 | 52791 | 83295, 113799, 144303, 174807, 205311 |
| 2074 | ABV30583 | 16105 | 46609 | 77113, 107617, 138121, 168625, 199129 | 8257 | AFJ77762 | 22288 | 52792 | 83296, 113800, 144304, 174808, 205312 |
| 2075 | ABV30594 | 16106 | 46610 | 77114, 107618, 138122, 168626, 199130 | 8258 | AFJ77773 | 22289 | 52793 | 83297, 113801, 144305, 174809, 205313 |
| 2076 | ABV30605 | 16107 | 46611 | 77115, 107619, 138123, 168627, 199131 | 8259 | AFJ77784 | 22290 | 52794 | 83298, 113802, 144306, 174810, 205314 |
| 2077 | ABV30616 | 16108 | 46612 | 77116, 107620, 138124, 168628, 199132 | 8260 | AFJ77795 | 22291 | 52795 | 83299, 113803, 144307, 174811, 205315 |
| 2078 | ABV30627 | 16109 | 46613 | 77117, 107621, 138125, 168629, 199133 | 8261 | AFJ77806 | 22292 | 52796 | 83300, 113804, 144308, 174812, 205316 |
| 2079 | ABV30649 | 16110 | 46614 | 77118, 107622, 138126, 168630, 199134 | 8262 | AFJ77817 | 22293 | 52797 | 83301, 113805, 144309, 174813, 205317 |
| 2080 | ABV30660 | 16111 | 46615 | 77119, 107623, 138127, 168631, 199135 | 8263 | AFJ77828 | 22294 | 52798 | 83302, 113806, 144310, 174814, 205318 |
| 2081 | ABV45852 | 16112 | 46616 | 77120, 107624, 138128, 168632, 199136 | 8264 | AFJ77839 | 22295 | 52799 | 83303, 113807, 144311, 174815, 205319 |

FIG. 3 continued

| | | | | | | | | | |
|---|---|---|---|---|---|---|---|---|---|
| 2082 | ABV45863 | 16113 | 46617 | 77121, 107625, 138129, 168633, 199137 | 8265 | AFJ77850 | 22296 | 52800 | 83304, 113808, 144312, 174816, 205320 |
| 2083 | ABV45874 | 16114 | 46618 | 77122, 107626, 138130, 168634, 199138 | 8266 | AFJ77861 | 22297 | 52801 | 83305, 113809, 144313, 174817, 205321 |
| 2084 | ABV45885 | 16115 | 46619 | 77123, 107627, 138131, 168635, 199139 | 8267 | AFJ77872 | 22298 | 52802 | 83306, 113810, 144314, 174818, 205322 |
| 2085 | ABV45896 | 16116 | 46620 | 77124, 107628, 138132, 168636, 199140 | 8268 | AFJ77883 | 22299 | 52803 | 83307, 113811, 144315, 174819, 205323 |
| 2086 | ABV45918 | 16117 | 46621 | 77125, 107629, 138133, 168637, 199141 | 8269 | AFJ77894 | 22300 | 52804 | 83308, 113812, 144316, 174820, 205324 |
| 2087 | ABV45929 | 16118 | 46622 | 77126, 107630, 138134, 168638, 199142 | 8270 | AFJ77905 | 22301 | 52805 | 83309, 113813, 144317, 174821, 205325 |
| 2088 | ABV45940 | 16119 | 46623 | 77127, 107631, 138135, 168639, 199143 | 8271 | AFJ77916 | 22302 | 52806 | 83310, 113814, 144318, 174822, 205326 |
| 2089 | ABV45951 | 16120 | 46624 | 77128, 107632, 138136, 168640, 199144 | 8272 | AFJ77927 | 22303 | 52807 | 83311, 113815, 144319, 174823, 205327 |
| 2090 | ABV45973 | 16121 | 46625 | 77129, 107633, 138137, 168641, 199145 | 8273 | AFJ77938 | 22304 | 52808 | 83312, 113816, 144320, 174824, 205328 |
| 2091 | ABV45984 | 16122 | 46626 | 77130, 107634, 138138, 168642, 199146 | 8274 | AFJ77949 | 22305 | 52809 | 83313, 113817, 144321, 174825, 205329 |
| 2092 | ABV45995 | 16123 | 46627 | 77131, 107635, 138139, 168643, 199147 | 8275 | AFJ77960 | 22306 | 52810 | 83314, 113818, 144322, 174826, 205330 |
| 2093 | ABV82554 | 16124 | 46628 | 77132, 107636, 138140, 168644, 199148 | 8276 | AFJ77971 | 22307 | 52811 | 83315, 113819, 144323, 174827, 205331 |
| 2094 | ABV82565 | 16125 | 46629 | 77133, 107637, 138141, 168645, 199149 | 8277 | AFJ77982 | 22308 | 52812 | 83316, 113820, 144324, 174828, 205332 |
| 2095 | ABW36171 | 16126 | 46630 | 77134, 107638, 138142, 168646, 199150 | 8278 | AFJ77993 | 22309 | 52813 | 83317, 113821, 144325, 174829, 205333 |
| 2096 | ABW36193 | 16127 | 46631 | 77135, 107639, 138143, 168647, 199151 | 8279 | AFJ78004 | 22310 | 52814 | 83318, 113822, 144326, 174830, 205334 |
| 2097 | ABW36204 | 16128 | 46632 | 77136, 107640, 138144, 168648, 199152 | 8280 | AFJ78015 | 22311 | 52815 | 83319, 113823, 144327, 174831, 205335 |
| 2098 | ABW36215 | 16129 | 46633 | 77137, 107641, 138145, 168649, 199153 | 8281 | AFJ78026 | 22312 | 52816 | 83320, 113824, 144328, 174832, 205336 |
| 2099 | ABW36226 | 16130 | 46634 | 77138, 107642, 138146, 168650, 199154 | 8282 | AFJ78037 | 22313 | 52817 | 83321, 113825, 144329, 174833, 205337 |

FIG. 3 continued

| | | | | | | | | | |
|---|---|---|---|---|---|---|---|---|---|
| 2100 | ABW36237 | 16131 | 46635 | 77139, 107643, 138147, 168651, 199155 | 8283 | AFJ78048 | 22314 | 52818 | 83322, 113826, 144330, 174834, 205338 |
| 2101 | ABW36248 | 16132 | 46636 | 77140, 107644, 138148, 168652, 199156 | 8284 | AFJ78059 | 22315 | 52819 | 83323, 113827, 144331, 174835, 205339 |
| 2102 | ABW36259 | 16133 | 46637 | 77141, 107645, 138149, 168653, 199157 | 8285 | AFJ78070 | 22316 | 52820 | 83324, 113828, 144332, 174836, 205340 |
| 2103 | ABW36281 | 16134 | 46638 | 77142, 107646, 138150, 168654, 199158 | 8286 | AFJ78081 | 22317 | 52821 | 83325, 113829, 144333, 174837, 205341 |
| 2104 | ABW36292 | 16135 | 46639 | 77143, 107647, 138151, 168655, 199159 | 8287 | AFJ78092 | 22318 | 52822 | 83326, 113830, 144334, 174838, 205342 |
| 2105 | ABW36303 | 16136 | 46640 | 77144, 107648, 138152, 168656, 199160 | 8288 | AFJ78103 | 22319 | 52823 | 83327, 113831, 144335, 174839, 205343 |
| 2106 | ABW36314 | 16137 | 46641 | 77145, 107649, 138153, 168657, 199161 | 8289 | AFJ78114 | 22320 | 52824 | 83328, 113832, 144336, 174840, 205344 |
| 2107 | ABW38366 | 16138 | 46642 | 77146, 107650, 138154, 168658, 199162 | 8290 | AFJ78125 | 22321 | 52825 | 83329, 113833, 144337, 174841, 205345 |
| 2108 | ABW39780 | 16139 | 46643 | 77147, 107651, 138155, 168659, 199163 | 8291 | AFJ78136 | 22322 | 52826 | 83330, 113834, 144338, 174842, 205346 |
| 2109 | ABW39809 | 16140 | 46644 | 77148, 107652, 138156, 168660, 199164 | 8292 | AFJ78147 | 22323 | 52827 | 83331, 113835, 144339, 174843, 205347 |
| 2110 | ABW39820 | 16141 | 46645 | 77149, 107653, 138157, 168661, 199165 | 8293 | AFJ78158 | 22324 | 52828 | 83332, 113836, 144340, 174844, 205348 |
| 2111 | ABW39831 | 16142 | 46646 | 77150, 107654, 138158, 168662, 199166 | 8294 | AFJ78169 | 22325 | 52829 | 83333, 113837, 144341, 174845, 205349 |
| 2112 | ABW39842 | 16143 | 46647 | 77151, 107655, 138159, 168663, 199167 | 8295 | AFJ78180 | 22326 | 52830 | 83334, 113838, 144342, 174846, 205350 |
| 2113 | ABW39864 | 16144 | 46648 | 77152, 107656, 138160, 168664, 199168 | 8296 | AFJ78191 | 22327 | 52831 | 83335, 113839, 144343, 174847, 205351 |
| 2114 | ABW39875 | 16145 | 46649 | 77153, 107657, 138161, 168665, 199169 | 8297 | AFJ78202 | 22328 | 52832 | 83336, 113840, 144344, 174848, 205352 |
| 2115 | ABW39886 | 16146 | 46650 | 77154, 107658, 138162, 168666, 199170 | 8298 | AFJ78213 | 22329 | 52833 | 83337, 113841, 144345, 174849, 205353 |
| 2116 | ABW39897 | 16147 | 46651 | 77155, 107659, 138163, 168667, 199171 | 8299 | AFJ78224 | 22330 | 52834 | 83338, 113842, 144346, 174850, 205354 |
| 2117 | ABW39908 | 16148 | 46652 | 77156, 107660, 138164, 168668, 199172 | 8300 | AFJ78235 | 22331 | 52835 | 83339, 113843, 144347, 174851, 205355 |

FIG. 3 continued

| | | | | | | | | | |
|---|---|---|---|---|---|---|---|---|---|
| 2118 | ABW39930 | 16149 | 46653 | 77157, 107661, 138165, 168669, 199173 | 8301 | AFJ78246 | 22332 | 52836 | 83340, 113844, 144348, 174852, 205356 |
| 2119 | ABW39952 | 16150 | 46654 | 77158, 107662, 138166, 168670, 199174 | 8302 | AFJ78268 | 22333 | 52837 | 83341, 113845, 144349, 174853, 205357 |
| 2120 | ABW39963 | 16151 | 46655 | 77159, 107663, 138167, 168671, 199175 | 8303 | AFJ78279 | 22334 | 52838 | 83342, 113846, 144350, 174854, 205358 |
| 2121 | ABW39985 | 16152 | 46656 | 77160, 107664, 138168, 168672, 199176 | 8304 | AFJ78290 | 22335 | 52839 | 83343, 113847, 144351, 174855, 205359 |
| 2122 | ABW39996 | 16153 | 46657 | 77161, 107665, 138169, 168673, 199177 | 8305 | AFJ78312 | 22336 | 52840 | 83344, 113848, 144352, 174856, 205360 |
| 2123 | ABW40007 | 16154 | 46658 | 77162, 107666, 138170, 168674, 199178 | 8306 | AFJ78323 | 22337 | 52841 | 83345, 113849, 144353, 174857, 205361 |
| 2124 | ABW40018 | 16155 | 46659 | 77163, 107667, 138171, 168675, 199179 | 8307 | AFJ78334 | 22338 | 52842 | 83346, 113850, 144354, 174858, 205362 |
| 2125 | ABW40029 | 16156 | 46660 | 77164, 107668, 138172, 168676, 199180 | 8308 | AFJ78345 | 22339 | 52843 | 83347, 113851, 144355, 174859, 205363 |
| 2126 | ABW40040 | 16157 | 46661 | 77165, 107669, 138173, 168677, 199181 | 8309 | AFJ78356 | 22340 | 52844 | 83348, 113852, 144356, 174860, 205364 |
| 2127 | ABW40051 | 16158 | 46662 | 77166, 107670, 138174, 168678, 199182 | 8310 | AFJ78367 | 22341 | 52845 | 83349, 113853, 144357, 174861, 205365 |
| 2128 | ABW40062 | 16159 | 46663 | 77167, 107671, 138175, 168679, 199183 | 8311 | AFJ78378 | 22342 | 52846 | 83350, 113854, 144358, 174862, 205366 |
| 2129 | ABW40084 | 16160 | 46664 | 77168, 107672, 138176, 168680, 199184 | 8312 | AFJ78389 | 22343 | 52847 | 83351, 113855, 144359, 174863, 205367 |
| 2130 | ABW40095 | 16161 | 46665 | 77169, 107673, 138177, 168681, 199185 | 8313 | AFJ78400 | 22344 | 52848 | 83352, 113856, 144360, 174864, 205368 |
| 2131 | ABW40106 | 16162 | 46666 | 77170, 107674, 138178, 168682, 199186 | 8314 | AFJ78411 | 22345 | 52849 | 83353, 113857, 144361, 174865, 205369 |
| 2132 | ABW40117 | 16163 | 46667 | 77171, 107675, 138179, 168683, 199187 | 8315 | AFJ78422 | 22346 | 52850 | 83354, 113858, 144362, 174866, 205370 |
| 2133 | ABW40128 | 16164 | 46668 | 77172, 107676, 138180, 168684, 199188 | 8316 | AFJ78433 | 22347 | 52851 | 83355, 113859, 144363, 174867, 205371 |
| 2134 | ABW40139 | 16165 | 46669 | 77173, 107677, 138181, 168685, 199189 | 8317 | AFJ78444 | 22348 | 52852 | 83356, 113860, 144364, 174868, 205372 |
| 2135 | ABW40150 | 16166 | 46670 | 77174, 107678, 138182, 168686, 199190 | 8318 | AFJ78466 | 22349 | 52853 | 83357, 113861, 144365, 174869, 205373 |

FIG. 3 continued

| | | | | | | | | | |
|---|---|---|---|---|---|---|---|---|---|
| 2136 | ABW40161 | 16167 | 46671 | 77175, 107679, 138183, 168687, 199191 | 8319 | AFJ78477 | 22350 | 52854 | 83358, 113862, 144366, 174870, 205374 |
| 2137 | ABW40172 | 16168 | 46672 | 77176, 107680, 138184, 168688, 199192 | 8320 | AFJ78488 | 22351 | 52855 | 83359, 113863, 144367, 174871, 205375 |
| 2138 | ABW40183 | 16169 | 46673 | 77177, 107681, 138185, 168689, 199193 | 8321 | AFJ78510 | 22352 | 52856 | 83360, 113864, 144368, 174872, 205376 |
| 2139 | ABW40194 | 16170 | 46674 | 77178, 107682, 138186, 168690, 199194 | 8322 | AFJ78521 | 22353 | 52857 | 83361, 113865, 144369, 174873, 205377 |
| 2140 | ABW40205 | 16171 | 46675 | 77179, 107683, 138187, 168691, 199195 | 8323 | AFJ78532 | 22354 | 52858 | 83362, 113866, 144370, 174874, 205378 |
| 2141 | ABW40216 | 16172 | 46676 | 77180, 107684, 138188, 168692, 199196 | 8324 | AFJ78543 | 22355 | 52859 | 83363, 113867, 144371, 174875, 205379 |
| 2142 | ABW40227 | 16173 | 46677 | 77181, 107685, 138189, 168693, 199197 | 8325 | AFJ78554 | 22356 | 52860 | 83364, 113868, 144372, 174876, 205380 |
| 2143 | ABW40238 | 16174 | 46678 | 77182, 107686, 138190, 168694, 199198 | 8326 | AFJ78565 | 22357 | 52861 | 83365, 113869, 144373, 174877, 205381 |
| 2144 | ABW40249 | 16175 | 46679 | 77183, 107687, 138191, 168695, 199199 | 8327 | AFJ78576 | 22358 | 52862 | 83366, 113870, 144374, 174878, 205382 |
| 2145 | ABW40260 | 16176 | 46680 | 77184, 107688, 138192, 168696, 199200 | 8328 | AFJ78598 | 22359 | 52863 | 83367, 113871, 144375, 174879, 205383 |
| 2146 | ABW40271 | 16177 | 46681 | 77185, 107689, 138193, 168697, 199201 | 8329 | AFJ78609 | 22360 | 52864 | 83368, 113872, 144376, 174880, 205384 |
| 2147 | ABW40282 | 16178 | 46682 | 77186, 107690, 138194, 168698, 199202 | 8330 | AFJ78620 | 22361 | 52865 | 83369, 113873, 144377, 174881, 205385 |
| 2148 | ABW40293 | 16179 | 46683 | 77187, 107691, 138195, 168699, 199203 | 8331 | AFJ78631 | 22362 | 52866 | 83370, 113874, 144378, 174882, 205386 |
| 2149 | ABW40304 | 16180 | 46684 | 77188, 107692, 138196, 168700, 199204 | 8332 | AFJ78642 | 22363 | 52867 | 83371, 113875, 144379, 174883, 205387 |
| 2150 | ABW40315 | 16181 | 46685 | 77189, 107693, 138197, 168701, 199205 | 8333 | AFJ78653 | 22364 | 52868 | 83372, 113876, 144380, 174884, 205388 |
| 2151 | ABW40326 | 16182 | 46686 | 77190, 107694, 138198, 168702, 199206 | 8334 | AFJ78664 | 22365 | 52869 | 83373, 113877, 144381, 174885, 205389 |
| 2152 | ABW40337 | 16183 | 46687 | 77191, 107695, 138199, 168703, 199207 | 8335 | AFJ78674 | 22366 | 52870 | 83374, 113878, 144382, 174886, 205390 |
| 2153 | ABW40359 | 16184 | 46688 | 77192, 107696, 138200, 168704, 199208 | 8336 | AFJ78684 | 22367 | 52871 | 83375, 113879, 144383, 174887, 205391 |

FIG. 3 continued

| | | | | | | | | | |
|---|---|---|---|---|---|---|---|---|---|
| 2154 | ABW40370 | 16185 | 46689 | 77193, 107697, 138201, 168705, 199209 | 8337 | AFJ78694 | 22368 | 52872 | 83376, 113880, 144384, 174888, 205392 |
| 2155 | ABW40403 | 16186 | 46690 | 77194, 107698, 138202, 168706, 199210 | 8338 | AFJ78704 | 22369 | 52873 | 83377, 113881, 144385, 174889, 205393 |
| 2156 | ABW40414 | 16187 | 46691 | 77195, 107699, 138203, 168707, 199211 | 8339 | AFJ78714 | 22370 | 52874 | 83378, 113882, 144386, 174890, 205394 |
| 2157 | ABW40425 | 16188 | 46692 | 77196, 107700, 138204, 168708, 199212 | 8340 | AFJ78724 | 22371 | 52875 | 83379, 113883, 144387, 174891, 205395 |
| 2158 | ABW40436 | 16189 | 46693 | 77197, 107701, 138205, 168709, 199213 | 8341 | AFJ78734 | 22372 | 52876 | 83380, 113884, 144388, 174892, 205396 |
| 2159 | ABW40447 | 16190 | 46694 | 77198, 107702, 138206, 168710, 199214 | 8342 | AFJ78744 | 22373 | 52877 | 83381, 113885, 144389, 174893, 205397 |
| 2160 | ABW40458 | 16191 | 46695 | 77199, 107703, 138207, 168711, 199215 | 8343 | AFJ78754 | 22374 | 52878 | 83382, 113886, 144390, 174894, 205398 |
| 2161 | ABW40469 | 16192 | 46696 | 77200, 107704, 138208, 168712, 199216 | 8344 | AFJ78764 | 22375 | 52879 | 83383, 113887, 144391, 174895, 205399 |
| 2162 | ABW40491 | 16193 | 46697 | 77201, 107705, 138209, 168713, 199217 | 8345 | AFJ78774 | 22376 | 52880 | 83384, 113888, 144392, 174896, 205400 |
| 2163 | ABW40502 | 16194 | 46698 | 77202, 107706, 138210, 168714, 199218 | 8346 | AFJ78784 | 22377 | 52881 | 83385, 113889, 144393, 174897, 205401 |
| 2164 | ABW40513 | 16195 | 46699 | 77203, 107707, 138211, 168715, 199219 | 8347 | AFJ78794 | 22378 | 52882 | 83386, 113890, 144394, 174898, 205402 |
| 2165 | ABW40524 | 16196 | 46700 | 77204, 107708, 138212, 168716, 199220 | 8348 | AFJ78804 | 22379 | 52883 | 83387, 113891, 144395, 174899, 205403 |
| 2166 | ABW40546 | 16197 | 46701 | 77205, 107709, 138213, 168717, 199221 | 8349 | AFJ78814 | 22380 | 52884 | 83388, 113892, 144396, 174900, 205404 |
| 2167 | ABW40557 | 16198 | 46702 | 77206, 107710, 138214, 168718, 199222 | 8350 | AFJ78824 | 22381 | 52885 | 83389, 113893, 144397, 174901, 205405 |
| 2168 | ABW40568 | 16199 | 46703 | 77207, 107711, 138215, 168719, 199223 | 8351 | AFJ78834 | 22382 | 52886 | 83390, 113894, 144398, 174902, 205406 |
| 2169 | ABW40579 | 16200 | 46704 | 77208, 107712, 138216, 168720, 199224 | 8352 | AFJ78844 | 22383 | 52887 | 83391, 113895, 144399, 174903, 205407 |
| 2170 | ABW40601 | 16201 | 46705 | 77209, 107713, 138217, 168721, 199225 | 8353 | AFJ78854 | 22384 | 52888 | 83392, 113896, 144400, 174904, 205408 |
| 2171 | ABW40612 | 16202 | 46706 | 77210, 107714, 138218, 168722, 199226 | 8354 | AFJ78864 | 22385 | 52889 | 83393, 113897, 144401, 174905, 205409 |

FIG. 3 continued

| | | | | | | | | | |
|---|---|---|---|---|---|---|---|---|---|
| 2172 | ABW40623 | 16203 | 46707 | 77211, 107715, 138219, 168723, 199227 | 8355 | AFJ78874 | 22386 | 52890 | 83394, 113898, 144402, 174906, 205410 |
| 2173 | ABW40634 | 16204 | 46708 | 77212, 107716, 138220, 168724, 199228 | 8356 | AFJ78884 | 22387 | 52891 | 83395, 113899, 144403, 174907, 205411 |
| 2174 | ABW40645 | 16205 | 46709 | 77213, 107717, 138221, 168725, 199229 | 8357 | AFJ78894 | 22388 | 52892 | 83396, 113900, 144404, 174908, 205412 |
| 2175 | ABW40656 | 16206 | 46710 | 77214, 107718, 138222, 168726, 199230 | 8358 | AFJ78904 | 22389 | 52893 | 83397, 113901, 144405, 174909, 205413 |
| 2176 | ABW40667 | 16207 | 46711 | 77215, 107719, 138223, 168727, 199231 | 8359 | AFJ78914 | 22390 | 52894 | 83398, 113902, 144406, 174910, 205414 |
| 2177 | ABW40678 | 16208 | 46712 | 77216, 107720, 138224, 168728, 199232 | 8360 | AFJ78924 | 22391 | 52895 | 83399, 113903, 144407, 174911, 205415 |
| 2178 | ABW71297 | 16209 | 46713 | 77217, 107721, 138225, 168729, 199233 | 8361 | AFJ97569 | 22392 | 52896 | 83400, 113904, 144408, 174912, 205416 |
| 2179 | ABW71308 | 16210 | 46714 | 77218, 107722, 138226, 168730, 199234 | 8362 | AFK14107 | 22393 | 52897 | 83401, 113905, 144409, 174913, 205417 |
| 2180 | ABW71319 | 16211 | 46715 | 77219, 107723, 138227, 168731, 199235 | 8363 | AFK14117 | 22394 | 52898 | 83402, 113906, 144410, 174914, 205418 |
| 2181 | ABW71330 | 16212 | 46716 | 77220, 107724, 138228, 168732, 199236 | 8364 | AFK14141 | 22395 | 52899 | 83403, 113907, 144411, 174915, 205419 |
| 2182 | ABW71341 | 16213 | 46717 | 77221, 107725, 138229, 168733, 199237 | 8365 | AFK14150 | 22396 | 52900 | 83404, 113908, 144412, 174916, 205420 |
| 2183 | ABW71352 | 16214 | 46718 | 77222, 107726, 138230, 168734, 199238 | 8366 | AFK14159 | 22397 | 52901 | 83405, 113909, 144413, 174917, 205421 |
| 2184 | ABW71363 | 16215 | 46719 | 77223, 107727, 138231, 168735, 199239 | 8367 | AFK14168 | 22398 | 52902 | 83406, 113910, 144414, 174918, 205422 |
| 2185 | ABW71374 | 16216 | 46720 | 77224, 107728, 138232, 168736, 199240 | 8368 | AFK14177 | 22399 | 52903 | 83407, 113911, 144415, 174919, 205423 |
| 2186 | ABW71385 | 16217 | 46721 | 77225, 107729, 138233, 168737, 199241 | 8369 | AFK14186 | 22400 | 52904 | 83408, 113912, 144416, 174920, 205424 |
| 2187 | ABW71396 | 16218 | 46722 | 77226, 107730, 138234, 168738, 199242 | 8370 | AFK14195 | 22401 | 52905 | 83409, 113913, 144417, 174921, 205425 |
| 2188 | ABW71407 | 16219 | 46723 | 77227, 107731, 138235, 168739, 199243 | 8371 | AFK14204 | 22402 | 52906 | 83410, 113914, 144418, 174922, 205426 |
| 2189 | ABW71418 | 16220 | 46724 | 77228, 107732, 138236, 168740, 199244 | 8372 | AFK14213 | 22403 | 52907 | 83411, 113915, 144419, 174923, 205427 |

FIG. 3 continued

| | | | | | | | | | |
|---|---|---|---|---|---|---|---|---|---|
| 2190 | ABW71440 | 16221 | 46725 | 77229, 107733, 138237, 168741, 199245 | 8373 | AFK14222 | 22404 | 52908 | 83412, 113916, 144420, 174924, 205428 |
| 2191 | ABW71451 | 16222 | 46726 | 77230, 107734, 138238, 168742, 199246 | 8374 | AFK14231 | 22405 | 52909 | 83413, 113917, 144421, 174925, 205429 |
| 2192 | ABW71462 | 16223 | 46727 | 77231, 107735, 138239, 168743, 199247 | 8375 | AFK14240 | 22406 | 52910 | 83414, 113918, 144422, 174926, 205430 |
| 2193 | ABW80980 | 16224 | 46728 | 77232, 107736, 138240, 168744, 199248 | 8376 | AFK14249 | 22407 | 52911 | 83415, 113919, 144423, 174927, 205431 |
| 2194 | ABW80981 | 16225 | 46729 | 77233, 107737, 138241, 168745, 199249 | 8377 | AFK14257 | 22408 | 52912 | 83416, 113920, 144424, 174928, 205432 |
| 2195 | ABW81474 | 16226 | 46730 | 77234, 107738, 138242, 168746, 199250 | 8378 | AFK14266 | 22409 | 52913 | 83417, 113921, 144425, 174929, 205433 |
| 2196 | ABW81475 | 16227 | 46731 | 77235, 107739, 138243, 168747, 199251 | 8379 | AFK14274 | 22410 | 52914 | 83418, 113922, 144426, 174930, 205434 |
| 2197 | ABW81477 | 16228 | 46732 | 77236, 107740, 138244, 168748, 199252 | 8380 | AFK14281 | 22411 | 52915 | 83419, 113923, 144427, 174931, 205435 |
| 2198 | ABW81478 | 16229 | 46733 | 77237, 107741, 138245, 168749, 199253 | 8381 | AFK14289 | 22412 | 52916 | 83420, 113924, 144428, 174932, 205436 |
| 2199 | ABW81479 | 16230 | 46734 | 77238, 107742, 138246, 168750, 199254 | 8382 | AFK14298 | 22413 | 52917 | 83421, 113925, 144429, 174933, 205437 |
| 2200 | ABW81480 | 16231 | 46735 | 77239, 107743, 138247, 168751, 199255 | 8383 | AFK14307 | 22414 | 52918 | 83422, 113926, 144430, 174934, 205438 |
| 2201 | ABW81481 | 16232 | 46736 | 77240, 107744, 138248, 168752, 199256 | 8384 | AFK14316 | 22415 | 52919 | 83423, 113927, 144431, 174935, 205439 |
| 2202 | ABW81482 | 16233 | 46737 | 77241, 107745, 138249, 168753, 199257 | 8385 | AFK14325 | 22416 | 52920 | 83424, 113928, 144432, 174936, 205440 |
| 2203 | ABW81483 | 16234 | 46738 | 77242, 107746, 138250, 168754, 199258 | 8386 | AFK14334 | 22417 | 52921 | 83425, 113929, 144433, 174937, 205441 |
| 2204 | ABW81484 | 16235 | 46739 | 77243, 107747, 138251, 168755, 199259 | 8387 | AFK14343 | 22418 | 52922 | 83426, 113930, 144434, 174938, 205442 |
| 2205 | ABW81487 | 16236 | 46740 | 77244, 107748, 138252, 168756, 199260 | 8388 | AFK14352 | 22419 | 52923 | 83427, 113931, 144435, 174939, 205443 |
| 2206 | ABW81488 | 16237 | 46741 | 77245, 107749, 138253, 168757, 199261 | 8389 | AFK14360 | 22420 | 52924 | 83428, 113932, 144436, 174940, 205444 |
| 2207 | ABW81489 | 16238 | 46742 | 77246, 107750, 138254, 168758, 199262 | 8390 | AFK14369 | 22421 | 52925 | 83429, 113933, 144437, 174941, 205445 |

FIG. 3 continued

| | | | | | | | | | |
|---|---|---|---|---|---|---|---|---|---|
| 2208 | ABW81490 | 16239 | 46743 | 77247, 107751, 138255, 168759, 199263 | 8391 | AFK14387 | 22422 | 52926 | 83430, 113934, 144438, 174942, 205446 |
| 2209 | ABW81491 | 16240 | 46744 | 77248, 107752, 138256, 168760, 199264 | 8392 | AFK14397 | 22423 | 52927 | 83431, 113935, 144439, 174943, 205447 |
| 2210 | ABW81492 | 16241 | 46745 | 77249, 107753, 138257, 168761, 199265 | 8393 | AFK14406 | 22424 | 52928 | 83432, 113936, 144440, 174944, 205448 |
| 2211 | ABW81493 | 16242 | 46746 | 77250, 107754, 138258, 168762, 199266 | 8394 | AFK14415 | 22425 | 52929 | 83433, 113937, 144441, 174945, 205449 |
| 2212 | ABW81494 | 16243 | 46747 | 77251, 107755, 138259, 168763, 199267 | 8395 | AFK14424 | 22426 | 52930 | 83434, 113938, 144442, 174946, 205450 |
| 2213 | ABW81495 | 16244 | 46748 | 77252, 107756, 138260, 168764, 199268 | 8396 | AFK14433 | 22427 | 52931 | 83435, 113939, 144443, 174947, 205451 |
| 2214 | ABW81497 | 16245 | 46749 | 77253, 107757, 138261, 168765, 199269 | 8397 | AFK14442 | 22428 | 52932 | 83436, 113940, 144444, 174948, 205452 |
| 2215 | ABW81498 | 16246 | 46750 | 77254, 107758, 138262, 168766, 199270 | 8398 | AFK14451 | 22429 | 52933 | 83437, 113941, 144445, 174949, 205453 |
| 2216 | ABW81499 | 16247 | 46751 | 77255, 107759, 138263, 168767, 199271 | 8399 | AFK14458 | 22430 | 52934 | 83438, 113942, 144446, 174950, 205454 |
| 2217 | ABW81500 | 16248 | 46752 | 77256, 107760, 138264, 168768, 199272 | 8400 | AFK14467 | 22431 | 52935 | 83439, 113943, 144447, 174951, 205455 |
| 2218 | ABW81501 | 16249 | 46753 | 77257, 107761, 138265, 168769, 199273 | 8401 | AFK14476 | 22432 | 52936 | 83440, 113944, 144448, 174952, 205456 |
| 2219 | ABW86324 | 16250 | 46754 | 77258, 107762, 138266, 168770, 199274 | 8402 | AFK14485 | 22433 | 52937 | 83441, 113945, 144449, 174953, 205457 |
| 2220 | ABW86335 | 16251 | 46755 | 77259, 107763, 138267, 168771, 199275 | 8403 | AFK14504 | 22434 | 52938 | 83442, 113946, 144450, 174954, 205458 |
| 2221 | ABW86346 | 16252 | 46756 | 77260, 107764, 138268, 168772, 199276 | 8404 | AFK14514 | 22435 | 52939 | 83443, 113947, 144451, 174955, 205459 |
| 2222 | ABW86357 | 16253 | 46757 | 77261, 107765, 138269, 168773, 199277 | 8405 | AFK14522 | 22436 | 52940 | 83444, 113948, 144452, 174956, 205460 |
| 2223 | ABW86368 | 16254 | 46758 | 77262, 107766, 138270, 168774, 199278 | 8406 | AFK14529 | 22437 | 52941 | 83445, 113949, 144453, 174957, 205461 |
| 2224 | ABW86379 | 16255 | 46759 | 77263, 107767, 138271, 168775, 199279 | 8407 | AFK14538 | 22438 | 52942 | 83446, 113950, 144454, 174958, 205462 |
| 2225 | ABW86390 | 16256 | 46760 | 77264, 107768, 138272, 168776, 199280 | 8408 | AFK14547 | 22439 | 52943 | 83447, 113951, 144455, 174959, 205463 |

FIG. 3 continued

| | | | | | | | | | |
|---|---|---|---|---|---|---|---|---|---|
| 2226 | ABW86401 | 16257 | 46761 | 77265, 107769, 138273, 168777, 199281 | 8409 | AFK14555 | 22440 | 52944 | 83448, 113952, 144456, 174960, 205464 |
| 2227 | ABW86412 | 16258 | 46762 | 77266, 107770, 138274, 168778, 199282 | 8410 | AFK14564 | 22441 | 52945 | 83449, 113953, 144457, 174961, 205465 |
| 2228 | ABW86423 | 16259 | 46763 | 77267, 107771, 138275, 168779, 199283 | 8411 | AFK14573 | 22442 | 52946 | 83450, 113954, 144458, 174962, 205466 |
| 2229 | ABW86434 | 16260 | 46764 | 77268, 107772, 138276, 168780, 199284 | 8412 | AFK14579 | 22443 | 52947 | 83451, 113955, 144459, 174963, 205467 |
| 2230 | ABW86445 | 16261 | 46765 | 77269, 107773, 138277, 168781, 199285 | 8413 | AFK14588 | 22444 | 52948 | 83452, 113956, 144460, 174964, 205468 |
| 2231 | ABW86456 | 16262 | 46766 | 77270, 107774, 138278, 168782, 199286 | 8414 | AFK14597 | 22445 | 52949 | 83453, 113957, 144461, 174965, 205469 |
| 2232 | ABW86467 | 16263 | 46767 | 77271, 107775, 138279, 168783, 199287 | 8415 | AFK14604 | 22446 | 52950 | 83454, 113958, 144462, 174966, 205470 |
| 2233 | ABW86478 | 16264 | 46768 | 77272, 107776, 138280, 168784, 199288 | 8416 | AFK14632 | 22447 | 52951 | 83455, 113959, 144463, 174967, 205471 |
| 2234 | ABW86489 | 16265 | 46769 | 77273, 107777, 138281, 168785, 199289 | 8417 | AFK14641 | 22448 | 52952 | 83456, 113960, 144464, 174968, 205472 |
| 2235 | ABW86500 | 16266 | 46770 | 77274, 107778, 138282, 168786, 199290 | 8418 | AFK14651 | 22449 | 52953 | 83457, 113961, 144465, 174969, 205473 |
| 2236 | ABW86511 | 16267 | 46771 | 77275, 107779, 138283, 168787, 199291 | 8419 | AFK14656 | 22450 | 52954 | 83458, 113962, 144466, 174970, 205474 |
| 2237 | ABW86522 | 16268 | 46772 | 77276, 107780, 138284, 168788, 199292 | 8420 | AFK14663 | 22451 | 52955 | 83459, 113963, 144467, 174971, 205475 |
| 2238 | ABW86533 | 16269 | 46773 | 77277, 107781, 138285, 168789, 199293 | 8421 | AFK14672 | 22452 | 52956 | 83460, 113964, 144468, 174972, 205476 |
| 2239 | ABW86544 | 16270 | 46774 | 77278, 107782, 138286, 168790, 199294 | 8422 | AFK14680 | 22453 | 52957 | 83461, 113965, 144469, 174973, 205477 |
| 2240 | ABW86555 | 16271 | 46775 | 77279, 107783, 138287, 168791, 199295 | 8423 | AFK14690 | 22454 | 52958 | 83462, 113966, 144470, 174974, 205478 |
| 2241 | ABW86566 | 16272 | 46776 | 77280, 107784, 138288, 168792, 199296 | 8424 | AFK14707 | 22455 | 52959 | 83463, 113967, 144471, 174975, 205479 |
| 2242 | ABW86609 | 16273 | 46777 | 77281, 107785, 138289, 168793, 199297 | 8425 | AFK14715 | 22456 | 52960 | 83464, 113968, 144472, 174976, 205480 |
| 2243 | ABW91188 | 16274 | 46778 | 77282, 107786, 138290, 168794, 199298 | 8426 | AFK14724 | 22457 | 52961 | 83465, 113969, 144473, 174977, 205481 |

FIG. 3 continued

| | | | | | | | | | |
|---|---|---|---|---|---|---|---|---|---|
| 2244 | ABW91210 | 16275 | 46779 | 77283, 107787, 138291, 168795, 199299 | 8427 | AFK14733 | 22458 | 52962 | 83466, 113970, 144474, 174978, 205482 |
| 2245 | ABW91221 | 16276 | 46780 | 77284, 107788, 138292, 168796, 199300 | 8428 | AFK14751 | 22459 | 52963 | 83467, 113971, 144475, 174979, 205483 |
| 2246 | ABW91232 | 16277 | 46781 | 77285, 107789, 138293, 168797, 199301 | 8429 | AFK14757 | 22460 | 52964 | 83468, 113972, 144476, 174980, 205484 |
| 2247 | ABW91243 | 16278 | 46782 | 77286, 107790, 138294, 168798, 199302 | 8430 | AFK14766 | 22461 | 52965 | 83469, 113973, 144477, 174981, 205485 |
| 2248 | ABW91254 | 16279 | 46783 | 77287, 107791, 138295, 168799, 199303 | 8431 | AFK14774 | 22462 | 52966 | 83470, 113974, 144478, 174982, 205486 |
| 2249 | ABW91265 | 16280 | 46784 | 77288, 107792, 138296, 168800, 199304 | 8432 | AFK14781 | 22463 | 52967 | 83471, 113975, 144479, 174983, 205487 |
| 2250 | ABW91276 | 16281 | 46785 | 77289, 107793, 138297, 168801, 199305 | 8433 | AFK14790 | 22464 | 52968 | 83472, 113976, 144480, 174984, 205488 |
| 2251 | ABW91287 | 16282 | 46786 | 77290, 107794, 138298, 168802, 199306 | 8434 | AFK14800 | 22465 | 52969 | 83473, 113977, 144481, 174985, 205489 |
| 2252 | ABW91298 | 16283 | 46787 | 77291, 107795, 138299, 168803, 199307 | 8435 | AFK14809 | 22466 | 52970 | 83474, 113978, 144482, 174986, 205490 |
| 2253 | ABW91309 | 16284 | 46788 | 77292, 107796, 138300, 168804, 199308 | 8436 | AFK14816 | 22467 | 52971 | 83475, 113979, 144483, 174987, 205491 |
| 2254 | ABW91320 | 16285 | 46789 | 77293, 107797, 138301, 168805, 199309 | 8437 | AFK14824 | 22468 | 52972 | 83476, 113980, 144484, 174988, 205492 |
| 2255 | ABW91331 | 16286 | 46790 | 77294, 107798, 138302, 168806, 199310 | 8438 | AFK14841 | 22469 | 52973 | 83477, 113981, 144485, 174989, 205493 |
| 2256 | ABW91342 | 16287 | 46791 | 77295, 107799, 138303, 168807, 199311 | 8439 | AFK14849 | 22470 | 52974 | 83478, 113982, 144486, 174990, 205494 |
| 2257 | ABW91353 | 16288 | 46792 | 77296, 107800, 138304, 168808, 199312 | 8440 | AFK14856 | 22471 | 52975 | 83479, 113983, 144487, 174991, 205495 |
| 2258 | ABW91364 | 16289 | 46793 | 77297, 107801, 138305, 168809, 199313 | 8441 | AFK14870 | 22472 | 52976 | 83480, 113984, 144488, 174992, 205496 |
| 2259 | ABW91375 | 16290 | 46794 | 77298, 107802, 138306, 168810, 199314 | 8442 | AFK14879 | 22473 | 52977 | 83481, 113985, 144489, 174993, 205497 |
| 2260 | ABW91386 | 16291 | 46795 | 77299, 107803, 138307, 168811, 199315 | 8443 | AFK14885 | 22474 | 52978 | 83482, 113986, 144490, 174994, 205498 |
| 2261 | ABW91397 | 16292 | 46796 | 77300, 107804, 138308, 168812, 199316 | 8444 | AFK14894 | 22475 | 52979 | 83483, 113987, 144491, 174995, 205499 |

FIG. 3 continued

| | | | | | | | | | |
|---|---|---|---|---|---|---|---|---|---|
| 2262 | ABW91408 | 16293 | 46797 | 77301, 107805, 138309, 168813, 199317 | 8445 | AFK14903 | 22476 | 52980 | 83484, 113988, 144492, 174996, 205500 |
| 2263 | ABW91419 | 16294 | 46798 | 77302, 107806, 138310, 168814, 199318 | 8446 | AFK14912 | 22477 | 52981 | 83485, 113989, 144493, 174997, 205501 |
| 2264 | ABW91430 | 16295 | 46799 | 77303, 107807, 138311, 168815, 199319 | 8447 | AFK14921 | 22478 | 52982 | 83486, 113990, 144494, 174998, 205502 |
| 2265 | ABW91441 | 16296 | 46800 | 77304, 107808, 138312, 168816, 199320 | 8448 | AFK14931 | 22479 | 52983 | 83487, 113991, 144495, 174999, 205503 |
| 2266 | ABW91452 | 16297 | 46801 | 77305, 107809, 138313, 168817, 199321 | 8449 | AFK25604 | 22480 | 52984 | 83488, 113992, 144496, 175000, 205504 |
| 2267 | ABW91463 | 16298 | 46802 | 77306, 107810, 138314, 168818, 199322 | 8450 | AFK25606 | 22481 | 52985 | 83489, 113993, 144497, 175001, 205505 |
| 2268 | ABW91474 | 16299 | 46803 | 77307, 107811, 138315, 168819, 199323 | 8451 | AFK74537 | 22482 | 52986 | 83490, 113994, 144498, 175002, 205506 |
| 2269 | ABW91485 | 16300 | 46804 | 77308, 107812, 138316, 168820, 199324 | 8452 | AFK74547 | 22483 | 52987 | 83491, 113995, 144499, 175003, 205507 |
| 2270 | ABW91496 | 16301 | 46805 | 77309, 107813, 138317, 168821, 199325 | 8453 | AFK74557 | 22484 | 52988 | 83492, 113996, 144500, 175004, 205508 |
| 2271 | ABW91507 | 16302 | 46806 | 77310, 107814, 138318, 168822, 199326 | 8454 | AFK74567 | 22485 | 52989 | 83493, 113997, 144501, 175005, 205509 |
| 2272 | ABW91518 | 16303 | 46807 | 77311, 107815, 138319, 168823, 199327 | 8455 | AFK74578 | 22486 | 52990 | 83494, 113998, 144502, 175006, 205510 |
| 2273 | ABW91529 | 16304 | 46808 | 77312, 107816, 138320, 168824, 199328 | 8456 | AFK74588 | 22487 | 52991 | 83495, 113999, 144503, 175007, 205511 |
| 2274 | ABW91540 | 16305 | 46809 | 77313, 107817, 138321, 168825, 199329 | 8457 | AFK74598 | 22488 | 52992 | 83496, 114000, 144504, 175008, 205512 |
| 2275 | ABW91551 | 16306 | 46810 | 77314, 107818, 138322, 168826, 199330 | 8458 | AFK74608 | 22489 | 52993 | 83497, 114001, 144505, 175009, 205513 |
| 2276 | ABW91562 | 16307 | 46811 | 77315, 107819, 138323, 168827, 199331 | 8459 | AFK74618 | 22490 | 52994 | 83498, 114002, 144506, 175010, 205514 |
| 2277 | ABW91584 | 16308 | 46812 | 77316, 107820, 138324, 168828, 199332 | 8460 | AFK74628 | 22491 | 52995 | 83499, 114003, 144507, 175011, 205515 |
| 2278 | ABW91595 | 16309 | 46813 | 77317, 107821, 138325, 168829, 199333 | 8461 | AFK74638 | 22492 | 52996 | 83500, 114004, 144508, 175012, 205516 |
| 2279 | ABW91606 | 16310 | 46814 | 77318, 107822, 138326, 168830, 199334 | 8462 | AFK74648 | 22493 | 52997 | 83501, 114005, 144509, 175013, 205517 |

FIG. 3 continued

| | | | | | | | | | |
|---|---|---|---|---|---|---|---|---|---|
| 2280 | ABW91617 | 16311 | 46815 | 77319, 107823, 138327, 168831, 199335 | 8463 | AFK74658 | 22494 | 52998 | 83502, 114006, 144510, 175014, 205518 |
| 2281 | ABW91628 | 16312 | 46816 | 77320, 107824, 138328, 168832, 199336 | 8464 | AFK74668 | 22495 | 52999 | 83503, 114007, 144511, 175015, 205519 |
| 2282 | ABW91639 | 16313 | 46817 | 77321, 107825, 138329, 168833, 199337 | 8465 | AFK74678 | 22496 | 53000 | 83504, 114008, 144512, 175016, 205520 |
| 2283 | ABW91650 | 16314 | 46818 | 77322, 107826, 138330, 168834, 199338 | 8466 | AFK74688 | 22497 | 53001 | 83505, 114009, 144513, 175017, 205521 |
| 2284 | ABX10517 | 16315 | 46819 | 77323, 107827, 138331, 168835, 199339 | 8467 | AFK74698 | 22498 | 53002 | 83506, 114010, 144514, 175018, 205522 |
| 2285 | ABX10527 | 16316 | 46820 | 77324, 107828, 138332, 168836, 199340 | 8468 | AFK74708 | 22499 | 53003 | 83507, 114011, 144515, 175019, 205523 |
| 2286 | ABX58242 | 16317 | 46821 | 77325, 107829, 138333, 168837, 199341 | 8469 | AFK74718 | 22500 | 53004 | 83508, 114012, 144516, 175020, 205524 |
| 2287 | ABX58253 | 16318 | 46822 | 77326, 107830, 138334, 168838, 199342 | 8470 | AFK74728 | 22501 | 53005 | 83509, 114013, 144517, 175021, 205525 |
| 2288 | ABX58264 | 16319 | 46823 | 77327, 107831, 138335, 168839, 199343 | 8471 | AFK74738 | 22502 | 53006 | 83510, 114014, 144518, 175022, 205526 |
| 2289 | ABX58275 | 16320 | 46824 | 77328, 107832, 138336, 168840, 199344 | 8472 | AFK74748 | 22503 | 53007 | 83511, 114015, 144519, 175023, 205527 |
| 2290 | ABX58286 | 16321 | 46825 | 77329, 107833, 138337, 168841, 199345 | 8473 | AFK74758 | 22504 | 53008 | 83512, 114016, 144520, 175024, 205528 |
| 2291 | ABX58297 | 16322 | 46826 | 77330, 107834, 138338, 168842, 199346 | 8474 | AFK74768 | 22505 | 53009 | 83513, 114017, 144521, 175025, 205529 |
| 2292 | ABX58308 | 16323 | 46827 | 77331, 107835, 138339, 168843, 199347 | 8475 | AFK74778 | 22506 | 53010 | 83514, 114018, 144522, 175026, 205530 |
| 2293 | ABX58319 | 16324 | 46828 | 77332, 107836, 138340, 168844, 199348 | 8476 | AFK74788 | 22507 | 53011 | 83515, 114019, 144523, 175027, 205531 |
| 2294 | ABX58352 | 16325 | 46829 | 77333, 107837, 138341, 168845, 199349 | 8477 | AFK74798 | 22508 | 53012 | 83516, 114020, 144524, 175028, 205532 |
| 2295 | ABX58363 | 16326 | 46830 | 77334, 107838, 138342, 168846, 199350 | 8478 | AFK74808 | 22509 | 53013 | 83517, 114021, 144525, 175029, 205533 |
| 2296 | ABX58385 | 16327 | 46831 | 77335, 107839, 138343, 168847, 199351 | 8479 | AFK74818 | 22510 | 53014 | 83518, 114022, 144526, 175030, 205534 |
| 2297 | ABX58396 | 16328 | 46832 | 77336, 107840, 138344, 168848, 199352 | 8480 | AFK74828 | 22511 | 53015 | 83519, 114023, 144527, 175031, 205535 |

FIG. 3 continued

| | | | | | | | | | |
|---|---|---|---|---|---|---|---|---|---|
| 2298 | ABX58407 | 16329 | 46833 | 77337, 107841, 138345, 168849, 199353 | 8481 | AFK74838 | 22512 | 53016 | 83520, 114024, 144528, 175032, 205536 |
| 2299 | ABX58418 | 16330 | 46834 | 77338, 107842, 138346, 168850, 199354 | 8482 | AFK74848 | 22513 | 53017 | 83521, 114025, 144529, 175033, 205537 |
| 2300 | ABX58429 | 16331 | 46835 | 77339, 107843, 138347, 168851, 199355 | 8483 | AFK74898 | 22514 | 53018 | 83522, 114026, 144530, 175034, 205538 |
| 2301 | ABX58440 | 16332 | 46836 | 77340, 107844, 138348, 168852, 199356 | 8484 | AFK74908 | 22515 | 53019 | 83523, 114027, 144531, 175035, 205539 |
| 2302 | ABX58451 | 16333 | 46837 | 77341, 107845, 138349, 168853, 199357 | 8485 | AFK74918 | 22516 | 53020 | 83524, 114028, 144532, 175036, 205540 |
| 2303 | ABX58462 | 16334 | 46838 | 77342, 107846, 138350, 168854, 199358 | 8486 | AFK74928 | 22517 | 53021 | 83525, 114029, 144533, 175037, 205541 |
| 2304 | ABX58473 | 16335 | 46839 | 77343, 107847, 138351, 168855, 199359 | 8487 | AFK74938 | 22518 | 53022 | 83526, 114030, 144534, 175038, 205542 |
| 2305 | ABX58484 | 16336 | 46840 | 77344, 107848, 138352, 168856, 199360 | 8488 | AFK74948 | 22519 | 53023 | 83527, 114031, 144535, 175039, 205543 |
| 2306 | ABX58495 | 16337 | 46841 | 77345, 107849, 138353, 168857, 199361 | 8489 | AFK74958 | 22520 | 53024 | 83528, 114032, 144536, 175040, 205544 |
| 2307 | ABX58506 | 16338 | 46842 | 77346, 107850, 138354, 168858, 199362 | 8490 | AFK74968 | 22521 | 53025 | 83529, 114033, 144537, 175041, 205545 |
| 2308 | ABX58528 | 16339 | 46843 | 77347, 107851, 138355, 168859, 199363 | 8491 | AFK74978 | 22522 | 53026 | 83530, 114034, 144538, 175042, 205546 |
| 2309 | ABX58539 | 16340 | 46844 | 77348, 107852, 138356, 168860, 199364 | 8492 | AFK74988 | 22523 | 53027 | 83531, 114035, 144539, 175043, 205547 |
| 2310 | ABX58550 | 16341 | 46845 | 77349, 107853, 138357, 168861, 199365 | 8493 | AFK74998 | 22524 | 53028 | 83532, 114036, 144540, 175044, 205548 |
| 2311 | ABX58561 | 16342 | 46846 | 77350, 107854, 138358, 168862, 199366 | 8494 | AFK75008 | 22525 | 53029 | 83533, 114037, 144541, 175045, 205549 |
| 2312 | ABX58572 | 16343 | 46847 | 77351, 107855, 138359, 168863, 199367 | 8495 | AFK75018 | 22526 | 53030 | 83534, 114038, 144542, 175046, 205550 |
| 2313 | ABX58583 | 16344 | 46848 | 77352, 107856, 138360, 168864, 199368 | 8496 | AFK75028 | 22527 | 53031 | 83535, 114039, 144543, 175047, 205551 |
| 2314 | ABX58594 | 16345 | 46849 | 77353, 107857, 138361, 168865, 199369 | 8497 | AFK75038 | 22528 | 53032 | 83536, 114040, 144544, 175048, 205552 |
| 2315 | ABX58605 | 16346 | 46850 | 77354, 107858, 138362, 168866, 199370 | 8498 | AFK75048 | 22529 | 53033 | 83537, 114041, 144545, 175049, 205553 |

FIG. 3 continued

| | | | | | | | | | |
|---|---|---|---|---|---|---|---|---|---|
| 2316 | ABX58616 | 16347 | 46851 | 77355, 107859, 138363, 168867, 199371 | 8499 | AFK75058 | 22530 | 53034 | 83538, 114042, 144546, 175050, 205554 |
| 2317 | ABX58627 | 16348 | 46852 | 77356, 107860, 138364, 168868, 199372 | 8500 | AFK75068 | 22531 | 53035 | 83539, 114043, 144547, 175051, 205555 |
| 2318 | ABX58638 | 16349 | 46853 | 77357, 107861, 138365, 168869, 199373 | 8501 | AFK75078 | 22532 | 53036 | 83540, 114044, 144548, 175052, 205556 |
| 2319 | ABX58682 | 16350 | 46854 | 77358, 107862, 138366, 168870, 199374 | 8502 | AFK75088 | 22533 | 53037 | 83541, 114045, 144549, 175053, 205557 |
| 2320 | ABX58693 | 16351 | 46855 | 77359, 107863, 138367, 168871, 199375 | 8503 | AFK75098 | 22534 | 53038 | 83542, 114046, 144550, 175054, 205558 |
| 2321 | ABX58704 | 16352 | 46856 | 77360, 107864, 138368, 168872, 199376 | 8504 | AFK75108 | 22535 | 53039 | 83543, 114047, 144551, 175055, 205559 |
| 2322 | ABX58715 | 16353 | 46857 | 77361, 107865, 138369, 168873, 199377 | 8505 | AFK77860 | 22536 | 53040 | 83544, 114048, 144552, 175056, 205560 |
| 2323 | ABY19420 | 16354 | 46858 | 77362, 107866, 138370, 168874, 199378 | 8506 | AFK77870 | 22537 | 53041 | 83545, 114049, 144553, 175057, 205561 |
| 2324 | ABY19421 | 16355 | 46859 | 77363, 107867, 138371, 168875, 199379 | 8507 | AFK77880 | 22538 | 53042 | 83546, 114050, 144554, 175058, 205562 |
| 2325 | ABY51020 | 16356 | 46860 | 77364, 107868, 138372, 168876, 199380 | 8508 | AFK77890 | 22539 | 53043 | 83547, 114051, 144555, 175059, 205563 |
| 2326 | ABY51031 | 16357 | 46861 | 77365, 107869, 138373, 168877, 199381 | 8509 | AFK77900 | 22540 | 53044 | 83548, 114052, 144556, 175060, 205564 |
| 2327 | ABY51042 | 16358 | 46862 | 77366, 107870, 138374, 168878, 199382 | 8510 | AFK78031 | 22541 | 53045 | 83549, 114053, 144557, 175061, 205565 |
| 2328 | ABY51053 | 16359 | 46863 | 77367, 107871, 138375, 168879, 199383 | 8511 | AFK78190 | 22542 | 53046 | 83550, 114054, 144558, 175062, 205566 |
| 2329 | ABY51064 | 16360 | 46864 | 77368, 107872, 138376, 168880, 199384 | 8512 | AFM68957 | 22543 | 53047 | 83551, 114055, 144559, 175063, 205567 |
| 2330 | ABY51075 | 16361 | 46865 | 77369, 107873, 138377, 168881, 199385 | 8513 | AFM68968 | 22544 | 53048 | 83552, 114056, 144560, 175064, 205568 |
| 2331 | ABY51086 | 16362 | 46866 | 77370, 107874, 138378, 168882, 199386 | 8514 | AFM68979 | 22545 | 53049 | 83553, 114057, 144561, 175065, 205569 |
| 2332 | ABY51097 | 16363 | 46867 | 77371, 107875, 138379, 168883, 199387 | 8515 | AFM68990 | 22546 | 53050 | 83554, 114058, 144562, 175066, 205570 |
| 2333 | ABY51108 | 16364 | 46868 | 77372, 107876, 138380, 168884, 199388 | 8516 | AFM71723 | 22547 | 53051 | 83555, 114059, 144563, 175067, 205571 |

FIG. 3 continued

| | | | | | | | | | |
|---|---|---|---|---|---|---|---|---|---|
| 2334 | ABY51119 | 16365 | 46869 | 77373, 107877, 138381, 168885, 199389 | 8517 | AFM71734 | 22548 | 53052 | 83556, 114060, 144564, 175068, 205572 |
| 2335 | ABY51130 | 16366 | 46870 | 77374, 107878, 138382, 168886, 199390 | 8518 | AFM71745 | 22549 | 53053 | 83557, 114061, 144565, 175069, 205573 |
| 2336 | ABY51141 | 16367 | 46871 | 77375, 107879, 138383, 168887, 199391 | 8519 | AFM71771 | 22550 | 53054 | 83558, 114062, 144566, 175070, 205574 |
| 2337 | ABY51152 | 16368 | 46872 | 77376, 107880, 138384, 168888, 199392 | 8520 | AFM71782 | 22551 | 53055 | 83559, 114063, 144567, 175071, 205575 |
| 2338 | ABY51163 | 16369 | 46873 | 77377, 107881, 138385, 168889, 199393 | 8521 | AFM71794 | 22552 | 53056 | 83560, 114064, 144568, 175072, 205576 |
| 2339 | ABY51174 | 16370 | 46874 | 77378, 107882, 138386, 168890, 199394 | 8522 | AFM71805 | 22553 | 53057 | 83561, 114065, 144569, 175073, 205577 |
| 2340 | ABY51185 | 16371 | 46875 | 77379, 107883, 138387, 168891, 199395 | 8523 | AFM71827 | 22554 | 53058 | 83562, 114066, 144570, 175074, 205578 |
| 2341 | ABY51196 | 16372 | 46876 | 77380, 107884, 138388, 168892, 199396 | 8524 | AFM71838 | 22555 | 53059 | 83563, 114067, 144571, 175075, 205579 |
| 2342 | ABY51229 | 16373 | 46877 | 77381, 107885, 138389, 168893, 199397 | 8525 | AFM71849 | 22556 | 53060 | 83564, 114068, 144572, 175076, 205580 |
| 2343 | ABY51240 | 16374 | 46878 | 77382, 107886, 138390, 168894, 199398 | 8526 | AFM71860 | 22557 | 53061 | 83565, 114069, 144573, 175077, 205581 |
| 2344 | ABY51251 | 16375 | 46879 | 77383, 107887, 138391, 168895, 199399 | 8527 | AFM71871 | 22558 | 53062 | 83566, 114070, 144574, 175078, 205582 |
| 2345 | ABY51262 | 16376 | 46880 | 77384, 107888, 138392, 168896, 199400 | 8528 | AFM71882 | 22559 | 53063 | 83567, 114071, 144575, 175079, 205583 |
| 2346 | ABY51273 | 16377 | 46881 | 77385, 107889, 138393, 168897, 199401 | 8529 | AFM71893 | 22560 | 53064 | 83568, 114072, 144576, 175080, 205584 |
| 2347 | ABY76285 | 16378 | 46882 | 77386, 107890, 138394, 168898, 199402 | 8530 | AFM71904 | 22561 | 53065 | 83569, 114073, 144577, 175081, 205585 |
| 2348 | ABY81352 | 16379 | 46883 | 77387, 107891, 138395, 168899, 199403 | 8531 | AFM71915 | 22562 | 53066 | 83570, 114074, 144578, 175082, 205586 |
| 2349 | ABY81363 | 16380 | 46884 | 77388, 107892, 138396, 168900, 199404 | 8532 | AFM71926 | 22563 | 53067 | 83571, 114075, 144579, 175083, 205587 |
| 2350 | ABY81374 | 16381 | 46885 | 77389, 107893, 138397, 168901, 199405 | 8533 | AFM71937 | 22564 | 53068 | 83572, 114076, 144580, 175084, 205588 |
| 2351 | ABY81385 | 16382 | 46886 | 77390, 107894, 138398, 168902, 199406 | 8534 | AFM71948 | 22565 | 53069 | 83573, 114077, 144581, 175085, 205589 |

FIG. 3 continued

| | | | | | | | | | |
|---|---|---|---|---|---|---|---|---|---|
| 2352 | ABY81407 | 16383 | 46887 | 77391, 107895, 138399, 168903, 199407 | 8535 | AFM71959 | 22566 | 53070 | 83574, 114078, 144582, 175086, 205590 |
| 2353 | ACA24505 | 16384 | 46888 | 77392, 107896, 138400, 168904, 199408 | 8536 | AFM71970 | 22567 | 53071 | 83575, 114079, 144583, 175087, 205591 |
| 2354 | ACA24516 | 16385 | 46889 | 77393, 107897, 138401, 168905, 199409 | 8537 | AFM71981 | 22568 | 53072 | 83576, 114080, 144584, 175088, 205592 |
| 2355 | ACA24527 | 16386 | 46890 | 77394, 107898, 138402, 168906, 199410 | 8538 | AFM71992 | 22569 | 53073 | 83577, 114081, 144585, 175089, 205593 |
| 2356 | ACA24692 | 16387 | 46891 | 77395, 107899, 138403, 168907, 199411 | 8539 | AFM72013 | 22570 | 53074 | 83578, 114082, 144586, 175090, 205594 |
| 2357 | ACA24703 | 16388 | 46892 | 77396, 107900, 138404, 168908, 199412 | 8540 | AFM72024 | 22571 | 53075 | 83579, 114083, 144587, 175091, 205595 |
| 2358 | ACA33539 | 16389 | 46893 | 77397, 107901, 138405, 168909, 199413 | 8541 | AFM72035 | 22572 | 53076 | 83580, 114084, 144588, 175092, 205596 |
| 2359 | ACA33540 | 16390 | 46894 | 77398, 107902, 138406, 168910, 199414 | 8542 | AFM72046 | 22573 | 53077 | 83581, 114085, 144589, 175093, 205597 |
| 2360 | ACA33582 | 16391 | 46895 | 77399, 107903, 138407, 168911, 199415 | 8543 | AFM72057 | 22574 | 53078 | 83582, 114086, 144590, 175094, 205598 |
| 2361 | ACA33622 | 16392 | 46896 | 77400, 107904, 138408, 168912, 199416 | 8544 | AFM72068 | 22575 | 53079 | 83583, 114087, 144591, 175095, 205599 |
| 2362 | ACA96522 | 16393 | 46897 | 77401, 107905, 138409, 168913, 199417 | 8545 | AFM72090 | 22576 | 53080 | 83584, 114088, 144592, 175096, 205600 |
| 2363 | ACC55274 | 16394 | 46898 | 77402, 107906, 138410, 168914, 199418 | 8546 | AFM72101 | 22577 | 53081 | 83585, 114089, 144593, 175097, 205601 |
| 2364 | ACC61967 | 16395 | 46899 | 77403, 107907, 138411, 168915, 199419 | 8547 | AFM72112 | 22578 | 53082 | 83586, 114090, 144594, 175098, 205602 |
| 2365 | ACD11077 | 16396 | 46900 | 77404, 107908, 138412, 168916, 199420 | 8548 | AFM72123 | 22579 | 53083 | 83587, 114091, 144595, 175099, 205603 |
| 2366 | ACD11078 | 16397 | 46901 | 77405, 107909, 138413, 168917, 199421 | 8549 | AFM72134 | 22580 | 53084 | 83588, 114092, 144596, 175100, 205604 |
| 2367 | ACD11079 | 16398 | 46902 | 77406, 107910, 138414, 168918, 199422 | 8550 | AFM72145 | 22581 | 53085 | 83589, 114093, 144597, 175101, 205605 |
| 2368 | ACD56116 | 16399 | 46903 | 77407, 107911, 138415, 168919, 199423 | 8551 | AFM72156 | 22582 | 53086 | 83590, 114094, 144598, 175102, 205606 |
| 2369 | ACD56127 | 16400 | 46904 | 77408, 107912, 138416, 168920, 199424 | 8552 | AFM72167 | 22583 | 53087 | 83591, 114095, 144599, 175103, 205607 |

FIG. 3 continued

| | | | | | | | | | |
|---|---|---|---|---|---|---|---|---|---|
| 2370 | ACD56261 | 16401 | 46905 | 77409, 107913, 138417, 168921, 199425 | 8553 | AFM72178 | 22584 | 53088 | 83592, 114096, 144600, 175104, 205608 |
| 2371 | ACD56272 | 16402 | 46906 | 77410, 107914, 138418, 168922, 199426 | 8554 | AFM72189 | 22585 | 53089 | 83593, 114097, 144601, 175105, 205609 |
| 2372 | ACD56283 | 16403 | 46907 | 77411, 107915, 138419, 168923, 199427 | 8555 | AFM72200 | 22586 | 53090 | 83594, 114098, 144602, 175106, 205610 |
| 2373 | ACD56305 | 16404 | 46908 | 77412, 107916, 138420, 168924, 199428 | 8556 | AFM72211 | 22587 | 53091 | 83595, 114099, 144603, 175107, 205611 |
| 2374 | ACD56316 | 16405 | 46909 | 77413, 107917, 138421, 168925, 199429 | 8557 | AFM72222 | 22588 | 53092 | 83596, 114100, 144604, 175108, 205612 |
| 2375 | ACD56327 | 16406 | 46910 | 77414, 107918, 138422, 168926, 199430 | 8558 | AFM72233 | 22589 | 53093 | 83597, 114101, 144605, 175109, 205613 |
| 2376 | ACD85190 | 16407 | 46911 | 77415, 107919, 138423, 168927, 199431 | 8559 | AFM72249 | 22590 | 53094 | 83598, 114102, 144606, 175110, 205614 |
| 2377 | ACD85201 | 16408 | 46912 | 77416, 107920, 138424, 168928, 199432 | 8560 | AFM72260 | 22591 | 53095 | 83599, 114103, 144607, 175111, 205615 |
| 2378 | ACD85212 | 16409 | 46913 | 77417, 107921, 138425, 168929, 199433 | 8561 | AFM72271 | 22592 | 53096 | 83600, 114104, 144608, 175112, 205616 |
| 2379 | ACD85223 | 16410 | 46914 | 77418, 107922, 138426, 168930, 199434 | 8562 | AFM72293 | 22593 | 53097 | 83601, 114105, 144609, 175113, 205617 |
| 2380 | ACD85234 | 16411 | 46915 | 77419, 107923, 138427, 168931, 199435 | 8563 | AFM72304 | 22594 | 53098 | 83602, 114106, 144610, 175114, 205618 |
| 2381 | ACD85245 | 16412 | 46916 | 77420, 107924, 138428, 168932, 199436 | 8564 | AFM72315 | 22595 | 53099 | 83603, 114107, 144611, 175115, 205619 |
| 2382 | ACD85454 | 16413 | 46917 | 77421, 107925, 138429, 168933, 199437 | 8565 | AFM72326 | 22596 | 53100 | 83604, 114108, 144612, 175116, 205620 |
| 2383 | ACD85465 | 16414 | 46918 | 77422, 107926, 138430, 168934, 199438 | 8566 | AFM72337 | 22597 | 53101 | 83605, 114109, 144613, 175117, 205621 |
| 2384 | ACD85487 | 16415 | 46919 | 77423, 107927, 138431, 168935, 199439 | 8567 | AFM72348 | 22598 | 53102 | 83606, 114110, 144614, 175118, 205622 |
| 2385 | ACD85498 | 16416 | 46920 | 77424, 107928, 138432, 168936, 199440 | 8568 | AFM72359 | 22599 | 53103 | 83607, 114111, 144615, 175119, 205623 |
| 2386 | ACD85509 | 16417 | 46921 | 77425, 107929, 138433, 168937, 199441 | 8569 | AFM72370 | 22600 | 53104 | 83608, 114112, 144616, 175120, 205624 |
| 2387 | ACD85520 | 16418 | 46922 | 77426, 107930, 138434, 168938, 199442 | 8570 | AFM72381 | 22601 | 53105 | 83609, 114113, 144617, 175121, 205625 |

FIG. 3 continued

| | | | | | | | | | |
|---|---|---|---|---|---|---|---|---|---|
| 2388 | ACD85553 | 16419 | 46923 | 77427, 107931, 138435, 168939, 199443 | 8571 | AFM72392 | 22602 | 53106 | 83610, 114114, 144618, 175122, 205626 |
| 2389 | ACD85564 | 16420 | 46924 | 77428, 107932, 138436, 168940, 199444 | 8572 | AFM72403 | 22603 | 53107 | 83611, 114115, 144619, 175123, 205627 |
| 2390 | ACD85575 | 16421 | 46925 | 77429, 107933, 138437, 168941, 199445 | 8573 | AFM72414 | 22604 | 53108 | 83612, 114116, 144620, 175124, 205628 |
| 2391 | ACD85586 | 16422 | 46926 | 77430, 107934, 138438, 168942, 199446 | 8574 | AFM72425 | 22605 | 53109 | 83613, 114117, 144621, 175125, 205629 |
| 2392 | ACD93582 | 16423 | 46927 | 77431, 107935, 138439, 168943, 199447 | 8575 | AFM72436 | 22606 | 53110 | 83614, 114118, 144622, 175126, 205630 |
| 2393 | ACF09403 | 16424 | 46928 | 77432, 107936, 138440, 168944, 199448 | 8576 | AFM72447 | 22607 | 53111 | 83615, 114119, 144623, 175127, 205631 |
| 2394 | ACF22151 | 16425 | 46929 | 77433, 107937, 138441, 168945, 199449 | 8577 | AFM72458 | 22608 | 53112 | 83616, 114120, 144624, 175128, 205632 |
| 2395 | ACF22246 | 16426 | 46930 | 77434, 107938, 138442, 168946, 199450 | 8578 | AFM72469 | 22609 | 53113 | 83617, 114121, 144625, 175129, 205633 |
| 2396 | ACF22257 | 16427 | 46931 | 77435, 107939, 138443, 168947, 199451 | 8579 | AFM72491 | 22610 | 53114 | 83618, 114122, 144626, 175130, 205634 |
| 2397 | ACF22279 | 16428 | 46932 | 77436, 107940, 138444, 168948, 199452 | 8580 | AFM72502 | 22611 | 53115 | 83619, 114123, 144627, 175131, 205635 |
| 2398 | ACF22290 | 16429 | 46933 | 77437, 107941, 138445, 168949, 199453 | 8581 | AFM72513 | 22612 | 53116 | 83620, 114124, 144628, 175132, 205636 |
| 2399 | ACF22301 | 16430 | 46934 | 77438, 107942, 138446, 168950, 199454 | 8582 | AFM72524 | 22613 | 53117 | 83621, 114125, 144629, 175133, 205637 |
| 2400 | ACF22312 | 16431 | 46935 | 77439, 107943, 138447, 168951, 199455 | 8583 | AFM72535 | 22614 | 53118 | 83622, 114126, 144630, 175134, 205638 |
| 2401 | ACF22323 | 16432 | 46936 | 77440, 107944, 138448, 168952, 199456 | 8584 | AFM72546 | 22615 | 53119 | 83623, 114127, 144631, 175135, 205639 |
| 2402 | ACF22334 | 16433 | 46937 | 77441, 107945, 138449, 168953, 199457 | 8585 | AFM72557 | 22616 | 53120 | 83624, 114128, 144632, 175136, 205640 |
| 2403 | ACF22367 | 16434 | 46938 | 77442, 107946, 138450, 168954, 199458 | 8586 | AFM72579 | 22617 | 53121 | 83625, 114129, 144633, 175137, 205641 |
| 2404 | ACF22378 | 16435 | 46939 | 77443, 107947, 138451, 168955, 199459 | 8587 | AFM72802 | 22618 | 53122 | 83626, 114130, 144634, 175138, 205642 |
| 2405 | ACF22389 | 16436 | 46940 | 77444, 107948, 138452, 168956, 199460 | 8588 | AFM72813 | 22619 | 53123 | 83627, 114131, 144635, 175139, 205643 |

FIG. 3 continued

| | | | | | | | | | |
|---|---|---|---|---|---|---|---|---|---|
| 2406 | ACF22400 | 16437 | 46941 | 77445, 107949, 138453, 168957, 199461 | 8589 | AFM72824 | 22620 | 53124 | 83628, 114132, 144636, 175140. 205644 |
| 2407 | ACF22411 | 16438 | 46942 | 77446, 107950, 138454, 168958, 199462 | 8590 | AFM72835 | 22621 | 53125 | 83629, 114133, 144637, 175141, 205645 |
| 2408 | ACF33772 | 16439 | 46943 | 77447, 107951, 138455, 168959, 199463 | 8591 | AFM72845 | 22622 | 53126 | 83630, 114134, 144638, 175142, 205646 |
| 2409 | ACF33778 | 16440 | 46944 | 77448, 107952, 138456, 168960, 199464 | 8592 | AFM72855 | 22623 | 53127 | 83631, 114135, 144639, 175143, 205647 |
| 2410 | ACF33785 | 16441 | 46945 | 77449, 107953, 138457, 168961, 199465 | 8593 | AFM72865 | 22624 | 53128 | 83632, 114136, 144640, 175144, 205648 |
| 2411 | ACF33787 | 16442 | 46946 | 77450, 107954, 138458, 168962, 199466 | 8594 | AFM72875 | 22625 | 53129 | 83633, 114137, 144641, 175145, 205649 |
| 2412 | ACF33798 | 16443 | 46947 | 77451, 107955, 138459, 168963, 199467 | 8595 | AFM72886 | 22626 | 53130 | 83634, 114138, 144642, 175146, 205650 |
| 2413 | ACF41672 | 16444 | 46948 | 77452, 107956, 138460, 168964, 199468 | 8596 | AFM72897 | 22627 | 53131 | 83635, 114139, 144643, 175147, 205651 |
| 2414 | ACF41683 | 16445 | 46949 | 77453, 107957, 138461, 168965, 199469 | 8597 | AFM72908 | 22628 | 53132 | 83636, 114140, 144644, 175148, 205652 |
| 2415 | ACF41749 | 16446 | 46950 | 77454, 107958, 138462, 168966, 199470 | 8598 | AFM72919 | 22629 | 53133 | 83637, 114141, 144645, 175149, 205653 |
| 2416 | ACF41760 | 16447 | 46951 | 77455, 107959, 138463, 168967, 199471 | 8599 | AFM72930 | 22630 | 53134 | 83638, 114142, 144646, 175150, 205654 |
| 2417 | ACF41771 | 16448 | 46952 | 77456, 107960, 138464, 168968, 199472 | 8600 | AFM72941 | 22631 | 53135 | 83639, 114143, 144647, 175151, 205655 |
| 2418 | ACF41793 | 16449 | 46953 | 77457, 107961, 138465, 168969, 199473 | 8601 | AFM72952 | 22632 | 53136 | 83640, 114144, 144648, 175152, 205656 |
| 2419 | ACF41804 | 16450 | 46954 | 77458, 107962, 138466, 168970, 199474 | 8602 | AFM72963 | 22633 | 53137 | 83641, 114145, 144649, 175153, 205657 |
| 2420 | ACF41826 | 16451 | 46955 | 77459, 107963, 138467, 168971, 199475 | 8603 | AFM72974 | 22634 | 53138 | 83642, 114146, 144650, 175154, 205658 |
| 2421 | ACF41837 | 16452 | 46956 | 77460, 107964, 138468, 168972, 199476 | 8604 | AFM72985 | 22635 | 53139 | 83643, 114147, 144651, 175155, 205659 |
| 2422 | ACF41881 | 16453 | 46957 | 77461, 107965, 138469, 168973, 199477 | 8605 | AFM72996 | 22636 | 53140 | 83644, 114148, 144652, 175156, 205660 |
| 2423 | ACF41892 | 16454 | 46958 | 77462, 107966, 138470, 168974, 199478 | 8606 | AFM73007 | 22637 | 53141 | 83645, 114149, 144653, 175157, 205661 |

FIG. 3 continued

| | | | | | | | | | |
|---|---|---|---|---|---|---|---|---|---|
| 2424 | ACF41903 | 16455 | 46959 | 77463, 107967, 138471, 168975, 199479 | 8607 | AFM73018 | 22638 | 53142 | 83646, 114150, 144654, 175158, 205662 |
| 2425 | ACF41914 | 16456 | 46960 | 77464, 107968, 138472, 168976, 199480 | 8608 | AFM73028 | 22639 | 53143 | 83647, 114151, 144655, 175159, 205663 |
| 2426 | ACF41925 | 16457 | 46961 | 77465, 107969, 138473, 168977, 199481 | 8609 | AFM73038 | 22640 | 53144 | 83648, 114152, 144656, 175160, 205664 |
| 2427 | ACF41936 | 16458 | 46962 | 77466, 107970, 138474, 168978, 199482 | 8610 | AFM73048 | 22641 | 53145 | 83649, 114153, 144657, 175161, 205665 |
| 2428 | ACF54392 | 16459 | 46963 | 77467, 107971, 138475, 168979, 199483 | 8611 | AFM73058 | 22642 | 53146 | 83650, 114154, 144658, 175162, 205666 |
| 2429 | ACF54403 | 16460 | 46964 | 77468, 107972, 138476, 168980, 199484 | 8612 | AFM73068 | 22643 | 53147 | 83651, 114155, 144659, 175163, 205667 |
| 2430 | ACF54414 | 16461 | 46965 | 77469, 107973, 138477, 168981, 199485 | 8613 | AFM73480 | 22644 | 53148 | 83652, 114156, 144660, 175164, 205668 |
| 2431 | ACF54425 | 16462 | 46966 | 77470, 107974, 138478, 168982, 199486 | 8614 | AFM78569 | 22645 | 53149 | 83653, 114157, 144661, 175165, 205669 |
| 2432 | ACF54436 | 16463 | 46967 | 77471, 107975, 138479, 168983, 199487 | 8615 | AFM85180 | 22646 | 53150 | 83654, 114158, 144662, 175166, 205670 |
| 2433 | ACF54447 | 16464 | 46968 | 77472, 107976, 138480, 168984, 199488 | 8616 | AFN11830 | 22647 | 53151 | 83655, 114159, 144663, 175167, 205671 |
| 2434 | ACF54469 | 16465 | 46969 | 77473, 107977, 138481, 168985, 199489 | 8617 | AFN11831 | 22648 | 53152 | 83656, 114160, 144664, 175168, 205672 |
| 2435 | ACF54480 | 16466 | 46970 | 77474, 107978, 138482, 168986, 199490 | 8618 | AFN11833 | 22649 | 53153 | 83657, 114161, 144665, 175169, 205673 |
| 2436 | ACF54502 | 16467 | 46971 | 77475, 107979, 138483, 168987, 199491 | 8619 | AFN11835 | 22650 | 53154 | 83658, 114162, 144666, 175170, 205674 |
| 2437 | ACF54513 | 16468 | 46972 | 77476, 107980, 138484, 168988, 199492 | 8620 | AFN11836 | 22651 | 53155 | 83659, 114163, 144667, 175171, 205675 |
| 2438 | ACF54524 | 16469 | 46973 | 77477, 107981, 138485, 168989, 199493 | 8621 | AFN11839 | 22652 | 53156 | 83660, 114164, 144668, 175172, 205676 |
| 2439 | ACF54535 | 16470 | 46974 | 77478, 107982, 138486, 168990, 199494 | 8622 | AFN11840 | 22653 | 53157 | 83661, 114165, 144669, 175173, 205677 |
| 2440 | ACF54557 | 16471 | 46975 | 77479, 107983, 138487, 168991, 199495 | 8623 | AFN11841 | 22654 | 53158 | 83662, 114166, 144670, 175174, 205678 |
| 2441 | ACF54568 | 16472 | 46976 | 77480, 107984, 138488, 168992, 199496 | 8624 | AFN11842 | 22655 | 53159 | 83663, 114167, 144671, 175175, 205679 |

FIG. 3 continued

| | | | | | | | | | |
|---|---|---|---|---|---|---|---|---|---|
| 2442 | ACF54579 | 16473 | 46977 | 77481, 107985, 138489, 168993, 199497 | 8625 | AFN11844 | 22656 | 53160 | 83664, 114168, 144672, 175176, 205680 |
| 2443 | ACF54601 | 16474 | 46978 | 77482, 107986, 138490, 168994, 199498 | 8626 | AFN11845 | 22657 | 53161 | 83665, 114169, 144673, 175177, 205681 |
| 2444 | ACG50700 | 16475 | 46979 | 77483, 107987, 138491, 168995, 199499 | 8627 | AFN11847 | 22658 | 53162 | 83666, 114170, 144674, 175178, 205682 |
| 2445 | ACG70145 | 16476 | 46980 | 77484, 107988, 138492, 168996, 199500 | 8628 | AFN11848 | 22659 | 53163 | 83667, 114171, 144675, 175179, 205683 |
| 2446 | ACG70156 | 16477 | 46981 | 77485, 107989, 138493, 168997, 199501 | 8629 | AFN11850 | 22660 | 53164 | 83668, 114172, 144676, 175180, 205684 |
| 2447 | ACG80407 | 16478 | 46982 | 77486, 107990, 138494, 168998, 199502 | 8630 | AFN11851 | 22661 | 53165 | 83669, 114173, 144677, 175181, 205685 |
| 2448 | ACG80411 | 16479 | 46983 | 77487, 107991, 138495, 168999, 199503 | 8631 | AFN11853 | 22662 | 53166 | 83670, 114174, 144678, 175182, 205686 |
| 2449 | ACG80421 | 16480 | 46984 | 77488, 107992, 138496, 169000, 199504 | 8632 | AFN11855 | 22663 | 53167 | 83671, 114175, 144679, 175183, 205687 |
| 2450 | ACG80427 | 16481 | 46985 | 77489, 107993, 138497, 169001, 199505 | 8633 | AFN11857 | 22664 | 53168 | 83672, 114176, 144680, 175184, 205688 |
| 2451 | ACG80437 | 16482 | 46986 | 77490, 107994, 138498, 169002, 199506 | 8634 | AFN17373 | 22665 | 53169 | 83673, 114177, 144681, 175185, 205689 |
| 2452 | ACG80446 | 16483 | 46987 | 77491, 107995, 138499, 169003, 199507 | 8635 | AFN17383 | 22666 | 53170 | 83674, 114178, 144682, 175186, 205690 |
| 2453 | ACG80455 | 16484 | 46988 | 77492, 107996, 138500, 169004, 199508 | 8636 | AFN17393 | 22667 | 53171 | 83675, 114179, 144683, 175187, 205691 |
| 2454 | ACG80464 | 16485 | 46989 | 77493, 107997, 138501, 169005, 199509 | 8637 | AFN17403 | 22668 | 53172 | 83676, 114180, 144684, 175188, 205692 |
| 2455 | ACG80473 | 16486 | 46990 | 77494, 107998, 138502, 169006, 199510 | 8638 | AFN17413 | 22669 | 53173 | 83677, 114181, 144685, 175189, 205693 |
| 2456 | ACH69559 | 16487 | 46991 | 77495, 107999, 138503, 169007, 199511 | 8639 | AFN17423 | 22670 | 53174 | 83678, 114182, 144686, 175190, 205694 |
| 2457 | ACH69570 | 16488 | 46992 | 77496, 108000, 138504, 169008, 199512 | 8640 | AFN17433 | 22671 | 53175 | 83679, 114183, 144687, 175191, 205695 |
| 2458 | ACH69581 | 16489 | 46993 | 77497, 108001, 138505, 169009, 199513 | 8641 | AFN17443 | 22672 | 53176 | 83680, 114184, 144688, 175192, 205696 |
| 2459 | ACH69592 | 16490 | 46994 | 77498, 108002, 138506, 169010, 199514 | 8642 | AFN17453 | 22673 | 53177 | 83681, 114185, 144689, 175193, 205697 |

FIG. 3 continued

| | | | | | | | | | |
|---|---|---|---|---|---|---|---|---|---|
| 2460 | ACH69603 | 16491 | 46995 | 77499, 108003, 138507, 169011, 199515 | 8643 | AFN17459 | 22674 | 53178 | 83682, 114186, 144690, 175194, 205698 |
| 2461 | ACH69614 | 16492 | 46996 | 77500, 108004, 138508, 169012, 199516 | 8644 | AFN17469 | 22675 | 53179 | 83683, 114187, 144691, 175195, 205699 |
| 2462 | ACI22525 | 16493 | 46997 | 77501, 108005, 138509, 169013, 199517 | 8645 | AFN17479 | 22676 | 53180 | 83684, 114188, 144692, 175196, 205700 |
| 2463 | ACI22526 | 16494 | 46998 | 77502, 108006, 138510, 169014, 199518 | 8646 | AFN17489 | 22677 | 53181 | 83685, 114189, 144693, 175197, 205701 |
| 2464 | ACI22527 | 16495 | 46999 | 77503, 108007, 138511, 169015, 199519 | 8647 | AFN17499 | 22678 | 53182 | 83686, 114190, 144694, 175198, 205702 |
| 2465 | ACI22528 | 16496 | 47000 | 77504, 108008, 138512, 169016, 199520 | 8648 | AFN17509 | 22679 | 53183 | 83687, 114191, 144695, 175199, 205703 |
| 2466 | ACI22529 | 16497 | 47001 | 77505, 108009, 138513, 169017, 199521 | 8649 | AFN17519 | 22680 | 53184 | 83688, 114192, 144696, 175200, 205704 |
| 2467 | ACI22530 | 16498 | 47002 | 77506, 108010, 138514, 169018, 199522 | 8650 | AFN17529 | 22681 | 53185 | 83689, 114193, 144697, 175201, 205705 |
| 2468 | ACI22532 | 16499 | 47003 | 77507, 108011, 138515, 169019, 199523 | 8651 | AFN17539 | 22682 | 53186 | 83690, 114194, 144698, 175202, 205706 |
| 2469 | ACI22533 | 16500 | 47004 | 77508, 108012, 138516, 169020, 199524 | 8652 | AFN17549 | 22683 | 53187 | 83691, 114195, 144699, 175203, 205707 |
| 2470 | ACI22534 | 16501 | 47005 | 77509, 108013, 138517, 169021, 199525 | 8653 | AFN17559 | 22684 | 53188 | 83692, 114196, 144700, 175204, 205708 |
| 2471 | ACI25727 | 16502 | 47006 | 77510, 108014, 138518, 169022, 199526 | 8654 | AFN17569 | 22685 | 53189 | 83693, 114197, 144701, 175205, 205709 |
| 2472 | ACI25749 | 16503 | 47007 | 77511, 108015, 138519, 169023, 199527 | 8655 | AFN17575 | 22686 | 53190 | 83694, 114198, 144702, 175206, 205710 |
| 2473 | ACI25760 | 16504 | 47008 | 77512, 108016, 138520, 169024, 199528 | 8656 | AFN17581 | 22687 | 53191 | 83695, 114199, 144703, 175207, 205711 |
| 2474 | ACI25771 | 16505 | 47009 | 77513, 108017, 138521, 169025, 199529 | 8657 | AFN17587 | 22688 | 53192 | 83696, 114200, 144704, 175208, 205712 |
| 2475 | ACI25782 | 16506 | 47010 | 77514, 108018, 138522, 169026, 199530 | 8658 | AFN17597 | 22689 | 53193 | 83697, 114201, 144705, 175209, 205713 |
| 2476 | ACI25793 | 16507 | 47011 | 77515, 108019, 138523, 169027, 199531 | 8659 | AFN17607 | 22690 | 53194 | 83698, 114202, 144706, 175210, 205714 |
| 2477 | ACI25804 | 16508 | 47012 | 77516, 108020, 138524, 169028, 199532 | 8660 | AFN17617 | 22691 | 53195 | 83699, 114203, 144707, 175211, 205715 |

FIG. 3 continued

| | | | | | | | | | |
|---|---|---|---|---|---|---|---|---|---|
| 2478 | ACI26277 | 16509 | 47013 | 77517, 108021, 138525, 169029, 199533 | 8661 | AFN17627 | 22692 | 53196 | 83700, 114204, 144708, 175212, 205716 |
| 2479 | ACI26299 | 16510 | 47014 | 77518, 108022, 138526, 169030, 199534 | 8662 | AFN17637 | 22693 | 53197 | 83701, 114205, 144709, 175213, 205717 |
| 2480 | ACI26321 | 16511 | 47015 | 77519, 108023, 138527, 169031, 199535 | 8663 | AFN17647 | 22694 | 53198 | 83702, 114206, 144710, 175214, 205718 |
| 2481 | ACI26354 | 16512 | 47016 | 77520, 108024, 138528, 169032, 199536 | 8664 | AFN17657 | 22695 | 53199 | 83703, 114207, 144711, 175215, 205719 |
| 2482 | ACI26365 | 16513 | 47017 | 77521, 108025, 138529, 169033, 199537 | 8665 | AFN17667 | 22696 | 53200 | 83704, 114208, 144712, 175216, 205720 |
| 2483 | ACI26376 | 16514 | 47018 | 77522, 108026, 138530, 169034, 199538 | 8666 | AFN17677 | 22697 | 53201 | 83705, 114209, 144713, 175217, 205721 |
| 2484 | ACI26387 | 16515 | 47019 | 77523, 108027, 138531, 169035, 199539 | 8667 | AFN17687 | 22698 | 53202 | 83706, 114210, 144714, 175218, 205722 |
| 2485 | ACI26420 | 16516 | 47020 | 77524, 108028, 138532, 169036, 199540 | 8668 | AFN17697 | 22699 | 53203 | 83707, 114211, 144715, 175219, 205723 |
| 2486 | ACI26431 | 16517 | 47021 | 77525, 108029, 138533, 169037, 199541 | 8669 | AFN17707 | 22700 | 53204 | 83708, 114212, 144716, 175220, 205724 |
| 2487 | ACI26442 | 16518 | 47022 | 77526, 108030, 138534, 169038, 199542 | 8670 | AFN17717 | 22701 | 53205 | 83709, 114213, 144717, 175221, 205725 |
| 2488 | ACI26453 | 16519 | 47023 | 77527, 108031, 138535, 169039, 199543 | 8671 | AFN17727 | 22702 | 53206 | 83710, 114214, 144718, 175222, 205726 |
| 2489 | ACI26464 | 16520 | 47024 | 77528, 108032, 138536, 169040, 199544 | 8672 | AFN17737 | 22703 | 53207 | 83711, 114215, 144719, 175223, 205727 |
| 2490 | ACI26475 | 16521 | 47025 | 77529, 108033, 138537, 169041, 199545 | 8673 | AFN17743 | 22704 | 53208 | 83712, 114216, 144720, 175224, 205728 |
| 2491 | ACI26486 | 16522 | 47026 | 77530, 108034, 138538, 169042, 199546 | 8674 | AFN17749 | 22705 | 53209 | 83713, 114217, 144721, 175225, 205729 |
| 2492 | ACI26497 | 16523 | 47027 | 77531, 108035, 138539, 169043, 199547 | 8675 | AFN17759 | 22706 | 53210 | 83714, 114218, 144722, 175226, 205730 |
| 2493 | ACI26508 | 16524 | 47028 | 77532, 108036, 138540, 169044, 199548 | 8676 | AFN17769 | 22707 | 53211 | 83715, 114219, 144723, 175227, 205731 |
| 2494 | ACI26519 | 16525 | 47029 | 77533, 108037, 138541, 169045, 199549 | 8677 | AFN17775 | 22708 | 53212 | 83716, 114220, 144724, 175228, 205732 |
| 2495 | ACI26530 | 16526 | 47030 | 77534, 108038, 138542, 169046, 199550 | 8678 | AFN17785 | 22709 | 53213 | 83717, 114221, 144725, 175229, 205733 |

FIG. 3 continued

| | | | | | | | | | |
|---|---|---|---|---|---|---|---|---|---|
| 2496 | ACI26541 | 16527 | 47031 | 77535, 108039, 138543, 169047, 199551 | 8679 | AFN17795 | 22710 | 53214 | 83718, 114222, 144726, 175230, 205734 |
| 2497 | ACI26552 | 16528 | 47032 | 77536, 108040, 138544, 169048, 199552 | 8680 | AFN17805 | 22711 | 53215 | 83719, 114223, 144727, 175231, 205735 |
| 2498 | ACI26574 | 16529 | 47033 | 77537, 108041, 138545, 169049, 199553 | 8681 | AFN17815 | 22712 | 53216 | 83720, 114224, 144728, 175232, 205736 |
| 2499 | ACI26585 | 16530 | 47034 | 77538, 108042, 138546, 169050, 199554 | 8682 | AFN17825 | 22713 | 53217 | 83721, 114225, 144729, 175233, 205737 |
| 2500 | ACI32764 | 16531 | 47035 | 77539, 108043, 138547, 169051, 199555 | 8683 | AFN17835 | 22714 | 53218 | 83722, 114226, 144730, 175234, 205738 |
| 2501 | ACI32765 | 16532 | 47036 | 77540, 108044, 138548, 169052, 199556 | 8684 | AFN17845 | 22715 | 53219 | 83723, 114227, 144731, 175235, 205739 |
| 2502 | ACI32766 | 16533 | 47037 | 77541, 108045, 138549, 169053, 199557 | 8685 | AFN17855 | 22716 | 53220 | 83724, 114228, 144732, 175236, 205740 |
| 2503 | ACI32767 | 16534 | 47038 | 77542, 108046, 138550, 169054, 199558 | 8686 | AFN17865 | 22717 | 53221 | 83725, 114229, 144733, 175237, 205741 |
| 2504 | ACI32768 | 16535 | 47039 | 77543, 108047, 138551, 169055, 199559 | 8687 | AFN17875 | 22718 | 53222 | 83726, 114230, 144734, 175238, 205742 |
| 2505 | ACI32769 | 16536 | 47040 | 77544, 108048, 138552, 169056, 199560 | 8688 | AFN17885 | 22719 | 53223 | 83727, 114231, 144735, 175239, 205743 |
| 2506 | ACI32770 | 16537 | 47041 | 77545, 108049, 138553, 169057, 199561 | 8689 | AFN17895 | 22720 | 53224 | 83728, 114232, 144736, 175240, 205744 |
| 2507 | ACI32771 | 16538 | 47042 | 77546, 108050, 138554, 169058, 199562 | 8690 | AFN17905 | 22721 | 53225 | 83729, 114233, 144737, 175241, 205745 |
| 2508 | ACI32772 | 16539 | 47043 | 77547, 108051, 138555, 169059, 199563 | 8691 | AFN17911 | 22722 | 53226 | 83730, 114234, 144738, 175242, 205746 |
| 2509 | ACI32773 | 16540 | 47044 | 77548, 108052, 138556, 169060, 199564 | 8692 | AFN17921 | 22723 | 53227 | 83731, 114235, 144739, 175243, 205747 |
| 2510 | ACI32774 | 16541 | 47045 | 77549, 108053, 138557, 169061, 199565 | 8693 | AFN17931 | 22724 | 53228 | 83732, 114236, 144740, 175244, 205748 |
| 2511 | ACI32775 | 16542 | 47046 | 77550, 108054, 138558, 169062, 199566 | 8694 | AFN17941 | 22725 | 53229 | 83733, 114237, 144741, 175245, 205749 |
| 2512 | ACI32776 | 16543 | 47047 | 77551, 108055, 138559, 169063, 199567 | 8695 | AFN17951 | 22726 | 53230 | 83734, 114238, 144742, 175246, 205750 |
| 2513 | ACI32777 | 16544 | 47048 | 77552, 108056, 138560, 169064, 199568 | 8696 | AFN17961 | 22727 | 53231 | 83735, 114239, 144743, 175247, 205751 |

FIG. 3 continued

| | | | | | | | | | |
|---|---|---|---|---|---|---|---|---|---|
| 2514 | ACI32778 | 16545 | 47049 | 77553, 108057, 138561, 169065, 199569 | 8697 | AFN17971 | 22728 | 53232 | 83736, 114240, 144744, 175248, 205752 |
| 2515 | ACI32779 | 16546 | 47050 | 77554, 108058, 138562, 169066, 199570 | 8698 | AFN17981 | 22729 | 53233 | 83737, 114241, 144745, 175249, 205753 |
| 2516 | ACI32780 | 16547 | 47051 | 77555, 108059, 138563, 169067, 199571 | 8699 | AFN17991 | 22730 | 53234 | 83738, 114242, 144746, 175250, 205754 |
| 2517 | ACI32781 | 16548 | 47052 | 77556, 108060, 138564, 169068, 199572 | 8700 | AFN18001 | 22731 | 53235 | 83739, 114243, 144747, 175251, 205755 |
| 2518 | ACI32782 | 16549 | 47053 | 77557, 108061, 138565, 169069, 199573 | 8701 | AFN18011 | 22732 | 53236 | 83740, 114244, 144748, 175252, 205756 |
| 2519 | ACI32783 | 16550 | 47054 | 77558, 108062, 138566, 169070, 199574 | 8702 | AFN18021 | 22733 | 53237 | 83741, 114245, 144749, 175253, 205757 |
| 2520 | ACI32784 | 16551 | 47055 | 77559, 108063, 138567, 169071, 199575 | 8703 | AFN18031 | 22734 | 53238 | 83742, 114246, 144750, 175254, 205758 |
| 2521 | ACI32785 | 16552 | 47056 | 77560, 108064, 138568, 169072, 199576 | 8704 | AFN18041 | 22735 | 53239 | 83743, 114247, 144751, 175255, 205759 |
| 2522 | ACI32787 | 16553 | 47057 | 77561, 108065, 138569, 169073, 199577 | 8705 | AFN18051 | 22736 | 53240 | 83744, 114248, 144752, 175256, 205760 |
| 2523 | ACI32788 | 16554 | 47058 | 77562, 108066, 138570, 169074, 199578 | 8706 | AFN18061 | 22737 | 53241 | 83745, 114249, 144753, 175257, 205761 |
| 2524 | ACI32790 | 16555 | 47059 | 77563, 108067, 138571, 169075, 199579 | 8707 | AFN18070 | 22738 | 53242 | 83746, 114250, 144754, 175258, 205762 |
| 2525 | ACI32791 | 16556 | 47060 | 77564, 108068, 138572, 169076, 199580 | 8708 | AFN18080 | 22739 | 53243 | 83747, 114251, 144755, 175259, 205763 |
| 2526 | ACI32793 | 16557 | 47061 | 77565, 108069, 138573, 169077, 199581 | 8709 | AFN18090 | 22740 | 53244 | 83748, 114252, 144756, 175260, 205764 |
| 2527 | ACI32794 | 16558 | 47062 | 77566, 108070, 138574, 169078, 199582 | 8710 | AFN18100 | 22741 | 53245 | 83749, 114253, 144757, 175261, 205765 |
| 2528 | ACI32795 | 16559 | 47063 | 77567, 108071, 138575, 169079, 199583 | 8711 | AFN18106 | 22742 | 53246 | 83750, 114254, 144758, 175262, 205766 |
| 2529 | ACI32796 | 16560 | 47064 | 77568, 108072, 138576, 169080, 199584 | 8712 | AFN18108 | 22743 | 53247 | 83751, 114255, 144759, 175263, 205767 |
| 2530 | ACI32797 | 16561 | 47065 | 77569, 108073, 138577, 169081, 199585 | 8713 | AFN18118 | 22744 | 53248 | 83752, 114256, 144760, 175264, 205768 |
| 2531 | ACI32798 | 16562 | 47066 | 77570, 108074, 138578, 169082, 199586 | 8714 | AFN18120 | 22745 | 53249 | 83753, 114257, 144761, 175265, 205769 |

FIG. 3 continued

| | | | | | | | | | |
|---|---|---|---|---|---|---|---|---|---|
| 2532 | ACI32799 | 16563 | 47067 | 77571, 108075, 138579, 169083, 199587 | 8715 | AFN18122 | 22746 | 53250 | 83754, 114258, 144762, 175266, 205770 |
| 2533 | ACI32800 | 16564 | 47068 | 77572, 108076, 138580, 169084, 199588 | 8716 | AFN18128 | 22747 | 53251 | 83755, 114259, 144763, 175267, 205771 |
| 2534 | ACI32802 | 16565 | 47069 | 77573, 108077, 138581, 169085, 199589 | 8717 | AFN18134 | 22748 | 53252 | 83756, 114260, 144764, 175268, 205772 |
| 2535 | ACI32803 | 16566 | 47070 | 77574, 108078, 138582, 169086, 199590 | 8718 | AFN18136 | 22749 | 53253 | 83757, 114261, 144765, 175269, 205773 |
| 2536 | ACI32804 | 16567 | 47071 | 77575, 108079, 138583, 169087, 199591 | 8719 | AFN18138 | 22750 | 53254 | 83758, 114262, 144766, 175270, 205774 |
| 2537 | ACI32805 | 16568 | 47072 | 77576, 108080, 138584, 169088, 199592 | 8720 | AFN18140 | 22751 | 53255 | 83759, 114263, 144767, 175271, 205775 |
| 2538 | ACI32806 | 16569 | 47073 | 77577, 108081, 138585, 169089, 199593 | 8721 | AFN18144 | 22752 | 53256 | 83760, 114264, 144768, 175272, 205776 |
| 2539 | ACI32807 | 16570 | 47074 | 77578, 108082, 138586, 169090, 199594 | 8722 | AFN18150 | 22753 | 53257 | 83761, 114265, 144769, 175273, 205777 |
| 2540 | ACI32808 | 16571 | 47075 | 77579, 108083, 138587, 169091, 199595 | 8723 | AFN18156 | 22754 | 53258 | 83762, 114266, 144770, 175274, 205778 |
| 2541 | ACI32809 | 16572 | 47076 | 77580, 108084, 138588, 169092, 199596 | 8724 | AFN18158 | 22755 | 53259 | 83763, 114267, 144771, 175275, 205779 |
| 2542 | ACI32810 | 16573 | 47077 | 77581, 108085, 138589, 169093, 199597 | 8725 | AFN18160 | 22756 | 53260 | 83764, 114268, 144772, 175276, 205780 |
| 2543 | ACI32811 | 16574 | 47078 | 77582, 108086, 138590, 169094, 199598 | 8726 | AFN18166 | 22757 | 53261 | 83765, 114269, 144773, 175277, 205781 |
| 2544 | ACI32812 | 16575 | 47079 | 77583, 108087, 138591, 169095, 199599 | 8727 | AFN18172 | 22758 | 53262 | 83766, 114270, 144774, 175278, 205782 |
| 2545 | ACI32814 | 16576 | 47080 | 77584, 108088, 138592, 169096, 199600 | 8728 | AFN18178 | 22759 | 53263 | 83767, 114271, 144775, 175279, 205783 |
| 2546 | ACJ53848 | 16577 | 47081 | 77585, 108089, 138593, 169097, 199601 | 8729 | AFN18184 | 22760 | 53264 | 83768, 114272, 144776, 175280, 205784 |
| 2547 | ACJ53849 | 16578 | 47082 | 77586, 108090, 138594, 169098, 199602 | 8730 | AFN18190 | 22761 | 53265 | 83769, 114273, 144777, 175281, 205785 |
| 2548 | ACJ53853 | 16579 | 47083 | 77587, 108091, 138595, 169099, 199603 | 8731 | AFN18196 | 22762 | 53266 | 83770, 114274, 144778, 175282, 205786 |
| 2549 | ACJ53866 | 16580 | 47084 | 77588, 108092, 138596, 169100, 199604 | 8732 | AFN18202 | 22763 | 53267 | 83771, 114275, 144779, 175283, 205787 |

FIG. 3 continued

| | | | | | | | | | |
|---|---|---|---|---|---|---|---|---|---|
| 2550 | ACJ53867 | 16581 | 47085 | 77589, 108093, 138597, 169101, 199605 | 8733 | AFN18208 | 22764 | 53268 | 83772, 114276, 144780, 175284, 205788 |
| 2551 | ACJ53875 | 16582 | 47086 | 77590, 108094, 138598, 169102, 199606 | 8734 | AFN18210 | 22765 | 53269 | 83773, 114277, 144781, 175285, 205789 |
| 2552 | ACJ53876 | 16583 | 47087 | 77591, 108095, 138599, 169103, 199607 | 8735 | AFN18216 | 22766 | 53270 | 83774, 114278, 144782, 175286, 205790 |
| 2553 | ACJ67535 | 16584 | 47088 | 77592, 108096, 138600, 169104, 199608 | 8736 | AFN18226 | 22767 | 53271 | 83775, 114279, 144783, 175287, 205791 |
| 2554 | ACK99424 | 16585 | 47089 | 77593, 108097, 138601, 169105, 199609 | 8737 | AFN18232 | 22768 | 53272 | 83776, 114280, 144784, 175288, 205792 |
| 2555 | ACK99435 | 16586 | 47090 | 77594, 108098, 138602, 169106, 199610 | 8738 | AFN18234 | 22769 | 53273 | 83777, 114281, 144785, 175289, 205793 |
| 2556 | ACK99446 | 16587 | 47091 | 77595, 108099, 138603, 169107, 199611 | 8739 | AFN18244 | 22770 | 53274 | 83778, 114282, 144786, 175290, 205794 |
| 2557 | ACK99457 | 16588 | 47092 | 77596, 108100, 138604, 169108, 199612 | 8740 | AFN18246 | 22771 | 53275 | 83779, 114283, 144787, 175291, 205795 |
| 2558 | ACK99468 | 16589 | 47093 | 77597, 108101, 138605, 169109, 199613 | 8741 | AFN18256 | 22772 | 53276 | 83780, 114284, 144788, 175292, 205796 |
| 2559 | ACK99479 | 16590 | 47094 | 77598, 108102, 138606, 169110, 199614 | 8742 | AFN18262 | 22773 | 53277 | 83781, 114285, 144789, 175293, 205797 |
| 2560 | ACL12066 | 16591 | 47095 | 77599, 108103, 138607, 169111, 199615 | 8743 | AFN18268 | 22774 | 53278 | 83782, 114286, 144790, 175294, 205798 |
| 2561 | ACL12132 | 16592 | 47096 | 77600, 108104, 138608, 169112, 199616 | 8744 | AFN18270 | 22775 | 53279 | 83783, 114287, 144791, 175295, 205799 |
| 2562 | ACL12154 | 16593 | 47097 | 77601, 108105, 138609, 169113, 199617 | 8745 | AFN18272 | 22776 | 53280 | 83784, 114288, 144792, 175296, 205800 |
| 2563 | ACL12165 | 16594 | 47098 | 77602, 108106, 138610, 169114, 199618 | 8746 | AFN18274 | 22777 | 53281 | 83785, 114289, 144793, 175297, 205801 |
| 2564 | ACL12176 | 16595 | 47099 | 77603, 108107, 138611, 169115, 199619 | 8747 | AFN18282 | 22778 | 53282 | 83786, 114290, 144794, 175298, 205802 |
| 2565 | ACL12198 | 16596 | 47100 | 77604, 108108, 138612, 169116, 199620 | 8748 | AFN18304 | 22779 | 53283 | 83787, 114291, 144795, 175299, 205803 |
| 2566 | ACL12209 | 16597 | 47101 | 77605, 108109, 138613, 169117, 199621 | 8749 | AFN18306 | 22780 | 53284 | 83788, 114292, 144796, 175300, 205804 |
| 2567 | ACL12220 | 16598 | 47102 | 77606, 108110, 138614, 169118, 199622 | 8750 | AFN18308 | 22781 | 53285 | 83789, 114293, 144797, 175301, 205805 |

FIG. 3 continued

| | | | | | | | | | |
|---|---|---|---|---|---|---|---|---|---|
| 2568 | ACL12242 | 16599 | 47103 | 77607, 108111, 138615, 169119, 199623 | 8751 | AFN18314 | 22782 | 53286 | 83790, 114294, 144798, 175302, 205806 |
| 2569 | ACL12264 | 16600 | 47104 | 77608, 108112, 138616, 169120, 199624 | 8752 | AFN18320 | 22783 | 53287 | 83791, 114295, 144799, 175303, 205807 |
| 2570 | ACN32275 | 16601 | 47105 | 77609, 108113, 138617, 169121, 199625 | 8753 | AFN18326 | 22784 | 53288 | 83792, 114296, 144800, 175304, 205808 |
| 2571 | ACN32286 | 16602 | 47106 | 77610, 108114, 138618, 169122, 199626 | 8754 | AFN18336 | 22785 | 53289 | 83793, 114297, 144801, 175305, 205809 |
| 2572 | ACN32493 | 16603 | 47107 | 77611, 108115, 138619, 169123, 199627 | 8755 | AFN18346 | 22786 | 53290 | 83794, 114298, 144802, 175306, 205810 |
| 2573 | ACN32526 | 16604 | 47108 | 77612, 108116, 138620, 169124, 199628 | 8756 | AFN18356 | 22787 | 53291 | 83795, 114299, 144803, 175307, 205811 |
| 2574 | ACN32537 | 16605 | 47109 | 77613, 108117, 138621, 169125, 199629 | 8757 | AFN18366 | 22788 | 53292 | 83796, 114300, 144804, 175308, 205812 |
| 2575 | ACN32807 | 16606 | 47110 | 77614, 108118, 138622, 169126, 199630 | 8758 | AFN18376 | 22789 | 53293 | 83797, 114301, 144805, 175309, 205813 |
| 2576 | ACN32818 | 16607 | 47111 | 77615, 108119, 138623, 169127, 199631 | 8759 | AFN18382 | 22790 | 53294 | 83798, 114302, 144806, 175310, 205814 |
| 2577 | ACN32829 | 16608 | 47112 | 77616, 108120, 138624, 169128, 199632 | 8760 | AFN18392 | 22791 | 53295 | 83799, 114303, 144807, 175311, 205815 |
| 2578 | ACN32840 | 16609 | 47113 | 77617, 108121, 138625, 169129, 199633 | 8761 | AFN18402 | 22792 | 53296 | 83800, 114304, 144808, 175312, 205816 |
| 2579 | ACN32851 | 16610 | 47114 | 77618, 108122, 138626, 169130, 199634 | 8762 | AFN18412 | 22793 | 53297 | 83801, 114305, 144809, 175313, 205817 |
| 2580 | ACN32862 | 16611 | 47115 | 77619, 108123, 138627, 169131, 199635 | 8763 | AFN18422 | 22794 | 53298 | 83802, 114306, 144810, 175314, 205818 |
| 2581 | ACN32873 | 16612 | 47116 | 77620, 108124, 138628, 169132, 199636 | 8764 | AFN18432 | 22795 | 53299 | 83803, 114307, 144811, 175315, 205819 |
| 2582 | ACN32884 | 16613 | 47117 | 77621, 108125, 138629, 169133, 199637 | 8765 | AFN18442 | 22796 | 53300 | 83804, 114308, 144812, 175316, 205820 |
| 2583 | ACN32895 | 16614 | 47118 | 77622, 108126, 138630, 169134, 199638 | 8766 | AFN18452 | 22797 | 53301 | 83805, 114309, 144813, 175317, 205821 |
| 2584 | ACN32906 | 16615 | 47119 | 77623, 108127, 138631, 169135, 199639 | 8767 | AFN18462 | 22798 | 53302 | 83806, 114310, 144814, 175318, 205822 |
| 2585 | ACN32917 | 16616 | 47120 | 77624, 108128, 138632, 169136, 199640 | 8768 | AFN18472 | 22799 | 53303 | 83807, 114311, 144815, 175319, 205823 |

FIG. 3 continued

| | | | | | | | | | |
|---|---|---|---|---|---|---|---|---|---|
| 2586 | ACN32928 | 16617 | 47121 | 77625, 108129, 138633, 169137, 199641 | 8769 | AFN18482 | 22800 | 53304 | 83808, 114312, 144816, 175320, 205824 |
| 2587 | ACN32939 | 16618 | 47122 | 77626, 108130, 138634, 169138, 199642 | 8770 | AFN18492 | 22801 | 53305 | 83809, 114313, 144817, 175321, 205825 |
| 2588 | ACN32950 | 16619 | 47123 | 77627, 108131, 138635, 169139, 199643 | 8771 | AFN18514 | 22802 | 53306 | 83810, 114314, 144818, 175322, 205826 |
| 2589 | ACN32961 | 16620 | 47124 | 77628, 108132, 138636, 169140, 199644 | 8772 | AFN18520 | 22803 | 53307 | 83811, 114315, 144819, 175323, 205827 |
| 2590 | ACN32972 | 16621 | 47125 | 77629, 108133, 138637, 169141, 199645 | 8773 | AFN18522 | 22804 | 53308 | 83812, 114316, 144820, 175324, 205828 |
| 2591 | ACN32994 | 16622 | 47126 | 77630, 108134, 138638, 169142, 199646 | 8774 | AFN18524 | 22805 | 53309 | 83813, 114317, 144821, 175325, 205829 |
| 2592 | ACN33005 | 16623 | 47127 | 77631, 108135, 138639, 169143, 199647 | 8775 | AFN18530 | 22806 | 53310 | 83814, 114318, 144822, 175326, 205830 |
| 2593 | ACN33016 | 16624 | 47128 | 77632, 108136, 138640, 169144, 199648 | 8776 | AFN18532 | 22807 | 53311 | 83815, 114319, 144823, 175327, 205831 |
| 2594 | ACN33049 | 16625 | 47129 | 77633, 108137, 138641, 169145, 199649 | 8777 | AFN18538 | 22808 | 53312 | 83816, 114320, 144824, 175328, 205832 |
| 2595 | ACN33060 | 16626 | 47130 | 77634, 108138, 138642, 169146, 199650 | 8778 | AFN18544 | 22809 | 53313 | 83817, 114321, 144825, 175329, 205833 |
| 2596 | ACN33082 | 16627 | 47131 | 77635, 108139, 138643, 169147, 199651 | 8779 | AFN18546 | 22810 | 53314 | 83818, 114322, 144826, 175330, 205834 |
| 2597 | ACN33093 | 16628 | 47132 | 77636, 108140, 138644, 169148, 199652 | 8780 | AFN18552 | 22811 | 53315 | 83819, 114323, 144827, 175331, 205835 |
| 2598 | ACN33104 | 16629 | 47133 | 77637, 108141, 138645, 169149, 199653 | 8781 | AFN18558 | 22812 | 53316 | 83820, 114324, 144828, 175332, 205836 |
| 2599 | ACN33115 | 16630 | 47134 | 77638, 108142, 138646, 169150, 199654 | 8782 | AFN18560 | 22813 | 53317 | 83821, 114325, 144829, 175333, 205837 |
| 2600 | ACN33126 | 16631 | 47135 | 77639, 108143, 138647, 169151, 199655 | 8783 | AFN18562 | 22814 | 53318 | 83822, 114326, 144830, 175334, 205838 |
| 2601 | ACN33148 | 16632 | 47136 | 77640, 108144, 138648, 169152, 199656 | 8784 | AFN18564 | 22815 | 53319 | 83823, 114327, 144831, 175335, 205839 |
| 2602 | ACN33159 | 16633 | 47137 | 77641, 108145, 138649, 169153, 199657 | 8785 | AFN18566 | 22816 | 53320 | 83824, 114328, 144832, 175336, 205840 |
| 2603 | ACN33170 | 16634 | 47138 | 77642, 108146, 138650, 169154, 199658 | 8786 | AFN18572 | 22817 | 53321 | 83825, 114329, 144833, 175337, 205841 |

FIG. 3 continued

| | | | | | | | | | |
|---|---|---|---|---|---|---|---|---|---|
| 2604 | ACN33181 | 16635 | 47139 | 77643, 108147, 138651, 169155, 199659 | 8787 | AFN18582 | 22818 | 53322 | 83826, 114330, 144834, 175338, 205842 |
| 2605 | ACN33203 | 16636 | 47140 | 77644, 108148, 138652, 169156, 199660 | 8788 | AFN18592 | 22819 | 53323 | 83827, 114331, 144835, 175339, 205843 |
| 2606 | ACN33214 | 16637 | 47141 | 77645, 108149, 138653, 169157, 199661 | 8789 | AFN18602 | 22820 | 53324 | 83828, 114332, 144836, 175340, 205844 |
| 2607 | ACN42984 | 16638 | 47142 | 77646, 108150, 138654, 169158, 199662 | 8790 | AFN18612 | 22821 | 53325 | 83829, 114333, 144837, 175341, 205845 |
| 2608 | ACN42995 | 16639 | 47143 | 77647, 108151, 138655, 169159, 199663 | 8791 | AFN18618 | 22822 | 53326 | 83830, 114334, 144838, 175342, 205846 |
| 2609 | ACN43006 | 16640 | 47144 | 77648, 108152, 138656, 169160, 199664 | 8792 | AFN18624 | 22823 | 53327 | 83831, 114335, 144839, 175343, 205847 |
| 2610 | ACN43017 | 16641 | 47145 | 77649, 108153, 138657, 169161, 199665 | 8793 | AFN18630 | 22824 | 53328 | 83832, 114336, 144840, 175344, 205848 |
| 2611 | ACN43028 | 16642 | 47146 | 77650, 108154, 138658, 169162, 199666 | 8794 | AFN18636 | 22825 | 53329 | 83833, 114337, 144841, 175345, 205849 |
| 2612 | ACN43039 | 16643 | 47147 | 77651, 108155, 138659, 169163, 199667 | 8795 | AFN18646 | 22826 | 53330 | 83834, 114338, 144842, 175346, 205850 |
| 2613 | ACN43050 | 16644 | 47148 | 77652, 108156, 138660, 169164, 199668 | 8796 | AFN18656 | 22827 | 53331 | 83835, 114339, 144843, 175347, 205851 |
| 2614 | ACN43061 | 16645 | 47149 | 77653, 108157, 138661, 169165, 199669 | 8797 | AFN18666 | 22828 | 53332 | 83836, 114340, 144844, 175348, 205852 |
| 2615 | ACN43072 | 16646 | 47150 | 77654, 108158, 138662, 169166, 199670 | 8798 | AFN18676 | 22829 | 53333 | 83837, 114341, 144845, 175349, 205853 |
| 2616 | ACN43083 | 16647 | 47151 | 77655, 108159, 138663, 169167, 199671 | 8799 | AFN18686 | 22830 | 53334 | 83838, 114342, 144846, 175350, 205854 |
| 2617 | ACN50231 | 16648 | 47152 | 77656, 108160, 138664, 169168, 199672 | 8800 | AFN18696 | 22831 | 53335 | 83839, 114343, 144847, 175351, 205855 |
| 2618 | ACN50233 | 16649 | 47153 | 77657, 108161, 138665, 169169, 199673 | 8801 | AFN18706 | 22832 | 53336 | 83840, 114344, 144848, 175352, 205856 |
| 2619 | ACN50245 | 16650 | 47154 | 77658, 108162, 138666, 169170, 199674 | 8802 | AFN18716 | 22833 | 53337 | 83841, 114345, 144849, 175353, 205857 |
| 2620 | ACN72609 | 16651 | 47155 | 77659, 108163, 138667, 169171, 199675 | 8803 | AFN18727 | 22834 | 53338 | 83842, 114346, 144850, 175354, 205858 |
| 2621 | ACN72621 | 16652 | 47156 | 77660, 108164, 138668, 169172, 199676 | 8804 | AFN18737 | 22835 | 53339 | 83843, 114347, 144851, 175355, 205859 |

FIG. 3 continued

| | | | | | | | | | |
|---|---|---|---|---|---|---|---|---|---|
| 2622 | ACN76503 | 16653 | 47157 | 77661, 108165, 138669, 169173, 199677 | 8805 | AFN18743 | 22836 | 53340 | 83844, 114348, 144852, 175356, 205860 |
| 2623 | AC036345 | 16654 | 47158 | 77662, 108166, 138670, 169174, 199678 | 8806 | AFN18749 | 22837 | 53341 | 83845, 114349, 144853, 175357, 205861 |
| 2624 | AC036356 | 16655 | 47159 | 77663, 108167, 138671, 169175, 199679 | 8807 | AFN18759 | 22838 | 53342 | 83846, 114350, 144854, 175358, 205862 |
| 2625 | AC036367 | 16656 | 47160 | 77664, 108168, 138672, 169176, 199680 | 8808 | AFN18769 | 22839 | 53343 | 83847, 114351, 144855, 175359, 205863 |
| 2626 | AC036400 | 16657 | 47161 | 77665, 108169, 138673, 169177, 199681 | 8809 | AFN18775 | 22840 | 53344 | 83848, 114352, 144856, 175360, 205864 |
| 2627 | AC036411 | 16658 | 47162 | 77666, 108170, 138674, 169178, 199682 | 8810 | AFN18777 | 22841 | 53345 | 83849, 114353, 144857, 175361, 205865 |
| 2628 | AC036422 | 16659 | 47163 | 77667, 108171, 138675, 169179, 199683 | 8811 | AFN18779 | 22842 | 53346 | 83850, 114354, 144858, 175362, 205866 |
| 2629 | AC036433 | 16660 | 47164 | 77668, 108172, 138676, 169180, 199684 | 8812 | AFN18785 | 22843 | 53347 | 83851, 114355, 144859, 175363, 205867 |
| 2630 | AC036444 | 16661 | 47165 | 77669, 108173, 138677, 169181, 199685 | 8813 | AFN18791 | 22844 | 53348 | 83852, 114356, 144860, 175364, 205868 |
| 2631 | AC036466 | 16662 | 47166 | 77670, 108174, 138678, 169182, 199686 | 8814 | AFN18801 | 22845 | 53349 | 83853, 114357, 144861, 175365, 205869 |
| 2632 | AC036477 | 16663 | 47167 | 77671, 108175, 138679, 169183, 199687 | 8815 | AFN18811 | 22846 | 53350 | 83854, 114358, 144862, 175366, 205870 |
| 2633 | AC036499 | 16664 | 47168 | 77672, 108176, 138680, 169184, 199688 | 8816 | AFN18817 | 22847 | 53351 | 83855, 114359, 144863, 175367, 205871 |
| 2634 | AC036510 | 16665 | 47169 | 77673, 108177, 138681, 169185, 199689 | 8817 | AFN18819 | 22848 | 53352 | 83856, 114360, 144864, 175368, 205872 |
| 2635 | AC036543 | 16666 | 47170 | 77674, 108178, 138682, 169186, 199690 | 8818 | AFN18821 | 22849 | 53353 | 83857, 114361, 144865, 175369, 205873 |
| 2636 | AC036554 | 16667 | 47171 | 77675, 108179, 138683, 169187, 199691 | 8819 | AFN18823 | 22850 | 53354 | 83858, 114362, 144866, 175370, 205874 |
| 2637 | AC036565 | 16668 | 47172 | 77676, 108180, 138684, 169188, 199692 | 8820 | AFN18825 | 22851 | 53355 | 83859, 114363, 144867, 175371, 205875 |
| 2638 | AC036576 | 16669 | 47173 | 77677, 108181, 138685, 169189, 199693 | 8821 | AFN18827 | 22852 | 53356 | 83860, 114364, 144868, 175372, 205876 |
| 2639 | AC036587 | 16670 | 47174 | 77678, 108182, 138686, 169190, 199694 | 8822 | AFN18829 | 22853 | 53357 | 83861, 114365, 144869, 175373, 205877 |

FIG. 3 continued

| | | | | | | | | | |
|---|---|---|---|---|---|---|---|---|---|
| 2640 | AC036609 | 16671 | 47175 | 77679, 108183, 138687, 169191, 199695 | 8823 | AFN18831 | 22854 | 53358 | 83862, 114366, 144870, 175374, 205878 |
| 2641 | AC036620 | 16672 | 47176 | 77680, 108184, 138688, 169192, 199696 | 8824 | AFN18833 | 22855 | 53359 | 83863, 114367, 144871, 175375, 205879 |
| 2642 | AC036631 | 16673 | 47177 | 77681, 108185, 138689, 169193, 199697 | 8825 | AFN18835 | 22856 | 53360 | 83864, 114368, 144872, 175376, 205880 |
| 2643 | AC036653 | 16674 | 47178 | 77682, 108186, 138690, 169194, 199698 | 8826 | AFN18841 | 22857 | 53361 | 83865, 114369, 144873, 175377, 205881 |
| 2644 | AC036675 | 16675 | 47179 | 77683, 108187, 138691, 169195, 199699 | 8827 | AFN18851 | 22858 | 53362 | 83866, 114370, 144874, 175378, 205882 |
| 2645 | AC036686 | 16676 | 47180 | 77684, 108188, 138692, 169196, 199700 | 8828 | AFN18857 | 22859 | 53363 | 83867, 114371, 144875, 175379, 205883 |
| 2646 | AC037125 | 16677 | 47181 | 77685, 108189, 138693, 169197, 199701 | 8829 | AFN18859 | 22860 | 53364 | 83868, 114372, 144876, 175380, 205884 |
| 2647 | AC094511 | 16678 | 47182 | 77686, 108190, 138694, 169198, 199702 | 8830 | AFN18861 | 22861 | 53365 | 83869, 114373, 144877, 175381, 205885 |
| 2648 | AC094512 | 16679 | 47183 | 77687, 108191, 138695, 169199, 199703 | 8831 | AFN18867 | 22862 | 53366 | 83870, 114374, 144878, 175382, 205886 |
| 2649 | AC094513 | 16680 | 47184 | 77688, 108192, 138696, 169200, 199704 | 8832 | AFN18877 | 22863 | 53367 | 83871, 114375, 144879, 175383, 205887 |
| 2650 | AC094675 | 16681 | 47185 | 77689, 108193, 138697, 169201, 199705 | 8833 | AFN18887 | 22864 | 53368 | 83872, 114376, 144880, 175384, 205888 |
| 2651 | AC094686 | 16682 | 47186 | 77690, 108194, 138698, 169202, 199706 | 8834 | AFN18893 | 22865 | 53369 | 83873, 114377, 144881, 175385, 205889 |
| 2652 | AC094697 | 16683 | 47187 | 77691, 108195, 138699, 169203, 199707 | 8835 | AFN18895 | 22866 | 53370 | 83874, 114378, 144882, 175386, 205890 |
| 2653 | AC094708 | 16684 | 47188 | 77692, 108196, 138700, 169204, 199708 | 8836 | AFN18905 | 22867 | 53371 | 83875, 114379, 144883, 175387, 205891 |
| 2654 | AC094719 | 16685 | 47189 | 77693, 108197, 138701, 169205, 199709 | 8837 | AFN18913 | 22868 | 53372 | 83876, 114380, 144884, 175388, 205892 |
| 2655 | AC094741 | 16686 | 47190 | 77694, 108198, 138702, 169206, 199710 | 8838 | AFN18919 | 22869 | 53373 | 83877, 114381, 144885, 175389, 205893 |
| 2656 | AC094763 | 16687 | 47191 | 77695, 108199, 138703, 169207, 199711 | 8839 | AFN18929 | 22870 | 53374 | 83878, 114382, 144886, 175390, 205894 |
| 2657 | AC094774 | 16688 | 47192 | 77696, 108200, 138704, 169208, 199712 | 8840 | AFN18939 | 22871 | 53375 | 83879, 114383, 144887, 175391, 205895 |

FIG. 3 continued

| | | | | | | | | | |
|---|---|---|---|---|---|---|---|---|---|
| 2658 | AC094785 | 16689 | 47193 | 77697, 108201, 138705, 169209, 199713 | 8841 | AFN18953 | 22872 | 53376 | 83880, 114384, 144888, 175392, 205896 |
| 2659 | AC094796 | 16690 | 47194 | 77698, 108202, 138706, 169210, 199714 | 8842 | AFN18959 | 22873 | 53377 | 83881, 114385, 144889, 175393, 205897 |
| 2660 | AC094807 | 16691 | 47195 | 77699, 108203, 138707, 169211, 199715 | 8843 | AFN18965 | 22874 | 53378 | 83882, 114386, 144890, 175394, 205898 |
| 2661 | AC094818 | 16692 | 47196 | 77700, 108204, 138708, 169212, 199716 | 8844 | AFN18975 | 22875 | 53379 | 83883, 114387, 144891, 175395, 205899 |
| 2662 | AC094829 | 16693 | 47197 | 77701, 108205, 138709, 169213, 199717 | 8845 | AFN18981 | 22876 | 53380 | 83884, 114388, 144892, 175396, 205900 |
| 2663 | AC094840 | 16694 | 47198 | 77702, 108206, 138710, 169214, 199718 | 8846 | AFN18983 | 22877 | 53381 | 83885, 114389, 144893, 175397, 205901 |
| 2664 | AC094851 | 16695 | 47199 | 77703, 108207, 138711, 169215, 199719 | 8847 | AFN18985 | 22878 | 53382 | 83886, 114390, 144894, 175398, 205902 |
| 2665 | AC094873 | 16696 | 47200 | 77704, 108208, 138712, 169216, 199720 | 8848 | AFN18987 | 22879 | 53383 | 83887, 114391, 144895, 175399, 205903 |
| 2666 | AC094884 | 16697 | 47201 | 77705, 108209, 138713, 169217, 199721 | 8849 | AFN18989 | 22880 | 53384 | 83888, 114392, 144896, 175400, 205904 |
| 2667 | AC094906 | 16698 | 47202 | 77706, 108210, 138714, 169218, 199722 | 8850 | AFN18995 | 22881 | 53385 | 83889, 114393, 144897, 175401, 205905 |
| 2668 | AC094917 | 16699 | 47203 | 77707, 108211, 138715, 169219, 199723 | 8851 | AFN19001 | 22882 | 53386 | 83890, 114394, 144898, 175402, 205906 |
| 2669 | AC094928 | 16700 | 47204 | 77708, 108212, 138716, 169220, 199724 | 8852 | AFN19007 | 22883 | 53387 | 83891, 114395, 144899, 175403, 205907 |
| 2670 | AC094939 | 16701 | 47205 | 77709, 108213, 138717, 169221, 199725 | 8853 | AFN19024 | 22884 | 53388 | 83892, 114396, 144900, 175404, 205908 |
| 2671 | AC094950 | 16702 | 47206 | 77710, 108214, 138718, 169222, 199726 | 8854 | AFN19025 | 22885 | 53389 | 83893, 114397, 144901, 175405, 205909 |
| 2672 | AC094961 | 16703 | 47207 | 77711, 108215, 138719, 169223, 199727 | 8855 | AFN19027 | 22886 | 53390 | 83894, 114398, 144902, 175406, 205910 |
| 2673 | AC094972 | 16704 | 47208 | 77712, 108216, 138720, 169224, 199728 | 8856 | AFN19032 | 22887 | 53391 | 83895, 114399, 144903, 175407, 205911 |
| 2674 | AC095156 | 16705 | 47209 | 77713, 108217, 138721, 169225, 199729 | 8857 | AFN19038 | 22888 | 53392 | 83896, 114400, 144904, 175408, 205912 |
| 2675 | AC095174 | 16706 | 47210 | 77714, 108218, 138722, 169226, 199730 | 8858 | AFN19049 | 22889 | 53393 | 83897, 114401, 144905, 175409, 205913 |

FIG. 3 continued

| | | | | | | | | | |
|---|---|---|---|---|---|---|---|---|---|
| 2676 | AC095185 | 16707 | 47211 | 77715, 108219, 138723, 169227, 199731 | 8859 | AFN19055 | 22890 | 53394 | 83898, 114402, 144906, 175410, 205914 |
| 2677 | AC095196 | 16708 | 47212 | 77716, 108220, 138724, 169228, 199732 | 8860 | AFN19065 | 22891 | 53395 | 83899, 114403, 144907, 175411, 205915 |
| 2678 | AC095207 | 16709 | 47213 | 77717, 108221, 138725, 169229, 199733 | 8861 | AFN19071 | 22892 | 53396 | 83900, 114404, 144908, 175412, 205916 |
| 2679 | AC095218 | 16710 | 47214 | 77718, 108222, 138726, 169230, 199734 | 8862 | AFN19077 | 22893 | 53397 | 83901, 114405, 144909, 175413, 205917 |
| 2680 | AC095229 | 16711 | 47215 | 77719, 108223, 138727, 169231, 199735 | 8863 | AFN19083 | 22894 | 53398 | 83902, 114406, 144910, 175414, 205918 |
| 2681 | AC095240 | 16712 | 47216 | 77720, 108224, 138728, 169232, 199736 | 8864 | AFN19089 | 22895 | 53399 | 83903, 114407, 144911, 175415, 205919 |
| 2682 | AC095262 | 16713 | 47217 | 77721, 108225, 138729, 169233, 199737 | 8865 | AFN19099 | 22896 | 53400 | 83904, 114408, 144912, 175416, 205920 |
| 2683 | AC095273 | 16714 | 47218 | 77722, 108226, 138730, 169234, 199738 | 8866 | AFN19105 | 22897 | 53401 | 83905, 114409, 144913, 175417, 205921 |
| 2684 | AC095306 | 16715 | 47219 | 77723, 108227, 138731, 169235, 199739 | 8867 | AFN19114 | 22898 | 53402 | 83906, 114410, 144914, 175418, 205922 |
| 2685 | AC095385 | 16716 | 47220 | 77724, 108228, 138732, 169236, 199740 | 8868 | AFN19126 | 22899 | 53403 | 83907, 114411, 144915, 175419, 205923 |
| 2686 | AC095407 | 16717 | 47221 | 77725, 108229, 138733, 169237, 199741 | 8869 | AFN19136 | 22900 | 53404 | 83908, 114412, 144916, 175420, 205924 |
| 2687 | AC095418 | 16718 | 47222 | 77726, 108230, 138734, 169238, 199742 | 8870 | AFN19146 | 22901 | 53405 | 83909, 114413, 144917, 175421, 205925 |
| 2688 | AC095429 | 16719 | 47223 | 77727, 108231, 138735, 169239, 199743 | 8871 | AFN19156 | 22902 | 53406 | 83910, 114414, 144918, 175422, 205926 |
| 2689 | AC095440 | 16720 | 47224 | 77728, 108232, 138736, 169240, 199744 | 8872 | AFN19166 | 22903 | 53407 | 83911, 114415, 144919, 175423, 205927 |
| 2690 | AC095462 | 16721 | 47225 | 77729, 108233, 138737, 169241, 199745 | 8873 | AFN19186 | 22904 | 53408 | 83912, 114416, 144920, 175424, 205928 |
| 2691 | AC095484 | 16722 | 47226 | 77730, 108234, 138738, 169242, 199746 | 8874 | AFN19196 | 22905 | 53409 | 83913, 114417, 144921, 175425, 205929 |
| 2692 | AC095495 | 16723 | 47227 | 77731, 108235, 138739, 169243, 199747 | 8875 | AFN19205 | 22906 | 53410 | 83914, 114418, 144922, 175426, 205930 |
| 2693 | AC095506 | 16724 | 47228 | 77732, 108236, 138740, 169244, 199748 | 8876 | AFN19215 | 22907 | 53411 | 83915, 114419, 144923, 175427, 205931 |

FIG. 3 continued

| | | | | | | | | | |
|---|---|---|---|---|---|---|---|---|---|
| 2694 | ACO95517 | 16725 | 47229 | 77733, 108237, 138741, 169245, 199749 | 8877 | AFN19225 | 22908 | 53412 | 83916, 114420, 144924, 175428, 205932 |
| 2695 | ACO95539 | 16726 | 47230 | 77734, 108238, 138742, 169246, 199750 | 8878 | AFN19235 | 22909 | 53413 | 83917, 114421, 144925, 175429, 205933 |
| 2696 | ACP20223 | 16727 | 47231 | 77735, 108239, 138743, 169247, 199751 | 8879 | AFN19245 | 22910 | 53414 | 83918, 114422, 144926, 175430, 205934 |
| 2697 | ACP41952 | 16728 | 47232 | 77736, 108240, 138744, 169248, 199752 | 8880 | AFN19251 | 22911 | 53415 | 83919, 114423, 144927, 175431, 205935 |
| 2698 | ACP44158 | 16729 | 47233 | 77737, 108241, 138745, 169249, 199753 | 8881 | AFN19261 | 22912 | 53416 | 83920, 114424, 144928, 175432, 205936 |
| 2699 | ACP44195 | 16730 | 47234 | 77738, 108242, 138746, 169250, 199754 | 8882 | AFN19271 | 22913 | 53417 | 83921, 114425, 144929, 175433, 205937 |
| 2700 | ACP44217 | 16731 | 47235 | 77739, 108243, 138747, 169251, 199755 | 8883 | AFN19281 | 22914 | 53418 | 83922, 114426, 144930, 175434, 205938 |
| 2701 | ACP44228 | 16732 | 47236 | 77740, 108244, 138748, 169252, 199756 | 8884 | AFN19287 | 22915 | 53419 | 83923, 114427, 144931, 175435, 205939 |
| 2702 | ACP44239 | 16733 | 47237 | 77741, 108245, 138749, 169253, 199757 | 8885 | AFN19297 | 22916 | 53420 | 83924, 114428, 144932, 175436, 205940 |
| 2703 | ACP44250 | 16734 | 47238 | 77742, 108246, 138750, 169254, 199758 | 8886 | AFN19307 | 22917 | 53421 | 83925, 114429, 144933, 175437, 205941 |
| 2704 | ACP44261 | 16735 | 47239 | 77743, 108247, 138751, 169255, 199759 | 8887 | AFN19317 | 22918 | 53422 | 83926, 114430, 144934, 175438, 205942 |
| 2705 | ACP44272 | 16736 | 47240 | 77744, 108248, 138752, 169256, 199760 | 8888 | AFN19327 | 22919 | 53423 | 83927, 114431, 144935, 175439, 205943 |
| 2706 | ACQ55360 | 16737 | 47241 | 77745, 108249, 138753, 169257, 199761 | 8889 | AFN19346 | 22920 | 53424 | 83928, 114432, 144936, 175440, 205944 |
| 2707 | ACQ63236 | 16738 | 47242 | 77746, 108250, 138754, 169258, 199762 | 8890 | AFN19352 | 22921 | 53425 | 83929, 114433, 144937, 175441, 205945 |
| 2708 | ACQ63242 | 16739 | 47243 | 77747, 108251, 138755, 169259, 199763 | 8891 | AFN19354 | 22922 | 53426 | 83930, 114434, 144938, 175442, 205946 |
| 2709 | ACQ63253 | 16740 | 47244 | 77748, 108252, 138756, 169260, 199764 | 8892 | AFN19356 | 22923 | 53427 | 83931, 114435, 144939, 175443, 205947 |
| 2710 | ACQ63262 | 16741 | 47245 | 77749, 108253, 138757, 169261, 199765 | 8893 | AFN19358 | 22924 | 53428 | 83932, 114436, 144940, 175444, 205948 |
| 2711 | ACQ65694 | 16742 | 47246 | 77750, 108254, 138758, 169262, 199766 | 8894 | AFN19360 | 22925 | 53429 | 83933, 114437, 144941, 175445, 205949 |

FIG. 3 continued

| | | | | | | | | | |
|---|---|---|---|---|---|---|---|---|---|
| 2712 | ACQ65705 | 16743 | 47247 | 77751, 108255, 138759, 169263, 199767 | 8895 | AFN19362 | 22926 | 53430 | 83934, 114438, 144942, 175446, 205950 |
| 2713 | ACQ65716 | 16744 | 47248 | 77752, 108256, 138760, 169264, 199768 | 8896 | AFN19364 | 22927 | 53431 | 83935, 114439, 144943, 175447, 205951 |
| 2714 | ACQ65727 | 16745 | 47249 | 77753, 108257, 138761, 169265, 199769 | 8897 | AFN19366 | 22928 | 53432 | 83936, 114440, 144944, 175448, 205952 |
| 2715 | ACQ65739 | 16746 | 47250 | 77754, 108258, 138762, 169266, 199770 | 8898 | AFN19370 | 22929 | 53433 | 83937, 114441, 144945, 175449, 205953 |
| 2716 | ACQ65750 | 16747 | 47251 | 77755, 108259, 138763, 169267, 199771 | 8899 | AFN19374 | 22930 | 53434 | 83938, 114442, 144946, 175450, 205954 |
| 2717 | ACQ65761 | 16748 | 47252 | 77756, 108260, 138764, 169268, 199772 | 8900 | AFN19376 | 22931 | 53435 | 83939, 114443, 144947, 175451, 205955 |
| 2718 | ACQ73394 | 16749 | 47253 | 77757, 108261, 138765, 169269, 199773 | 8901 | AFN19378 | 22932 | 53436 | 83940, 114444, 144948, 175452, 205956 |
| 2719 | ACQ73395 | 16750 | 47254 | 77758, 108262, 138766, 169270, 199774 | 8902 | AFN19380 | 22933 | 53437 | 83941, 114445, 144949, 175453, 205957 |
| 2720 | ACQ73396 | 16751 | 47255 | 77759, 108263, 138767, 169271, 199775 | 8903 | AFN19382 | 22934 | 53438 | 83942, 114446, 144950, 175454, 205958 |
| 2721 | ACQ76291 | 16752 | 47256 | 77760, 108264, 138768, 169272, 199776 | 8904 | AFN19384 | 22935 | 53439 | 83943, 114447, 144951, 175455, 205959 |
| 2722 | ACQ76298 | 16753 | 47257 | 77761, 108265, 138769, 169273, 199777 | 8905 | AFN19386 | 22936 | 53440 | 83944, 114448, 144952, 175456, 205960 |
| 2723 | ACQ76308 | 16754 | 47258 | 77762, 108266, 138770, 169274, 199778 | 8906 | AFN19388 | 22937 | 53441 | 83945, 114449, 144953, 175457, 205961 |
| 2724 | ACQ76316 | 16755 | 47259 | 77763, 108267, 138771, 169275, 199779 | 8907 | AFN19390 | 22938 | 53442 | 83946, 114450, 144954, 175458, 205962 |
| 2725 | ACQ76322 | 16756 | 47260 | 77764, 108268, 138772, 169276, 199780 | 8908 | AFN19392 | 22939 | 53443 | 83947, 114451, 144955, 175459, 205963 |
| 2726 | ACQ76328 | 16757 | 47261 | 77765, 108269, 138773, 169277, 199781 | 8909 | AFN19394 | 22940 | 53444 | 83948, 114452, 144956, 175460, 205964 |
| 2727 | ACQ76335 | 16758 | 47262 | 77766, 108270, 138774, 169278, 199782 | 8910 | AFN19396 | 22941 | 53445 | 83949, 114453, 144957, 175461, 205965 |
| 2728 | ACQ76342 | 16759 | 47263 | 77767, 108271, 138775, 169279, 199783 | 8911 | AFN19398 | 22942 | 53446 | 83950, 114454, 144958, 175462, 205966 |
| 2729 | ACQ76351 | 16760 | 47264 | 77768, 108272, 138776, 169280, 199784 | 8912 | AFN19400 | 22943 | 53447 | 83951, 114455, 144959, 175463, 205967 |

FIG. 3 continued

| | | | | | | | | | |
|---|---|---|---|---|---|---|---|---|---|
| 2730 | ACQ76359 | 16761 | 47265 | 77769, 108273, 138777, 169281, 199785 | 8913 | AFN19402 | 22944 | 53448 | 83952, 114456, 144960, 175464, 205968 |
| 2731 | ACQ76364 | 16762 | 47266 | 77770, 108274, 138778, 169282, 199786 | 8914 | AFN19404 | 22945 | 53449 | 83953, 114457, 144961, 175465, 205969 |
| 2732 | ACQ76367 | 16763 | 47267 | 77771, 108275, 138779, 169283, 199787 | 8915 | AFN19406 | 22946 | 53450 | 83954, 114458, 144962, 175466, 205970 |
| 2733 | ACQ76379 | 16764 | 47268 | 77772, 108276, 138780, 169284, 199788 | 8916 | AFN19410 | 22947 | 53451 | 83955, 114459, 144963, 175467, 205971 |
| 2734 | ACQ76385 | 16765 | 47269 | 77773, 108277, 138781, 169285, 199789 | 8917 | AFN19412 | 22948 | 53452 | 83956, 114460, 144964, 175468, 205972 |
| 2735 | ACQ76388 | 16766 | 47270 | 77774, 108278, 138782, 169286, 199790 | 8918 | AFN19414 | 22949 | 53453 | 83957, 114461, 144965, 175469, 205973 |
| 2736 | ACQ76403 | 16767 | 47271 | 77775, 108279, 138783, 169287, 199791 | 8919 | AFN19416 | 22950 | 53454 | 83958, 114462, 144966, 175470, 205974 |
| 2737 | ACQ76407 | 16768 | 47272 | 77776, 108280, 138784, 169288, 199792 | 8920 | AFN19418 | 22951 | 53455 | 83959, 114463, 144967, 175471, 205975 |
| 2738 | ACQ77603 | 16769 | 47273 | 77777, 108281, 138785, 169289, 199793 | 8921 | AFN19420 | 22952 | 53456 | 83960, 114464, 144968, 175472, 205976 |
| 2739 | ACQ83309 | 16770 | 47274 | 77778, 108282, 138786, 169290, 199794 | 8922 | AFN19422 | 22953 | 53457 | 83961, 114465, 144969, 175473, 205977 |
| 2740 | ACQ84460 | 16771 | 47275 | 77779, 108283, 138787, 169291, 199795 | 8923 | AFN19426 | 22954 | 53458 | 83962, 114466, 144970, 175474, 205978 |
| 2741 | ACQ84470 | 16772 | 47276 | 77780, 108284, 138788, 169292, 199796 | 8924 | AFN19428 | 22955 | 53459 | 83963, 114467, 144971, 175475, 205979 |
| 2742 | ACQ84480 | 16773 | 47277 | 77781, 108285, 138789, 169293, 199797 | 8925 | AFN19430 | 22956 | 53460 | 83964, 114468, 144972, 175476, 205980 |
| 2743 | ACQ89891 | 16774 | 47278 | 77782, 108286, 138790, 169294, 199798 | 8926 | AFN19432 | 22957 | 53461 | 83965, 114469, 144973, 175477, 205981 |
| 2744 | ACQ89918 | 16775 | 47279 | 77783, 108287, 138791, 169295, 199799 | 8927 | AFN19434 | 22958 | 53462 | 83966, 114470, 144974, 175478, 205982 |
| 2745 | ACQ89919 | 16776 | 47280 | 77784, 108288, 138792, 169296, 199800 | 8928 | AFN19436 | 22959 | 53463 | 83967, 114471, 144975, 175479, 205983 |
| 2746 | ACQ89920 | 16777 | 47281 | 77785, 108289, 138793, 169297, 199801 | 8929 | AFN19438 | 22960 | 53464 | 83968, 114472, 144976, 175480, 205984 |
| 2747 | ACQ89921 | 16778 | 47282 | 77786, 108290, 138794, 169298, 199802 | 8930 | AFN19442 | 22961 | 53465 | 83969, 114473, 144977, 175481, 205985 |

FIG. 3 continued

| | | | | | | | | | |
|---|---|---|---|---|---|---|---|---|---|
| 2748 | ACQ89922 | 16779 | 47283 | 77787, 108291, 138795, 169299, 199803 | 8931 | AFN19446 | 22962 | 53466 | 83970, 114474, 144978, 175482, 205986 |
| 2749 | ACQ89923 | 16780 | 47284 | 77788, 108292, 138796, 169300, 199804 | 8932 | AFN19448 | 22963 | 53467 | 83971, 114475, 144979, 175483, 205987 |
| 2750 | ACQ99623 | 16781 | 47285 | 77789, 108293, 138797, 169301, 199805 | 8933 | AFN19458 | 22964 | 53468 | 83972, 114476, 144980, 175484, 205988 |
| 2751 | ACQ99624 | 16782 | 47286 | 77790, 108294, 138798, 169302, 199806 | 8934 | AFN19460 | 22965 | 53469 | 83973, 114477, 144981, 175485, 205989 |
| 2752 | ACQ99626 | 16783 | 47287 | 77791, 108295, 138799, 169303, 199807 | 8935 | AFN19462 | 22966 | 53470 | 83974, 114478, 144982, 175486, 205990 |
| 2753 | ACQ99627 | 16784 | 47288 | 77792, 108296, 138800, 169304, 199808 | 8936 | AFN19466 | 22967 | 53471 | 83975, 114479, 144983, 175487, 205991 |
| 2754 | ACQ99628 | 16785 | 47289 | 77793, 108297, 138801, 169305, 199809 | 8937 | AFN19468 | 22968 | 53472 | 83976, 114480, 144984, 175488, 205992 |
| 2755 | ACQ99629 | 16786 | 47290 | 77794, 108298, 138802, 169306, 199810 | 8938 | AFN19470 | 22969 | 53473 | 83977, 114481, 144985, 175489, 205993 |
| 2756 | ACQ99630 | 16787 | 47291 | 77795, 108299, 138803, 169307, 199811 | 8939 | AFN19472 | 22970 | 53474 | 83978, 114482, 144986, 175490, 205994 |
| 2757 | ACQ99632 | 16788 | 47292 | 77796, 108300, 138804, 169308, 199812 | 8940 | AFN19476 | 22971 | 53475 | 83979, 114483, 144987, 175491, 205995 |
| 2758 | ACQ99633 | 16789 | 47293 | 77797, 108301, 138805, 169309, 199813 | 8941 | AFN19478 | 22972 | 53476 | 83980, 114484, 144988, 175492, 205996 |
| 2759 | ACQ99635 | 16790 | 47294 | 77798, 108302, 138806, 169310, 199814 | 8942 | AFN19480 | 22973 | 53477 | 83981, 114485, 144989, 175493, 205997 |
| 2760 | ACQ99636 | 16791 | 47295 | 77799, 108303, 138807, 169311, 199815 | 8943 | AFN19482 | 22974 | 53478 | 83982, 114486, 144990, 175494, 205998 |
| 2761 | ACQ99684 | 16792 | 47296 | 77800, 108304, 138808, 169312, 199816 | 8944 | AFN19484 | 22975 | 53479 | 83983, 114487, 144991, 175495, 205999 |
| 2762 | ACQ99824 | 16793 | 47297 | 77801, 108305, 138809, 169313, 199817 | 8945 | AFN19488 | 22976 | 53480 | 83984, 114488, 144992, 175496, 206000 |
| 2763 | ACR01015 | 16794 | 47298 | 77802, 108306, 138810, 169314, 199818 | 8946 | AFN19492 | 22977 | 53481 | 83985, 114489, 144993, 175497, 206001 |
| 2764 | ACR08422 | 16795 | 47299 | 77803, 108307, 138811, 169315, 199819 | 8947 | AFN19494 | 22978 | 53482 | 83986, 114490, 144994, 175498, 206002 |
| 2765 | ACR08432 | 16796 | 47300 | 77804, 108308, 138812, 169316, 199820 | 8948 | AFN19496 | 22979 | 53483 | 83987, 114491, 144995, 175499, 206003 |

FIG. 3 continued

| | | | | | | | | | |
|---|---|---|---|---|---|---|---|---|---|
| 2766 | ACR08442 | 16797 | 47301 | 77805, 108309, 138813, 169317, 199821 | 8949 | AFN19498 | 22980 | 53484 | 83988, 114492, 144996, 175500, 206004 |
| 2767 | ACR08452 | 16798 | 47302 | 77806, 108310, 138814, 169318, 199822 | 8950 | AFN19500 | 22981 | 53485 | 83989, 114493, 144997, 175501, 206005 |
| 2768 | ACR08462 | 16799 | 47303 | 77807, 108311, 138815, 169319, 199823 | 8951 | AFN19502 | 22982 | 53486 | 83990, 114494, 144998, 175502, 206006 |
| 2769 | ACR08565 | 16800 | 47304 | 77808, 108312, 138816, 169320, 199824 | 8952 | AFN19504 | 22983 | 53487 | 83991, 114495, 144999, 175503, 206007 |
| 2770 | ACR08566 | 16801 | 47305 | 77809, 108313, 138817, 169321, 199825 | 8953 | AFN19506 | 22984 | 53488 | 83992, 114496, 145000, 175504, 206008 |
| 2771 | ACR08567 | 16802 | 47306 | 77810, 108314, 138818, 169322, 199826 | 8954 | AFN19508 | 22985 | 53489 | 83993, 114497, 145001, 175505, 206009 |
| 2772 | ACR08568 | 16803 | 47307 | 77811, 108315, 138819, 169323, 199827 | 8955 | AFN19510 | 22986 | 53490 | 83994, 114498, 145002, 175506, 206010 |
| 2773 | ACR08569 | 16804 | 47308 | 77812, 108316, 138820, 169324, 199828 | 8956 | AFN19512 | 22987 | 53491 | 83995, 114499, 145003, 175507, 206011 |
| 2774 | ACR08570 | 16805 | 47309 | 77813, 108317, 138821, 169325, 199829 | 8957 | AFN19516 | 22988 | 53492 | 83996, 114500, 145004, 175508, 206012 |
| 2775 | ACR08571 | 16806 | 47310 | 77814, 108318, 138822, 169326, 199830 | 8958 | AFN19518 | 22989 | 53493 | 83997, 114501, 145005, 175509, 206013 |
| 2776 | ACR08572 | 16807 | 47311 | 77815, 108319, 138823, 169327, 199831 | 8959 | AFN19520 | 22990 | 53494 | 83998, 114502, 145006, 175510, 206014 |
| 2777 | ACR08573 | 16808 | 47312 | 77816, 108320, 138824, 169328, 199832 | 8960 | AFN19522 | 22991 | 53495 | 83999, 114503, 145007, 175511, 206015 |
| 2778 | ACR08574 | 16809 | 47313 | 77817, 108321, 138825, 169329, 199833 | 8961 | AFN19524 | 22992 | 53496 | 84000, 114504, 145008, 175512, 206016 |
| 2779 | ACR08576 | 16810 | 47314 | 77818, 108322, 138826, 169330, 199834 | 8962 | AFN19526 | 22993 | 53497 | 84001, 114505, 145009, 175513, 206017 |
| 2780 | ACR08577 | 16811 | 47315 | 77819, 108323, 138827, 169331, 199835 | 8963 | AFN19528 | 22994 | 53498 | 84002, 114506, 145010, 175514, 206018 |
| 2781 | ACR09378 | 16812 | 47316 | 77820, 108324, 138828, 169332, 199836 | 8964 | AFN19530 | 22995 | 53499 | 84003, 114507, 145011, 175515, 206019 |
| 2782 | ACR09379 | 16813 | 47317 | 77821, 108325, 138829, 169333, 199837 | 8965 | AFN19532 | 22996 | 53500 | 84004, 114508, 145012, 175516, 206020 |
| 2783 | ACR09380 | 16814 | 47318 | 77822, 108326, 138830, 169334, 199838 | 8966 | AFN19534 | 22997 | 53501 | 84005, 114509, 145013, 175517, 206021 |

FIG. 3 continued

| | | | | | | | | | |
|---|---|---|---|---|---|---|---|---|---|
| 2784 | ACR09381 | 16815 | 47319 | 77823, 108327, 138831, 169335, 199839 | 8967 | AFN19536 | 22998 | 53502 | 84006, 114510, 145014, 175518, 206022 |
| 2785 | ACR09382 | 16816 | 47320 | 77824, 108328, 138832, 169336, 199840 | 8968 | AFN19538 | 22999 | 53503 | 84007, 114511, 145015, 175519, 206023 |
| 2786 | ACR09383 | 16817 | 47321 | 77825, 108329, 138833, 169337, 199841 | 8969 | AFN19544 | 23000 | 53504 | 84008, 114512, 145016, 175520, 206024 |
| 2787 | ACR09384 | 16818 | 47322 | 77826, 108330, 138834, 169338, 199842 | 8970 | AFN19546 | 23001 | 53505 | 84009, 114513, 145017, 175521, 206025 |
| 2788 | ACR09385 | 16819 | 47323 | 77827, 108331, 138835, 169339, 199843 | 8971 | AFN19548 | 23002 | 53506 | 84010, 114514, 145018, 175522, 206026 |
| 2789 | ACR09386 | 16820 | 47324 | 77828, 108332, 138836, 169340, 199844 | 8972 | AFN19550 | 23003 | 53507 | 84011, 114515, 145019, 175523, 206027 |
| 2790 | ACR10189 | 16821 | 47325 | 77829, 108333, 138837, 169341, 199845 | 8973 | AFN19552 | 23004 | 53508 | 84012, 114516, 145020, 175524, 206028 |
| 2791 | ACR10226 | 16822 | 47326 | 77830, 108334, 138838, 169342, 199846 | 8974 | AFN19554 | 23005 | 53509 | 84013, 114517, 145021, 175525, 206029 |
| 2792 | ACR10236 | 16823 | 47327 | 77831, 108335, 138839, 169343, 199847 | 8975 | AFN19556 | 23006 | 53510 | 84014, 114518, 145022, 175526, 206030 |
| 2793 | ACR10237 | 16824 | 47328 | 77832, 108336, 138840, 169344, 199848 | 8976 | AFN19558 | 23007 | 53511 | 84015, 114519, 145023, 175527, 206031 |
| 2794 | ACR15186 | 16825 | 47329 | 77833, 108337, 138841, 169345, 199849 | 8977 | AFN19560 | 23008 | 53512 | 84016, 114520, 145024, 175528, 206032 |
| 2795 | ACR15197 | 16826 | 47330 | 77834, 108338, 138842, 169346, 199850 | 8978 | AFN19562 | 23009 | 53513 | 84017, 114521, 145025, 175529, 206033 |
| 2796 | ACR15208 | 16827 | 47331 | 77835, 108339, 138843, 169347, 199851 | 8979 | AFN19564 | 23010 | 53514 | 84018, 114522, 145026, 175530, 206034 |
| 2797 | ACR15230 | 16828 | 47332 | 77836, 108340, 138844, 169348, 199852 | 8980 | AFN19566 | 23011 | 53515 | 84019, 114523, 145027, 175531, 206035 |
| 2798 | ACR15241 | 16829 | 47333 | 77837, 108341, 138845, 169349, 199853 | 8981 | AFN19568 | 23012 | 53516 | 84020, 114524, 145028, 175532, 206036 |
| 2799 | ACR15252 | 16830 | 47334 | 77838, 108342, 138846, 169350, 199854 | 8982 | AFN19570 | 23013 | 53517 | 84021, 114525, 145029, 175533, 206037 |
| 2800 | ACR15263 | 16831 | 47335 | 77839, 108343, 138847, 169351, 199855 | 8983 | AFN19572 | 23014 | 53518 | 84022, 114526, 145030, 175534, 206038 |
| 2801 | ACR15274 | 16832 | 47336 | 77840, 108344, 138848, 169352, 199856 | 8984 | AFN19574 | 23015 | 53519 | 84023, 114527, 145031, 175535, 206039 |

FIG. 3 continued

| | | | | | | | | | |
|---|---|---|---|---|---|---|---|---|---|
| 2802 | ACRI5307 | 16833 | 47337 | 77841, 108345, 138849, 169353, 199857 | 8985 | AFNI9576 | 23016 | 53520 | 84024, 114528, 145032, 175536, 206040 |
| 2803 | ACRI5318 | 16834 | 47338 | 77842, 108346, 138850, 169354, 199858 | 8986 | AFNI9578 | 23017 | 53521 | 84025, 114529, 145033, 175537, 206041 |
| 2804 | ACRI5329 | 16835 | 47339 | 77843, 108347, 138851, 169355, 199859 | 8987 | AFNI9582 | 23018 | 53522 | 84026, 114530, 145034, 175538, 206042 |
| 2805 | ACRI5340 | 16836 | 47340 | 77844, 108348, 138852, 169356, 199860 | 8988 | AFNI9584 | 23019 | 53523 | 84027, 114531, 145035, 175539, 206043 |
| 2806 | ACRI5362 | 16837 | 47341 | 77845, 108349, 138853, 169357, 199861 | 8989 | AFNI9588 | 23020 | 53524 | 84028, 114532, 145036, 175540, 206044 |
| 2807 | ACRI5373 | 16838 | 47342 | 77846, 108350, 138854, 169358, 199862 | 8990 | AFNI9590 | 23021 | 53525 | 84029, 114533, 145037, 175541, 206045 |
| 2808 | ACRI5428 | 16839 | 47343 | 77847, 108351, 138855, 169359, 199863 | 8991 | AFNI9592 | 23022 | 53526 | 84030, 114534, 145038, 175542, 206046 |
| 2809 | ACRI5472 | 16840 | 47344 | 77848, 108352, 138856, 169360, 199864 | 8992 | AFNI9594 | 23023 | 53527 | 84031, 114535, 145039, 175543, 206047 |
| 2810 | ACRI5483 | 16841 | 47345 | 77849, 108353, 138857, 169361, 199865 | 8993 | AFNI9596 | 23024 | 53528 | 84032, 114536, 145040, 175544, 206048 |
| 2811 | ACRI5505 | 16842 | 47346 | 77850, 108354, 138858, 169362, 199866 | 8994 | AFNI9600 | 23025 | 53529 | 84033, 114537, 145041, 175545, 206049 |
| 2812 | ACRI5516 | 16843 | 47347 | 77851, 108355, 138859, 169363, 199867 | 8995 | AFNI9602 | 23026 | 53530 | 84034, 114538, 145042, 175546, 206050 |
| 2813 | ACRI5527 | 16844 | 47348 | 77852, 108356, 138860, 169364, 199868 | 8996 | AFNI9604 | 23027 | 53531 | 84035, 114539, 145043, 175547, 206051 |
| 2814 | ACRI5538 | 16845 | 47349 | 77853, 108357, 138861, 169365, 199869 | 8997 | AFNI9606 | 23028 | 53532 | 84036, 114540, 145044, 175548, 206052 |
| 2815 | ACRI5549 | 16846 | 47350 | 77854, 108358, 138862, 169366, 199870 | 8998 | AFNI9608 | 23029 | 53533 | 84037, 114541, 145045, 175549, 206053 |
| 2816 | ACRI5560 | 16847 | 47351 | 77855, 108359, 138863, 169367, 199871 | 8999 | AFNI9610 | 23030 | 53534 | 84038, 114542, 145046, 175550, 206054 |
| 2817 | ACRI5582 | 16848 | 47352 | 77856, 108360, 138864, 169368, 199872 | 9000 | AFNI9612 | 23031 | 53535 | 84039, 114543, 145047, 175551, 206055 |
| 2818 | ACRI5593 | 16849 | 47353 | 77857, 108361, 138865, 169369, 199873 | 9001 | AFNI9614 | 23032 | 53536 | 84040, 114544, 145048, 175552, 206056 |
| 2819 | ACRI5604 | 16850 | 47354 | 77858, 108362, 138866, 169370, 199874 | 9002 | AFNI9618 | 23033 | 53537 | 84041, 114545, 145049, 175553, 206057 |

FIG. 3 continued

| | | | | | | | | | |
|---|---|---|---|---|---|---|---|---|---|
| 2820 | ACR15618 | 16851 | 47355 | 77859, 108363, 138867, 169371, 199875 | 9003 | AFN19620 | 23034 | 53538 | 84042, 114546, 145050, 175554, 206058 |
| 2821 | ACR18924 | 16852 | 47356 | 77860, 108364, 138868, 169372, 199876 | 9004 | AFN19624 | 23035 | 53539 | 84043, 114547, 145051, 175555, 206059 |
| 2822 | ACR18925 | 16853 | 47357 | 77861, 108365, 138869, 169373, 199877 | 9005 | AFN19630 | 23036 | 53540 | 84044, 114548, 145052, 175556, 206060 |
| 2823 | ACR18926 | 16854 | 47358 | 77862, 108366, 138870, 169374, 199878 | 9006 | AFN19632 | 23037 | 53541 | 84045, 114549, 145053, 175557, 206061 |
| 2824 | ACR18927 | 16855 | 47359 | 77863, 108367, 138871, 169375, 199879 | 9007 | AFN19634 | 23038 | 53542 | 84046, 114550, 145054, 175558, 206062 |
| 2825 | ACR18928 | 16856 | 47360 | 77864, 108368, 138872, 169376, 199880 | 9008 | AFN19636 | 23039 | 53543 | 84047, 114551, 145055, 175559, 206063 |
| 2826 | ACR18929 | 16857 | 47361 | 77865, 108369, 138873, 169377, 199881 | 9009 | AFN19638 | 23040 | 53544 | 84048, 114552, 145056, 175560, 206064 |
| 2827 | ACR18930 | 16858 | 47362 | 77866, 108370, 138874, 169378, 199882 | 9010 | AFN19640 | 23041 | 53545 | 84049, 114553, 145057, 175561, 206065 |
| 2828 | ACR18931 | 16859 | 47363 | 77867, 108371, 138875, 169379, 199883 | 9011 | AFN19642 | 23042 | 53546 | 84050, 114554, 145058, 175562, 206066 |
| 2829 | ACR18933 | 16860 | 47364 | 77868, 108372, 138876, 169380, 199884 | 9012 | AFN19644 | 23043 | 53547 | 84051, 114555, 145059, 175563, 206067 |
| 2830 | ACR18934 | 16861 | 47365 | 77869, 108373, 138877, 169381, 199885 | 9013 | AFN19646 | 23044 | 53548 | 84052, 114556, 145060, 175564, 206068 |
| 2831 | ACR18935 | 16862 | 47366 | 77870, 108374, 138878, 169382, 199886 | 9014 | AFN19648 | 23045 | 53549 | 84053, 114557, 145061, 175565, 206069 |
| 2832 | ACR23301 | 16863 | 47367 | 77871, 108375, 138879, 169383, 199887 | 9015 | AFN19650 | 23046 | 53550 | 84054, 114558, 145062, 175566, 206070 |
| 2833 | ACR32997 | 16864 | 47368 | 77872, 108376, 138880, 169384, 199888 | 9016 | AFN19652 | 23047 | 53551 | 84055, 114559, 145063, 175567, 206071 |
| 2834 | ACR33740 | 16865 | 47369 | 77873, 108377, 138881, 169385, 199889 | 9017 | AFN19654 | 23048 | 53552 | 84056, 114560, 145064, 175568, 206072 |
| 2835 | ACR38792 | 16866 | 47370 | 77874, 108378, 138882, 169386, 199890 | 9018 | AFN19656 | 23049 | 53553 | 84057, 114561, 145065, 175569, 206073 |
| 2836 | ACR38793 | 16867 | 47371 | 77875, 108379, 138883, 169387, 199891 | 9019 | AFN19658 | 23050 | 53554 | 84058, 114562, 145066, 175570, 206074 |
| 2837 | ACR38794 | 16868 | 47372 | 77876, 108380, 138884, 169388, 199892 | 9020 | AFN19660 | 23051 | 53555 | 84059, 114563, 145067, 175571, 206075 |

FIG. 3 continued

| | | | | | | | | | |
|---|---|---|---|---|---|---|---|---|---|
| 2838 | ACR38878 | 16869 | 47373 | 77877, 108381, 138885, 169389, 199893 | 9021 | AFN19662 | 23052 | 53556 | 84060, 114564, 145068, 175572, 206076 |
| 2839 | ACR39357 | 16870 | 47374 | 77878, 108382, 138886, 169390, 199894 | 9022 | AFN19664 | 23053 | 53557 | 84061, 114565, 145069, 175573, 206077 |
| 2840 | ACR39396 | 16871 | 47375 | 77879, 108383, 138887, 169391, 199895 | 9023 | AFN19666 | 23054 | 53558 | 84062, 114566, 145070, 175574, 206078 |
| 2841 | ACR39406 | 16872 | 47376 | 77880, 108384, 138888, 169392, 199896 | 9024 | AFN19668 | 23055 | 53559 | 84063, 114567, 145071, 175575, 206079 |
| 2842 | ACR39416 | 16873 | 47377 | 77881, 108385, 138889, 169393, 199897 | 9025 | AFN19670 | 23056 | 53560 | 84064, 114568, 145072, 175576, 206080 |
| 2843 | ACR39426 | 16874 | 47378 | 77882, 108386, 138890, 169394, 199898 | 9026 | AFN19673 | 23057 | 53561 | 84065, 114569, 145073, 175577, 206081 |
| 2844 | ACR39436 | 16875 | 47379 | 77883, 108387, 138891, 169395, 199899 | 9027 | AFN19675 | 23058 | 53562 | 84066, 114570, 145074, 175578, 206082 |
| 2845 | ACR39446 | 16876 | 47380 | 77884, 108388, 138892, 169396, 199900 | 9028 | AFN19677 | 23059 | 53563 | 84067, 114571, 145075, 175579, 206083 |
| 2846 | ACR39456 | 16877 | 47381 | 77885, 108389, 138893, 169397, 199901 | 9029 | AFN19683 | 23060 | 53564 | 84068, 114572, 145076, 175580, 206084 |
| 2847 | ACR39466 | 16878 | 47382 | 77886, 108390, 138894, 169398, 199902 | 9030 | AFN19685 | 23061 | 53565 | 84069, 114573, 145077, 175581, 206085 |
| 2848 | ACR39476 | 16879 | 47383 | 77887, 108391, 138895, 169399, 199903 | 9031 | AFN19687 | 23062 | 53566 | 84070, 114574, 145078, 175582, 206086 |
| 2849 | ACR39486 | 16880 | 47384 | 77888, 108392, 138896, 169400, 199904 | 9032 | AFN19689 | 23063 | 53567 | 84071, 114575, 145079, 175583, 206087 |
| 2850 | ACR39496 | 16881 | 47385 | 77889, 108393, 138897, 169401, 199905 | 9033 | AFN19691 | 23064 | 53568 | 84072, 114576, 145080, 175584, 206088 |
| 2851 | ACR40291 | 16882 | 47386 | 77890, 108394, 138898, 169402, 199906 | 9034 | AFN19693 | 23065 | 53569 | 84073, 114577, 145081, 175585, 206089 |
| 2852 | ACR40301 | 16883 | 47387 | 77891, 108395, 138899, 169403, 199907 | 9035 | AFN19697 | 23066 | 53570 | 84074, 114578, 145082, 175586, 206090 |
| 2853 | ACR40311 | 16884 | 47388 | 77892, 108396, 138900, 169404, 199908 | 9036 | AFN19699 | 23067 | 53571 | 84075, 114579, 145083, 175587, 206091 |
| 2854 | ACR40321 | 16885 | 47389 | 77893, 108397, 138901, 169405, 199909 | 9037 | AFN19701 | 23068 | 53572 | 84076, 114580, 145084, 175588, 206092 |
| 2855 | ACR40341 | 16886 | 47390 | 77894, 108398, 138902, 169406, 199910 | 9038 | AFN19703 | 23069 | 53573 | 84077, 114581, 145085, 175589, 206093 |

FIG. 3 continued

| | | | | | | | | | |
|---|---|---|---|---|---|---|---|---|---|
| 2856 | ACR40351 | 16887 | 47391 | 77895, 108399, 138903, 169407, 199911 | 9039 | AFN19711 | 23070 | 53574 | 84078, 114582, 145086, 175590, 206094 |
| 2857 | ACR40361 | 16888 | 47392 | 77896, 108400, 138904, 169408, 199912 | 9040 | AFN19721 | 23071 | 53575 | 84079, 114583, 145087, 175591, 206095 |
| 2858 | ACR40371 | 16889 | 47393 | 77897, 108401, 138905, 169409, 199913 | 9041 | AFN19731 | 23072 | 53576 | 84080, 114584, 145088, 175592, 206096 |
| 2859 | ACR40391 | 16890 | 47394 | 77898, 108402, 138906, 169410, 199914 | 9042 | AFN19737 | 23073 | 53577 | 84081, 114585, 145089, 175593, 206097 |
| 2860 | ACR46663 | 16891 | 47395 | 77899, 108403, 138907, 169411, 199915 | 9043 | AFN19747 | 23074 | 53578 | 84082, 114586, 145090, 175594, 206098 |
| 2861 | ACR46673 | 16892 | 47396 | 77900, 108404, 138908, 169412, 199916 | 9044 | AFN19749 | 23075 | 53579 | 84083, 114587, 145091, 175595, 206099 |
| 2862 | ACR46996 | 16893 | 47397 | 77901, 108405, 138909, 169413, 199917 | 9045 | AFN19759 | 23076 | 53580 | 84084, 114588, 145092, 175596, 206100 |
| 2863 | ACR46997 | 16894 | 47398 | 77902, 108406, 138910, 169414, 199918 | 9046 | AFN19769 | 23077 | 53581 | 84085, 114589, 145093, 175597, 206101 |
| 2864 | ACR46998 | 16895 | 47399 | 77903, 108407, 138911, 169415, 199919 | 9047 | AFN19783 | 23078 | 53582 | 84086, 114590, 145094, 175598, 206102 |
| 2865 | ACR46999 | 16896 | 47400 | 77904, 108408, 138912, 169416, 199920 | 9048 | AFN19793 | 23079 | 53583 | 84087, 114591, 145095, 175599, 206103 |
| 2866 | ACR47000 | 16897 | 47401 | 77905, 108409, 138913, 169417, 199921 | 9049 | AFN19807 | 23080 | 53584 | 84088, 114592, 145096, 175600, 206104 |
| 2867 | ACR47001 | 16898 | 47402 | 77906, 108410, 138914, 169418, 199922 | 9050 | AFN19809 | 23081 | 53585 | 84089, 114593, 145097, 175601, 206105 |
| 2868 | ACR47002 | 16899 | 47403 | 77907, 108411, 138915, 169419, 199923 | 9051 | AFN19815 | 23082 | 53586 | 84090, 114594, 145098, 175602, 206106 |
| 2869 | ACR47003 | 16900 | 47404 | 77908, 108412, 138916, 169420, 199924 | 9052 | AFN19833 | 23083 | 53587 | 84091, 114595, 145099, 175603, 206107 |
| 2870 | ACR47008 | 16901 | 47405 | 77909, 108413, 138917, 169421, 199925 | 9053 | AFN19851 | 23084 | 53588 | 84092, 114596, 145100, 175604, 206108 |
| 2871 | ACR49267 | 16902 | 47406 | 77910, 108414, 138918, 169422, 199926 | 9054 | AFN19857 | 23085 | 53589 | 84093, 114597, 145101, 175605, 206109 |
| 2872 | ACR49268 | 16903 | 47407 | 77911, 108415, 138919, 169423, 199927 | 9055 | AFN19867 | 23086 | 53590 | 84094, 114598, 145102, 175606, 206110 |
| 2873 | ACR49269 | 16904 | 47408 | 77912, 108416, 138920, 169424, 199928 | 9056 | AFN19877 | 23087 | 53591 | 84095, 114599, 145103, 175607, 206111 |

FIG. 3 continued

| | | | | | | | | | |
|---|---|---|---|---|---|---|---|---|---|
| 2874 | ACR49270 | 16905 | 47409 | 77913, 108417, 138921, 169425, 199929 | 9057 | AFN19887 | 23088 | 53592 | 84096, 114600, 145104, 175608, 206112 |
| 2875 | ACR49271 | 16906 | 47410 | 77914, 108418, 138922, 169426, 199930 | 9058 | AFN19897 | 23089 | 53593 | 84097, 114601, 145105, 175609, 206113 |
| 2876 | ACR49272 | 16907 | 47411 | 77915, 108419, 138923, 169427, 199931 | 9059 | AFN19907 | 23090 | 53594 | 84098, 114602, 145106, 175610, 206114 |
| 2877 | ACR49273 | 16908 | 47412 | 77916, 108420, 138924, 169428, 199932 | 9060 | AFN19917 | 23091 | 53595 | 84099, 114603, 145107, 175611, 206115 |
| 2878 | ACR49274 | 16909 | 47413 | 77917, 108421, 138925, 169429, 199933 | 9061 | AFN19923 | 23092 | 53596 | 84100, 114604, 145108, 175612, 206116 |
| 2879 | ACR49275 | 16910 | 47414 | 77918, 108422, 138926, 169430, 199934 | 9062 | AFN19933 | 23093 | 53597 | 84101, 114605, 145109, 175613, 206117 |
| 2880 | ACR49277 | 16911 | 47415 | 77919, 108423, 138927, 169431, 199935 | 9063 | AFN19943 | 23094 | 53598 | 84102, 114606, 145110, 175614, 206118 |
| 2881 | ACR49278 | 16912 | 47416 | 77920, 108424, 138928, 169432, 199936 | 9064 | AFN19953 | 23095 | 53599 | 84103, 114607, 145111, 175615, 206119 |
| 2882 | ACR49279 | 16913 | 47417 | 77921, 108425, 138929, 169433, 199937 | 9065 | AFN19967 | 23096 | 53600 | 84104, 114608, 145112, 175616, 206120 |
| 2883 | ACR50994 | 16914 | 47418 | 77922, 108426, 138930, 169434, 199938 | 9066 | AFN19973 | 23097 | 53601 | 84105, 114609, 145113, 175617, 206121 |
| 2884 | ACR50998 | 16915 | 47419 | 77923, 108427, 138931, 169435, 199939 | 9067 | AFN19979 | 23098 | 53602 | 84106, 114610, 145114, 175618, 206122 |
| 2885 | ACR51008 | 16916 | 47420 | 77924, 108428, 138932, 169436, 199940 | 9068 | AFN19985 | 23099 | 53603 | 84107, 114611, 145115, 175619, 206123 |
| 2886 | ACR51018 | 16917 | 47421 | 77925, 108429, 138933, 169437, 199941 | 9069 | AFN19995 | 23100 | 53604 | 84108, 114612, 145116, 175620, 206124 |
| 2887 | ACR51028 | 16918 | 47422 | 77926, 108430, 138934, 169438, 199942 | 9070 | AFN20001 | 23101 | 53605 | 84109, 114613, 145117, 175621, 206125 |
| 2888 | ACR51038 | 16919 | 47423 | 77927, 108431, 138935, 169439, 199943 | 9071 | AFN20013 | 23102 | 53606 | 84110, 114614, 145118, 175622, 206126 |
| 2889 | ACR51048 | 16920 | 47424 | 77928, 108432, 138936, 169440, 199944 | 9072 | AFN20020 | 23103 | 53607 | 84111, 114615, 145119, 175623, 206127 |
| 2890 | ACR51058 | 16921 | 47425 | 77929, 108433, 138937, 169441, 199945 | 9073 | AFN20022 | 23104 | 53608 | 84112, 114616, 145120, 175624, 206128 |
| 2891 | ACR51068 | 16922 | 47426 | 77930, 108434, 138938, 169442, 199946 | 9074 | AFN20035 | 23105 | 53609 | 84113, 114617, 145121, 175625, 206129 |

FIG. 3 continued

| | | | | | | | | | |
|---|---|---|---|---|---|---|---|---|---|
| 2892 | ACR52371 | 16923 | 47427 | 77931, 108435, 138939, 169443, 199947 | 9075 | AFN20041 | 23106 | 53610 | 84114, 114618, 145122, 175626, 206130 |
| 2893 | ACR52381 | 16924 | 47428 | 77932, 108436, 138940, 169444, 199948 | 9076 | AFN20047 | 23107 | 53611 | 84115, 114619, 145123, 175627, 206131 |
| 2894 | ACR52391 | 16925 | 47429 | 77933, 108437, 138941, 169445, 199949 | 9077 | AFN20063 | 23108 | 53612 | 84116, 114620, 145124, 175628, 206132 |
| 2895 | ACR52401 | 16926 | 47430 | 77934, 108438, 138942, 169446, 199950 | 9078 | AFN20077 | 23109 | 53613 | 84117, 114621, 145125, 175629, 206133 |
| 2896 | ACR52411 | 16927 | 47431 | 77935, 108439, 138943, 169447, 199951 | 9079 | AFN20083 | 23110 | 53614 | 84118, 114622, 145126, 175630, 206134 |
| 2897 | ACR52421 | 16928 | 47432 | 77936, 108440, 138944, 169448, 199952 | 9080 | AFN20094 | 23111 | 53615 | 84119, 114623, 145127, 175631, 206135 |
| 2898 | ACR52431 | 16929 | 47433 | 77937, 108441, 138945, 169449, 199953 | 9081 | AFN20100 | 23112 | 53616 | 84120, 114624, 145128, 175632, 206136 |
| 2899 | ACR52441 | 16930 | 47434 | 77938, 108442, 138946, 169450, 199954 | 9082 | AFN20114 | 23113 | 53617 | 84121, 114625, 145129, 175633, 206137 |
| 2900 | ACR52451 | 16931 | 47435 | 77939, 108443, 138947, 169451, 199955 | 9083 | AFN20128 | 23114 | 53618 | 84122, 114626, 145130, 175634, 206138 |
| 2901 | ACR52471 | 16932 | 47436 | 77940, 108444, 138948, 169452, 199956 | 9084 | AFN87935 | 23115 | 53619 | 84123, 114627, 145131, 175635, 206139 |
| 2902 | ACR52481 | 16933 | 47437 | 77941, 108445, 138949, 169453, 199957 | 9085 | AFN87937 | 23116 | 53620 | 84124, 114628, 145132, 175636, 206140 |
| 2903 | ACR52491 | 16934 | 47438 | 77942, 108446, 138950, 169454, 199958 | 9086 | AFN87940 | 23117 | 53621 | 84125, 114629, 145133, 175637, 206141 |
| 2904 | ACR54046 | 16935 | 47439 | 77943, 108447, 138951, 169455, 199959 | 9087 | AFN87942 | 23118 | 53622 | 84126, 114630, 145134, 175638, 206142 |
| 2905 | ACR54052 | 16936 | 47440 | 77944, 108448, 138952, 169456, 199960 | 9088 | AFN87944 | 23119 | 53623 | 84127, 114631, 145135, 175639, 206143 |
| 2906 | ACR54966 | 16937 | 47441 | 77945, 108449, 138953, 169457, 199961 | 9089 | AFN87946 | 23120 | 53624 | 84128, 114632, 145136, 175640, 206144 |
| 2907 | ACR54976 | 16938 | 47442 | 77946, 108450, 138954, 169458, 199962 | 9090 | AFN87948 | 23121 | 53625 | 84129, 114633, 145137, 175641, 206145 |
| 2908 | ACR54986 | 16939 | 47443 | 77947, 108451, 138955, 169459, 199963 | 9091 | AFN87950 | 23122 | 53626 | 84130, 114634, 145138, 175642, 206146 |
| 2909 | ACR54996 | 16940 | 47444 | 77948, 108452, 138956, 169460, 199964 | 9092 | AFN87952 | 23123 | 53627 | 84131, 114635, 145139, 175643, 206147 |

FIG. 3 continued

| | | | | | | | | | |
|---|---|---|---|---|---|---|---|---|---|
| 2910 | ACR55006 | 16941 | 47445 | 77949, 108453, 138957, 169461, 199965 | 9093 | AFN87954 | 23124 | 53628 | 84132, 114636, 145140, 175644, 206148 |
| 2911 | ACR56383 | 16942 | 47446 | 77950, 108454, 138958, 169462, 199966 | 9094 | AFN87956 | 23125 | 53629 | 84133, 114637, 145141, 175645, 206149 |
| 2912 | ACR56393 | 16943 | 47447 | 77951, 108455, 138959, 169463, 199967 | 9095 | AFN87958 | 23126 | 53630 | 84134, 114638, 145142, 175646, 206150 |
| 2913 | ACR56403 | 16944 | 47448 | 77952, 108456, 138960, 169464, 199968 | 9096 | AFN87960 | 23127 | 53631 | 84135, 114639, 145143, 175647, 206151 |
| 2914 | ACR56413 | 16945 | 47449 | 77953, 108457, 138961, 169465, 199969 | 9097 | AFO64805 | 23128 | 53632 | 84136, 114640, 145144, 175648, 206152 |
| 2915 | ACR56423 | 16946 | 47450 | 77954, 108458, 138962, 169466, 199970 | 9098 | AFO64816 | 23129 | 53633 | 84137, 114641, 145145, 175649, 206153 |
| 2916 | ACR56433 | 16947 | 47451 | 77955, 108459, 138963, 169467, 199971 | 9099 | AFO64827 | 23130 | 53634 | 84138, 114642, 145146, 175650, 206154 |
| 2917 | ACR56443 | 16948 | 47452 | 77956, 108460, 138964, 169468, 199972 | 9100 | AFO64838 | 23131 | 53635 | 84139, 114643, 145147, 175651, 206155 |
| 2918 | ACR56453 | 16949 | 47453 | 77957, 108461, 138965, 169469, 199973 | 9101 | AFO64849 | 23132 | 53636 | 84140, 114644, 145148, 175652, 206156 |
| 2919 | ACR58555 | 16950 | 47454 | 77958, 108462, 138966, 169470, 199974 | 9102 | AFO64860 | 23133 | 53637 | 84141, 114645, 145149, 175653, 206157 |
| 2920 | ACR61658 | 16951 | 47455 | 77959, 108463, 138967, 169471, 199975 | 9103 | AFO64871 | 23134 | 53638 | 84142, 114646, 145150, 175654, 206158 |
| 2921 | ACR61680 | 16952 | 47456 | 77960, 108464, 138968, 169472, 199976 | 9104 | AFO64882 | 23135 | 53639 | 84143, 114647, 145151, 175655, 206159 |
| 2922 | ACR61691 | 16953 | 47457 | 77961, 108465, 138969, 169473, 199977 | 9105 | AFO64893 | 23136 | 53640 | 84144, 114648, 145152, 175656, 206160 |
| 2923 | ACR61702 | 16954 | 47458 | 77962, 108466, 138970, 169474, 199978 | 9106 | AFO64904 | 23137 | 53641 | 84145, 114649, 145153, 175657, 206161 |
| 2924 | ACR67201 | 16955 | 47459 | 77963, 108467, 138971, 169475, 199979 | 9107 | AFO65019 | 23138 | 53642 | 84146, 114650, 145154, 175658, 206162 |
| 2925 | ACR67202 | 16956 | 47460 | 77964, 108468, 138972, 169476, 199980 | 9108 | AFO65030 | 23139 | 53643 | 84147, 114651, 145155, 175659, 206163 |
| 2926 | ACR67203 | 16957 | 47461 | 77965, 108469, 138973, 169477, 199981 | 9109 | AFO65041 | 23140 | 53644 | 84148, 114652, 145156, 175660, 206164 |
| 2927 | ACR67204 | 16958 | 47462 | 77966, 108470, 138974, 169478, 199982 | 9110 | AFO65052 | 23141 | 53645 | 84149, 114653, 145157, 175661, 206165 |

FIG. 3 continued

| | | | | | | | | | |
|---|---|---|---|---|---|---|---|---|---|
| 2928 | ACR67246 | 16959 | 47463 | 77967, 108471, 138975, 169479, 199983 | 9111 | AFO66139 | 23142 | 53646 | 84150, 114654, 145158, 175662, 206166 |
| 2929 | ACR67256 | 16960 | 47464 | 77968, 108472, 138976, 169480, 199984 | 9112 | AFO66150 | 23143 | 53647 | 84151, 114655, 145159, 175663, 206167 |
| 2930 | ACR77451 | 16961 | 47465 | 77969, 108473, 138977, 169481, 199985 | 9113 | AFO66161 | 23144 | 53648 | 84152, 114656, 145160, 175664, 206168 |
| 2931 | ACR77461 | 16962 | 47466 | 77970, 108474, 138978, 169482, 199986 | 9114 | AFO66172 | 23145 | 53649 | 84153, 114657, 145161, 175665, 206169 |
| 2932 | ACR77471 | 16963 | 47467 | 77971, 108475, 138979, 169483, 199987 | 9115 | AFO66183 | 23146 | 53650 | 84154, 114658, 145162, 175666, 206170 |
| 2933 | ACR77481 | 16964 | 47468 | 77972, 108476, 138980, 169484, 199988 | 9116 | AFO66194 | 23147 | 53651 | 84155, 114659, 145163, 175667, 206171 |
| 2934 | ACR77491 | 16965 | 47469 | 77973, 108477, 138981, 169485, 199989 | 9117 | AFO66205 | 23148 | 53652 | 84156, 114660, 145164, 175668, 206172 |
| 2935 | ACR77501 | 16966 | 47470 | 77974, 108478, 138982, 169486, 199990 | 9118 | AFO66216 | 23149 | 53653 | 84157, 114661, 145165, 175669, 206173 |
| 2936 | ACR83527 | 16967 | 47471 | 77975, 108479, 138983, 169487, 199991 | 9119 | AFO66227 | 23150 | 53654 | 84158, 114662, 145166, 175670, 206174 |
| 2937 | ACR83539 | 16968 | 47472 | 77976, 108480, 138984, 169488, 199992 | 9120 | AFO66238 | 23151 | 53655 | 84159, 114663, 145167, 175671, 206175 |
| 2938 | ACS14669 | 16969 | 47473 | 77977, 108481, 138985, 169489, 199993 | 9121 | AFO66249 | 23152 | 53656 | 84160, 114664, 145168, 175672, 206176 |
| 2939 | ACS14679 | 16970 | 47474 | 77978, 108482, 138986, 169490, 199994 | 9122 | AFP33330 | 23153 | 53657 | 84161, 114665, 145169, 175673, 206177 |
| 2940 | ACS14689 | 16971 | 47475 | 77979, 108483, 138987, 169491, 199995 | 9123 | AFP33331 | 23154 | 53658 | 84162, 114666, 145170, 175674, 206178 |
| 2941 | ACS14699 | 16972 | 47476 | 77980, 108484, 138988, 169492, 199996 | 9124 | AFQ32576 | 23155 | 53659 | 84163, 114667, 145171, 175675, 206179 |
| 2942 | ACS14709 | 16973 | 47477 | 77981, 108485, 138989, 169493, 199997 | 9125 | AFQ37282 | 23156 | 53660 | 84164, 114668, 145172, 175676, 206180 |
| 2943 | ACS14719 | 16974 | 47478 | 77982, 108486, 138990, 169494, 199998 | 9126 | AFQ55691 | 23157 | 53661 | 84165, 114669, 145173, 175677, 206181 |
| 2944 | ACS14729 | 16975 | 47479 | 77983, 108487, 138991, 169495, 199999 | 9127 | AFR68156 | 23158 | 53662 | 84166, 114670, 145174, 175678, 206182 |
| 2945 | ACS14739 | 16976 | 47480 | 77984, 108488, 138992, 169496, 200000 | 9128 | AFR68166 | 23159 | 53663 | 84167, 114671, 145175, 175679, 206183 |

FIG. 3 continued

| | | | | | | | | | |
|---|---|---|---|---|---|---|---|---|---|
| 2946 | ACS27192 | 16977 | 47481 | 77985, 108489, 138993, 169497, 200001 | 9129 | AFR68176 | 23160 | 53664 | 84168, 114672, 145176, 175680, 206184 |
| 2947 | ACS27202 | 16978 | 47482 | 77986, 108490, 138994, 169498, 200002 | 9130 | AFR84677 | 23161 | 53665 | 84169, 114673, 145177, 175681, 206185 |
| 2948 | ACS27212 | 16979 | 47483 | 77987, 108491, 138995, 169499, 200003 | 9131 | AFR84687 | 23162 | 53666 | 84170, 114674, 145178, 175682, 206186 |
| 2949 | ACS27222 | 16980 | 47484 | 77988, 108492, 138996, 169500, 200004 | 9132 | AFR84696 | 23163 | 53667 | 84171, 114675, 145179, 175683, 206187 |
| 2950 | ACS27232 | 16981 | 47485 | 77989, 108493, 138997, 169501, 200005 | 9133 | AFR84706 | 23164 | 53668 | 84172, 114676, 145180, 175684, 206188 |
| 2951 | ACS27242 | 16982 | 47486 | 77990, 108494, 138998, 169502, 200006 | 9134 | AFR84716 | 23165 | 53669 | 84173, 114677, 145181, 175685, 206189 |
| 2952 | ACS27252 | 16983 | 47487 | 77991, 108495, 138999, 169503, 200007 | 9135 | AFR84726 | 23166 | 53670 | 84174, 114678, 145182, 175686, 206190 |
| 2953 | ACS27771 | 16984 | 47488 | 77992, 108496, 139000, 169504, 200008 | 9136 | AFR84736 | 23167 | 53671 | 84175, 114679, 145183, 175687, 206191 |
| 2954 | ACS34969 | 16985 | 47489 | 77993, 108497, 139001, 169505, 200009 | 9137 | AFR84746 | 23168 | 53672 | 84176, 114680, 145184, 175688, 206192 |
| 2955 | ACS34970 | 16986 | 47490 | 77994, 108498, 139002, 169506, 200010 | 9138 | AFR84756 | 23169 | 53673 | 84177, 114681, 145185, 175689, 206193 |
| 2956 | ACS34971 | 16987 | 47491 | 77995, 108499, 139003, 169507, 200011 | 9139 | AFR84766 | 23170 | 53674 | 84178, 114682, 145186, 175690, 206194 |
| 2957 | ACS34972 | 16988 | 47492 | 77996, 108500, 139004, 169508, 200012 | 9140 | AFR84776 | 23171 | 53675 | 84179, 114683, 145187, 175691, 206195 |
| 2958 | ACS50081 | 16989 | 47493 | 77997, 108501, 139005, 169509, 200013 | 9141 | AFR84786 | 23172 | 53676 | 84180, 114684, 145188, 175692, 206196 |
| 2959 | ACS50087 | 16990 | 47494 | 77998, 108502, 139006, 169510, 200014 | 9142 | AFR84796 | 23173 | 53677 | 84181, 114685, 145189, 175693, 206197 |
| 2960 | ACS50094 | 16991 | 47495 | 77999, 108503, 139007, 169511, 200015 | 9143 | AFR84806 | 23174 | 53678 | 84182, 114686, 145190, 175694, 206198 |
| 2961 | ACS54264 | 16992 | 47496 | 78000, 108504, 139008, 169512, 200016 | 9144 | AFR84816 | 23175 | 53679 | 84183, 114687, 145191, 175695, 206199 |
| 2962 | ACS54265 | 16993 | 47497 | 78001, 108505, 139009, 169513, 200017 | 9145 | AFR84826 | 23176 | 53680 | 84184, 114688, 145192, 175696, 206200 |
| 2963 | ACS54266 | 16994 | 47498 | 78002, 108506, 139010, 169514, 200018 | 9146 | AFR84836 | 23177 | 53681 | 84185, 114689, 145193, 175697, 206201 |

FIG. 3 continued

| | | | | | | | | | |
|---|---|---|---|---|---|---|---|---|---|
| 2964 | ACS54267 | 16995 | 47499 | 78003, 108507, 139011, 169515, 200019 | 9147 | AFR84846 | 23178 | 53682 | 84186, 114690, 145194, 175698, 206202 |
| 2965 | ACS54268 | 16996 | 47500 | 78004, 108508, 139012, 169516, 200020 | 9148 | AFR84856 | 23179 | 53683 | 84187, 114691, 145195, 175699, 206203 |
| 2966 | ACS54303 | 16997 | 47501 | 78005, 108509, 139013, 169517, 200021 | 9149 | AFR84866 | 23180 | 53684 | 84188, 114692, 145196, 175700, 206204 |
| 2967 | ACS68823 | 16998 | 47502 | 78006, 108510, 139014, 169518, 200022 | 9150 | AFR84876 | 23181 | 53685 | 84189, 114693, 145197, 175701, 206205 |
| 2968 | ACS75824 | 16999 | 47503 | 78007, 108511, 139015, 169519, 200023 | 9151 | AFR84895 | 23182 | 53686 | 84190, 114694, 145198, 175702, 206206 |
| 2969 | ACS77929 | 17000 | 47504 | 78008, 108512, 139016, 169520, 200024 | 9152 | AFR84905 | 23183 | 53687 | 84191, 114695, 145199, 175703, 206207 |
| 2970 | ACS77939 | 17001 | 47505 | 78009, 108513, 139017, 169521, 200025 | 9153 | AFR84915 | 23184 | 53688 | 84192, 114696, 145200, 175704, 206208 |
| 2971 | ACS77949 | 17002 | 47506 | 78010, 108514, 139018, 169522, 200026 | 9154 | AFR84925 | 23185 | 53689 | 84193, 114697, 145201, 175705, 206209 |
| 2972 | ACS77959 | 17003 | 47507 | 78011, 108515, 139019, 169523, 200027 | 9155 | AFU83119 | 23186 | 53690 | 84194, 114698, 145202, 175706, 206210 |
| 2973 | ACS77969 | 17004 | 47508 | 78012, 108516, 139020, 169524, 200028 | 9156 | AFV53208 | 23187 | 53691 | 84195, 114699, 145203, 175707, 206211 |
| 2974 | ACS77979 | 17005 | 47509 | 78013, 108517, 139021, 169525, 200029 | 9157 | AFV53219 | 23188 | 53692 | 84196, 114700, 145204, 175708, 206212 |
| 2975 | ACS77989 | 17006 | 47510 | 78014, 108518, 139022, 169526, 200030 | 9158 | AFV53230 | 23189 | 53693 | 84197, 114701, 145205, 175709, 206213 |
| 2976 | ACS77999 | 17007 | 47511 | 78015, 108519, 139023, 169527, 200031 | 9159 | AFV53241 | 23190 | 53694 | 84198, 114702, 145206, 175710, 206214 |
| 2977 | ACS78009 | 17008 | 47512 | 78016, 108520, 139024, 169528, 200032 | 9160 | AFV53252 | 23191 | 53695 | 84199, 114703, 145207, 175711, 206215 |
| 2978 | ACS78019 | 17009 | 47513 | 78017, 108521, 139025, 169529, 200033 | 9161 | AFV53263 | 23192 | 53696 | 84200, 114704, 145208, 175712, 206216 |
| 2979 | ACS78039 | 17010 | 47514 | 78018, 108522, 139026, 169530, 200034 | 9162 | AFV53274 | 23193 | 53697 | 84201, 114705, 145209, 175713, 206217 |
| 2980 | ACS78049 | 17011 | 47515 | 78019, 108523, 139027, 169531, 200035 | 9163 | AFV53285 | 23194 | 53698 | 84202, 114706, 145210, 175714, 206218 |
| 2981 | ACS88274 | 17012 | 47516 | 78020, 108524, 139028, 169532, 200036 | 9164 | AFV53296 | 23195 | 53699 | 84203, 114707, 145211, 175715, 206219 |

FIG. 3 continued

| | | | | | | | | | |
|---|---|---|---|---|---|---|---|---|---|
| 2982 | ACS88275 | 17013 | 47517 | 78021, 108525, 139029, 169533, 200037 | 9165 | AFV53307 | 23196 | 53700 | 84204, 114708, 145212, 175716, 206220 |
| 2983 | ACS92572 | 17014 | 47518 | 78022, 108526, 139030, 169534, 200038 | 9166 | AFV53317 | 23197 | 53701 | 84205, 114709, 145213, 175717, 206221 |
| 2984 | ACS92582 | 17015 | 47519 | 78023, 108527, 139031, 169535, 200039 | 9167 | AFV53328 | 23198 | 53702 | 84206, 114710, 145214, 175718, 206222 |
| 2985 | ACS92592 | 17016 | 47520 | 78024, 108528, 139032, 169536, 200040 | 9168 | AFV53339 | 23199 | 53703 | 84207, 114711, 145215, 175719, 206223 |
| 2986 | ACS92603 | 17017 | 47521 | 78025, 108529, 139033, 169537, 200041 | 9169 | AFX96367 | 23200 | 53704 | 84208, 114712, 145216, 175720, 206224 |
| 2987 | ACS92614 | 17018 | 47522 | 78026, 108530, 139034, 169538, 200042 | 9170 | AFX96386 | 23201 | 53705 | 84209, 114713, 145217, 175721, 206225 |
| 2988 | ACT09115 | 17019 | 47523 | 78027, 108531, 139035, 169539, 200043 | 9171 | AFX96401 | 23202 | 53706 | 84210, 114714, 145218, 175722, 206226 |
| 2989 | ACT10309 | 17020 | 47524 | 78028, 108532, 139036, 169540, 200044 | 9172 | AFX96411 | 23203 | 53707 | 84211, 114715, 145219, 175723, 206227 |
| 2990 | ACT10315 | 17021 | 47525 | 78029, 108533, 139037, 169541, 200045 | 9173 | AFX96421 | 23204 | 53708 | 84212, 114716, 145220, 175724, 206228 |
| 2991 | ACT11059 | 17022 | 47526 | 78030, 108534, 139038, 169542, 200046 | 9174 | AFX96431 | 23205 | 53709 | 84213, 114717, 145221, 175725, 206229 |
| 2992 | ACT15313 | 17023 | 47527 | 78031, 108535, 139039, 169543, 200047 | 9175 | AFX96441 | 23206 | 53710 | 84214, 114718, 145222, 175726, 206230 |
| 2993 | ACT15315 | 17024 | 47528 | 78032, 108536, 139040, 169544, 200048 | 9176 | AFX96451 | 23207 | 53711 | 84215, 114719, 145223, 175727, 206231 |
| 2994 | ACT15319 | 17025 | 47529 | 78033, 108537, 139041, 169545, 200049 | 9177 | AFX96461 | 23208 | 53712 | 84216, 114720, 145224, 175728, 206232 |
| 2995 | ACT15321 | 17026 | 47530 | 78034, 108538, 139042, 169546, 200050 | 9178 | AFX96471 | 23209 | 53713 | 84217, 114721, 145225, 175729, 206233 |
| 2996 | ACT15323 | 17027 | 47531 | 78035, 108539, 139043, 169547, 200051 | 9179 | AFX96481 | 23210 | 53714 | 84218, 114722, 145226, 175730, 206234 |
| 2997 | ACT15325 | 17028 | 47532 | 78036, 108540, 139044, 169548, 200052 | 9180 | AFX96491 | 23211 | 53715 | 84219, 114723, 145227, 175731, 206235 |
| 2998 | ACT15327 | 17029 | 47533 | 78037, 108541, 139045, 169549, 200053 | 9181 | AFX96501 | 23212 | 53716 | 84220, 114724, 145228, 175732, 206236 |
| 2999 | ACT15331 | 17030 | 47534 | 78038, 108542, 139046, 169550, 200054 | 9182 | AFX96511 | 23213 | 53717 | 84221, 114725, 145229, 175733, 206237 |

FIG. 3 continued

| | | | | | | | | | |
|---|---|---|---|---|---|---|---|---|---|
| 3000 | ACT15333 | 17031 | 47535 | 78039, 108543, 139047, 169551, 200055 | 9183 | AFX96521 | 23214 | 53718 | 84222, 114726, 145230, 175734, 206238 |
| 3001 | ACT15335 | 17032 | 47536 | 78040, 108544, 139048, 169552, 200056 | 9184 | AFX96531 | 23215 | 53719 | 84223, 114727, 145231, 175735, 206239 |
| 3002 | ACT15337 | 17033 | 47537 | 78041, 108545, 139049, 169553, 200057 | 9185 | AFX96541 | 23216 | 53720 | 84224, 114728, 145232, 175736, 206240 |
| 3003 | ACT15341 | 17034 | 47538 | 78042, 108546, 139050, 169554, 200058 | 9186 | AFX96551 | 23217 | 53721 | 84225, 114729, 145233, 175737, 206241 |
| 3004 | ACT15344 | 17035 | 47539 | 78043, 108547, 139051, 169555, 200059 | 9187 | AFX96561 | 23218 | 53722 | 84226, 114730, 145234, 175738, 206242 |
| 3005 | ACT15346 | 17036 | 47540 | 78044, 108548, 139052, 169556, 200060 | 9188 | AFX96571 | 23219 | 53723 | 84227, 114731, 145235, 175739, 206243 |
| 3006 | ACT15348 | 17037 | 47541 | 78045, 108549, 139053, 169557, 200061 | 9189 | AFX96581 | 23220 | 53724 | 84228, 114732, 145236, 175740, 206244 |
| 3007 | ACT15350 | 17038 | 47542 | 78046, 108550, 139054, 169558, 200062 | 9190 | AFX96591 | 23221 | 53725 | 84229, 114733, 145237, 175741, 206245 |
| 3008 | ACT15352 | 17039 | 47543 | 78047, 108551, 139055, 169559, 200063 | 9191 | AFX96601 | 23222 | 53726 | 84230, 114734, 145238, 175742, 206246 |
| 3009 | ACT15354 | 17040 | 47544 | 78048, 108552, 139056, 169560, 200064 | 9192 | AFX96611 | 23223 | 53727 | 84231, 114735, 145239, 175743, 206247 |
| 3010 | ACT15356 | 17041 | 47545 | 78049, 108553, 139057, 169561, 200065 | 9193 | AFX96621 | 23224 | 53728 | 84232, 114736, 145240, 175744, 206248 |
| 3011 | ACT15358 | 17042 | 47546 | 78050, 108554, 139058, 169562, 200066 | 9194 | AFX96631 | 23225 | 53729 | 84233, 114737, 145241, 175745, 206249 |
| 3012 | ACT21515 | 17043 | 47547 | 78051, 108555, 139059, 169563, 200067 | 9195 | AFX96641 | 23226 | 53730 | 84234, 114738, 145242, 175746, 206250 |
| 3013 | ACT21516 | 17044 | 47548 | 78052, 108556, 139060, 169564, 200068 | 9196 | AFX96651 | 23227 | 53731 | 84235, 114739, 145243, 175747, 206251 |
| 3014 | ACT21517 | 17045 | 47549 | 78053, 108557, 139061, 169565, 200069 | 9197 | AFX96661 | 23228 | 53732 | 84236, 114740, 145244, 175748, 206252 |
| 3015 | ACT21574 | 17046 | 47550 | 78054, 108558, 139062, 169566, 200070 | 9198 | AFX96671 | 23229 | 53733 | 84237, 114741, 145245, 175749, 206253 |
| 3016 | ACT21585 | 17047 | 47551 | 78055, 108559, 139063, 169567, 200071 | 9199 | AFX96681 | 23230 | 53734 | 84238, 114742, 145246, 175750, 206254 |
| 3017 | ACT22011 | 17048 | 47552 | 78056, 108560, 139064, 169568, 200072 | 9200 | AFX96691 | 23231 | 53735 | 84239, 114743, 145247, 175751, 206255 |

FIG. 3 continued

| | | | | | | | | | |
|---|---|---|---|---|---|---|---|---|---|
| 3018 | ACT22012 | 17049 | 47553 | 78057, 108561, 139065, 169569, 200073 | 9201 | AFX96701 | 23232 | 53736 | 84240, 114744, 145248, 175752, 206256 |
| 3019 | ACT22013 | 17050 | 47554 | 78058, 108562, 139066, 169570, 200074 | 9202 | AFX96711 | 23233 | 53737 | 84241, 114745, 145249, 175753, 206257 |
| 3020 | ACT22014 | 17051 | 47555 | 78059, 108563, 139067, 169571, 200075 | 9203 | AFX96721 | 23234 | 53738 | 84242, 114746, 145250, 175754, 206258 |
| 3021 | ACT22015 | 17052 | 47556 | 78060, 108564, 139068, 169572, 200076 | 9204 | AFX96731 | 23235 | 53739 | 84243, 114747, 145251, 175755, 206259 |
| 3022 | ACT22016 | 17053 | 47557 | 78061, 108565, 139069, 169573, 200077 | 9205 | AFX96741 | 23236 | 53740 | 84244, 114748, 145252, 175756, 206260 |
| 3023 | ACT22017 | 17054 | 47558 | 78062, 108566, 139070, 169574, 200078 | 9206 | AFX96751 | 23237 | 53741 | 84245, 114749, 145253, 175757, 206261 |
| 3024 | ACT22018 | 17055 | 47559 | 78063, 108567, 139071, 169575, 200079 | 9207 | AFX96761 | 23238 | 53742 | 84246, 114750, 145254, 175758, 206262 |
| 3025 | ACT22506 | 17056 | 47560 | 78064, 108568, 139072, 169576, 200080 | 9208 | AFX96771 | 23239 | 53743 | 84247, 114751, 145255, 175759, 206263 |
| 3026 | ACT22511 | 17057 | 47561 | 78065, 108569, 139073, 169577, 200081 | 9209 | AFX96791 | 23240 | 53744 | 84248, 114752, 145256, 175760, 206264 |
| 3027 | ACT33121 | 17058 | 47562 | 78066, 108570, 139074, 169578, 200082 | 9210 | AFX96801 | 23241 | 53745 | 84249, 114753, 145257, 175761, 206265 |
| 3028 | ACT33124 | 17059 | 47563 | 78067, 108571, 139075, 169579, 200083 | 9211 | AFX96811 | 23242 | 53746 | 84250, 114754, 145258, 175762, 206266 |
| 3029 | ACT33126 | 17060 | 47564 | 78068, 108572, 139076, 169580, 200084 | 9212 | AFX96821 | 23243 | 53747 | 84251, 114755, 145259, 175763, 206267 |
| 3030 | ACT35526 | 17061 | 47565 | 78069, 108573, 139077, 169581, 200085 | 9213 | AFX96831 | 23244 | 53748 | 84252, 114756, 145260, 175764, 206268 |
| 3031 | ACT36507 | 17062 | 47566 | 78070, 108574, 139078, 169582, 200086 | 9214 | AFX96841 | 23245 | 53749 | 84253, 114757, 145261, 175765, 206269 |
| 3032 | ACT36672 | 17063 | 47567 | 78071, 108575, 139079, 169583, 200087 | 9215 | AFX96859 | 23246 | 53750 | 84254, 114758, 145262, 175766, 206270 |
| 3033 | ACT36673 | 17064 | 47568 | 78072, 108576, 139080, 169584, 200088 | 9216 | AFX96907 | 23247 | 53751 | 84255, 114759, 145263, 175767, 206271 |
| 3034 | ACT36674 | 17065 | 47569 | 78073, 108577, 139081, 169585, 200089 | 9217 | AFX96917 | 23248 | 53752 | 84256, 114760, 145264, 175768, 206272 |
| 3035 | ACT36675 | 17066 | 47570 | 78074, 108578, 139082, 169586, 200090 | 9218 | AFX96927 | 23249 | 53753 | 84257, 114761, 145265, 175769, 206273 |

FIG. 3 continued

| | | | | | | | | | |
|---|---|---|---|---|---|---|---|---|---|
| 3036 | ACT36677 | 17067 | 47571 | 78075, 108579, 139083, 169587, 200091 | 9219 | AFX96937 | 23250 | 53754 | 84258, 114762, 145266, 175770, 206274 |
| 3037 | ACT36678 | 17068 | 47572 | 78076, 108580, 139084, 169588, 200092 | 9220 | AFY23991 | 23251 | 53755 | 84259, 114763, 145267, 175771, 206275 |
| 3038 | ACT36679 | 17069 | 47573 | 78077, 108581, 139085, 169589, 200093 | 9221 | AFY24001 | 23252 | 53756 | 84260, 114764, 145268, 175772, 206276 |
| 3039 | ACT36680 | 17070 | 47574 | 78078, 108582, 139086, 169590, 200094 | 9222 | AFY24022 | 23253 | 53757 | 84261, 114765, 145269, 175773, 206277 |
| 3040 | ACT36682 | 17071 | 47575 | 78079, 108583, 139087, 169591, 200095 | 9223 | AFY24043 | 23254 | 53758 | 84262, 114766, 145270, 175774, 206278 |
| 3041 | ACT36683 | 17072 | 47576 | 78080, 108584, 139088, 169592, 200096 | 9224 | AFY24153 | 23255 | 53759 | 84263, 114767, 145271, 175775, 206279 |
| 3042 | ACT36684 | 17073 | 47577 | 78081, 108585, 139089, 169593, 200097 | 9225 | AFY24208 | 23256 | 53760 | 84264, 114768, 145272, 175776, 206280 |
| 3043 | ACT36685 | 17074 | 47578 | 78082, 108586, 139090, 169594, 200098 | 9226 | AFY24219 | 23257 | 53761 | 84265, 114769, 145273, 175777, 206281 |
| 3044 | ACT36686 | 17075 | 47579 | 78083, 108587, 139091, 169595, 200099 | 9227 | AGB12978 | 23258 | 53762 | 84266, 114770, 145274, 175778, 206282 |
| 3045 | ACT36687 | 17076 | 47580 | 78084, 108588, 139092, 169596, 200100 | 9228 | AGB12989 | 23259 | 53763 | 84267, 114771, 145275, 175779, 206283 |
| 3046 | ACT36688 | 17077 | 47581 | 78085, 108589, 139093, 169597, 200101 | 9229 | AGB13009 | 23260 | 53764 | 84268, 114772, 145276, 175780, 206284 |
| 3047 | ACT36689 | 17078 | 47582 | 78086, 108590, 139094, 169598, 200102 | 9230 | AGB13019 | 23261 | 53765 | 84269, 114773, 145277, 175781, 206285 |
| 3048 | ACT36690 | 17079 | 47583 | 78087, 108591, 139095, 169599, 200103 | 9231 | AGB13029 | 23262 | 53766 | 84270, 114774, 145278, 175782, 206286 |
| 3049 | ACT36691 | 17080 | 47584 | 78088, 108592, 139096, 169600, 200104 | 9232 | AGB13039 | 23263 | 53767 | 84271, 114775, 145279, 175783, 206287 |
| 3050 | ACT36693 | 17081 | 47585 | 78089, 108593, 139097, 169601, 200105 | 9233 | AGB13051 | 23264 | 53768 | 84272, 114776, 145280, 175784, 206288 |
| 3051 | ACT36694 | 17082 | 47586 | 78090, 108594, 139098, 169602, 200106 | 9234 | AGB13069 | 23265 | 53769 | 84273, 114777, 145281, 175785, 206289 |
| 3052 | ACT36695 | 17083 | 47587 | 78091, 108595, 139099, 169603, 200107 | 9235 | AGB13074 | 23266 | 53770 | 84274, 114778, 145282, 175786, 206290 |
| 3053 | ACT52684 | 17084 | 47588 | 78092, 108596, 139100, 169604, 200108 | 9236 | AGB13115 | 23267 | 53771 | 84275, 114779, 145283, 175787, 206291 |

FIG. 3 continued

| | | | | | | | | | |
|---|---|---|---|---|---|---|---|---|---|
| 3054 | ACT54608 | 17085 | 47589 | 78093, 108597, 139101, 169605, 200109 | 9237 | AGB13133 | 23268 | 53772 | 84276, 114780, 145284, 175788, 206292 |
| 3055 | ACT66157 | 17086 | 47590 | 78094, 108598, 139102, 169606, 200110 | 9238 | AGB13152 | 23269 | 53773 | 84277, 114781, 145285, 175789, 206293 |
| 3056 | ACT67117 | 17087 | 47591 | 78095, 108599, 139103, 169607, 200111 | 9239 | AGB13162 | 23270 | 53774 | 84278, 114782, 145286, 175790, 206294 |
| 3057 | ACT67121 | 17088 | 47592 | 78096, 108600, 139104, 169608, 200112 | 9240 | AGB13173 | 23271 | 53775 | 84279, 114783, 145287, 175791, 206295 |
| 3058 | ACT67240 | 17089 | 47593 | 78097, 108601, 139105, 169609, 200113 | 9241 | AGB13183 | 23272 | 53776 | 84280, 114784, 145288, 175792, 206296 |
| 3059 | ACT67241 | 17090 | 47594 | 78098, 108602, 139106, 169610, 200114 | 9242 | AGB13193 | 23273 | 53777 | 84281, 114785, 145289, 175793, 206297 |
| 3060 | ACT67243 | 17091 | 47595 | 78099, 108603, 139107, 169611, 200115 | 9243 | AGB13203 | 23274 | 53778 | 84282, 114786, 145290, 175794, 206298 |
| 3061 | ACT67256 | 17092 | 47596 | 78100, 108604, 139108, 169612, 200116 | 9244 | AGB13213 | 23275 | 53779 | 84283, 114787, 145291, 175795, 206299 |
| 3062 | ACT68161 | 17093 | 47597 | 78101, 108605, 139109, 169613, 200117 | 9245 | AGB13223 | 23276 | 53780 | 84284, 114788, 145292, 175796, 206300 |
| 3063 | ACT68162 | 17094 | 47598 | 78102, 108606, 139110, 169614, 200118 | 9246 | AGB13233 | 23277 | 53781 | 84285, 114789, 145293, 175797, 206301 |
| 3064 | ACT68163 | 17095 | 47599 | 78103, 108607, 139111, 169615, 200119 | 9247 | AGB13243 | 23278 | 53782 | 84286, 114790, 145294, 175798, 206302 |
| 3065 | ACT68164 | 17096 | 47600 | 78104, 108608, 139112, 169616, 200120 | 9248 | AGB13253 | 23279 | 53783 | 84287, 114791, 145295, 175799, 206303 |
| 3066 | ACT68166 | 17097 | 47601 | 78105, 108609, 139113, 169617, 200121 | 9249 | AGB13263 | 23280 | 53784 | 84288, 114792, 145296, 175800, 206304 |
| 3067 | ACT68167 | 17098 | 47602 | 78106, 108610, 139114, 169618, 200122 | 9250 | AGB13273 | 23281 | 53785 | 84289, 114793, 145297, 175801, 206305 |
| 3068 | ACT68168 | 17099 | 47603 | 78107, 108611, 139115, 169619, 200123 | 9251 | AGB13283 | 23282 | 53786 | 84290, 114794, 145298, 175802, 206306 |
| 3069 | ACT68169 | 17100 | 47604 | 78108, 108612, 139116, 169620, 200124 | 9252 | AGB13293 | 23283 | 53787 | 84291, 114795, 145299, 175803, 206307 |
| 3070 | ACT68171 | 17101 | 47605 | 78109, 108613, 139117, 169621, 200125 | 9253 | AGB13303 | 23284 | 53788 | 84292, 114796, 145300, 175804, 206308 |
| 3071 | ACT68172 | 17102 | 47606 | 78110, 108614, 139118, 169622, 200126 | 9254 | AGB13313 | 23285 | 53789 | 84293, 114797, 145301, 175805, 206309 |

FIG. 3 continued

| | | | | | | | | | |
|---|---|---|---|---|---|---|---|---|---|
| 3072 | ACT68173 | 17103 | 47607 | 78111, 108615, 139119, 169623, 200127 | 9255 | AGB13323 | 23286 | 53790 | 84294, 114798, 145302, 175806, 206310 |
| 3073 | ACT68174 | 17104 | 47608 | 78112, 108616, 139120, 169624, 200128 | 9256 | AGB13333 | 23287 | 53791 | 84295, 114799, 145303, 175807, 206311 |
| 3074 | ACT68175 | 17105 | 47609 | 78113, 108617, 139121, 169625, 200129 | 9257 | AGB13343 | 23288 | 53792 | 84296, 114800, 145304, 175808, 206312 |
| 3075 | ACT68176 | 17106 | 47610 | 78114, 108618, 139122, 169626, 200130 | 9258 | AGB13353 | 23289 | 53793 | 84297, 114801, 145305, 175809, 206313 |
| 3076 | ACT68177 | 17107 | 47611 | 78115, 108619, 139123, 169627, 200131 | 9259 | AGB13363 | 23290 | 53794 | 84298, 114802, 145306, 175810, 206314 |
| 3077 | ACT68178 | 17108 | 47612 | 78116, 108620, 139124, 169628, 200132 | 9260 | AGB13383 | 23291 | 53795 | 84299, 114803, 145307, 175811, 206315 |
| 3078 | ACT68179 | 17109 | 47613 | 78117, 108621, 139125, 169629, 200133 | 9261 | AGB13393 | 23292 | 53796 | 84300, 114804, 145308, 175812, 206316 |
| 3079 | ACT68180 | 17110 | 47614 | 78118, 108622, 139126, 169630, 200134 | 9262 | AGB13403 | 23293 | 53797 | 84301, 114805, 145309, 175813, 206317 |
| 3080 | ACT79145 | 17111 | 47615 | 78119, 108623, 139127, 169631, 200135 | 9263 | AGB13413 | 23294 | 53798 | 84302, 114806, 145310, 175814, 206318 |
| 3081 | ACT79155 | 17112 | 47616 | 78120, 108624, 139128, 169632, 200136 | 9264 | AGB13423 | 23295 | 53799 | 84303, 114807, 145311, 175815, 206319 |
| 3082 | ACT79165 | 17113 | 47617 | 78121, 108625, 139129, 169633, 200137 | 9265 | AGB13433 | 23296 | 53800 | 84304, 114808, 145312, 175816, 206320 |
| 3083 | ACT79175 | 17114 | 47618 | 78122, 108626, 139130, 169634, 200138 | 9266 | AGB13443 | 23297 | 53801 | 84305, 114809, 145313, 175817, 206321 |
| 3084 | ACT79185 | 17115 | 47619 | 78123, 108627, 139131, 169635, 200139 | 9267 | AGB13453 | 23298 | 53802 | 84306, 114810, 145314, 175818, 206322 |
| 3085 | ACT79622 | 17116 | 47620 | 78124, 108628, 139132, 169636, 200140 | 9268 | AGB13463 | 23299 | 53803 | 84307, 114811, 145315, 175819, 206323 |
| 3086 | ACT79630 | 17117 | 47621 | 78125, 108629, 139133, 169637, 200141 | 9269 | AGB13473 | 23300 | 53804 | 84308, 114812, 145316, 175820, 206324 |
| 3087 | ACT83798 | 17118 | 47622 | 78126, 108630, 139134, 169638, 200142 | 9270 | AGB13483 | 23301 | 53805 | 84309, 114813, 145317, 175821, 206325 |
| 3088 | ACT83808 | 17119 | 47623 | 78127, 108631, 139135, 169639, 200143 | 9271 | AGB13493 | 23302 | 53806 | 84310, 114814, 145318, 175822, 206326 |
| 3089 | ACT83818 | 17120 | 47624 | 78128, 108632, 139136, 169640, 200144 | 9272 | AGB13503 | 23303 | 53807 | 84311, 114815, 145319, 175823, 206327 |

FIG. 3 continued

| | | | | | | | | | |
|---|---|---|---|---|---|---|---|---|---|
| 3090 | ACT83828 | 17121 | 47625 | 78129, 108633, 139137, 169641, 200145 | 9273 | AGB13513 | 23304 | 53808 | 84312, 114816, 145320, 175824, 206328 |
| 3091 | ACT83838 | 17122 | 47626 | 78130, 108634, 139138, 169642, 200146 | 9274 | AGB13523 | 23305 | 53809 | 84313, 114817, 145321, 175825, 206329 |
| 3092 | ACT83848 | 17123 | 47627 | 78131, 108635, 139139, 169643, 200147 | 9275 | AGB13533 | 23306 | 53810 | 84314, 114818, 145322, 175826, 206330 |
| 3093 | ACT83858 | 17124 | 47628 | 78132, 108636, 139140, 169644, 200148 | 9276 | AGB13543 | 23307 | 53811 | 84315, 114819, 145323, 175827, 206331 |
| 3094 | ACT83868 | 17125 | 47629 | 78133, 108637, 139141, 169645, 200149 | 9277 | AGB13553 | 23308 | 53812 | 84316, 114820, 145324, 175828, 206332 |
| 3095 | ACT83878 | 17126 | 47630 | 78134, 108638, 139142, 169646, 200150 | 9278 | AGB13563 | 23309 | 53813 | 84317, 114821, 145325, 175829, 206333 |
| 3096 | ACT86002 | 17127 | 47631 | 78135, 108639, 139143, 169647, 200151 | 9279 | AGB13573 | 23310 | 53814 | 84318, 114822, 145326, 175830, 206334 |
| 3097 | ACT86012 | 17128 | 47632 | 78136, 108640, 139144, 169648, 200152 | 9280 | AGB13583 | 23311 | 53815 | 84319, 114823, 145327, 175831, 206335 |
| 3098 | ACT86022 | 17129 | 47633 | 78137, 108641, 139145, 169649, 200153 | 9281 | AGB13593 | 23312 | 53816 | 84320, 114824, 145328, 175832, 206336 |
| 3099 | ACT86032 | 17130 | 47634 | 78138, 108642, 139146, 169650, 200154 | 9282 | AGB13603 | 23313 | 53817 | 84321, 114825, 145329, 175833, 206337 |
| 3100 | ACT86042 | 17131 | 47635 | 78139, 108643, 139147, 169651, 200155 | 9283 | AGB13613 | 23314 | 53818 | 84322, 114826, 145330, 175834, 206338 |
| 3101 | ACT86052 | 17132 | 47636 | 78140, 108644, 139148, 169652, 200156 | 9284 | AGB13623 | 23315 | 53819 | 84323, 114827, 145331, 175835, 206339 |
| 3102 | ACT86062 | 17133 | 47637 | 78141, 108645, 139149, 169653, 200157 | 9285 | AGB13633 | 23316 | 53820 | 84324, 114828, 145332, 175836, 206340 |
| 3103 | ACT86072 | 17134 | 47638 | 78142, 108646, 139150, 169654, 200158 | 9286 | AGB13643 | 23317 | 53821 | 84325, 114829, 145333, 175837, 206341 |
| 3104 | ACT86082 | 17135 | 47639 | 78143, 108647, 139151, 169655, 200159 | 9287 | AGB13653 | 23318 | 53822 | 84326, 114830, 145334, 175838, 206342 |
| 3105 | ACT86092 | 17136 | 47640 | 78144, 108648, 139152, 169656, 200160 | 9288 | AGB13663 | 23319 | 53823 | 84327, 114831, 145335, 175839, 206343 |
| 3106 | ACT86102 | 17137 | 47641 | 78145, 108649, 139153, 169657, 200161 | 9289 | AGB13724 | 23320 | 53824 | 84328, 114832, 145336, 175840, 206344 |
| 3107 | ACT86112 | 17138 | 47642 | 78146, 108650, 139154, 169658, 200162 | 9290 | AGB13734 | 23321 | 53825 | 84329, 114833, 145337, 175841, 206345 |

FIG. 3 continued

| | | | | | | | | | |
|---|---|---|---|---|---|---|---|---|---|
| 3108 | ACT86122 | 17139 | 47643 | 78147, 108651, 139155, 169659, 200163 | 9291 | AGB51359 | 23322 | 53826 | 84330, 114834, 145338, 175842, 206346 |
| 3109 | ACT86132 | 17140 | 47644 | 78148, 108652, 139156, 169660, 200164 | 9292 | AGB97270 | 23323 | 53827 | 84331, 114835, 145339, 175843, 206347 |
| 3110 | ACT86142 | 17141 | 47645 | 78149, 108653, 139157, 169661, 200165 | 9293 | AGB97274 | 23324 | 53828 | 84332, 114836, 145340, 175844, 206348 |
| 3111 | ACT97323 | 17142 | 47646 | 78150, 108654, 139158, 169662, 200166 | 9294 | AGB97289 | 23325 | 53829 | 84333, 114837, 145341, 175845, 206349 |
| 3112 | ACU00934 | 17143 | 47647 | 78151, 108655, 139159, 169663, 200167 | 9295 | AGE15475 | 23326 | 53830 | 84334, 114838, 145342, 175846, 206350 |
| 3113 | ACU00944 | 17144 | 47648 | 78152, 108656, 139160, 169664, 200168 | 9296 | AGE15476 | 23327 | 53831 | 84335, 114839, 145343, 175847, 206351 |
| 3114 | ACU00954 | 17145 | 47649 | 78153, 108657, 139161, 169665, 200169 | 9297 | AGE15477 | 23328 | 53832 | 84336, 114840, 145344, 175848, 206352 |
| 3115 | ACU12497 | 17146 | 47650 | 78154, 108658, 139162, 169666, 200170 | 9298 | AGE15478 | 23329 | 53833 | 84337, 114841, 145345, 175849, 206353 |
| 3116 | ACU12508 | 17147 | 47651 | 78155, 108659, 139163, 169667, 200171 | 9299 | AGE15479 | 23330 | 53834 | 84338, 114842, 145346, 175850, 206354 |
| 3117 | ACU12519 | 17148 | 47652 | 78156, 108660, 139164, 169668, 200172 | 9300 | AGE15480 | 23331 | 53835 | 84339, 114843, 145347, 175851, 206355 |
| 3118 | ACU12530 | 17149 | 47653 | 78157, 108661, 139165, 169669, 200173 | 9301 | AGE89270 | 23332 | 53836 | 84340, 114844, 145348, 175852, 206356 |
| 3119 | ACU12541 | 17150 | 47654 | 78158, 108662, 139166, 169670, 200174 | 9302 | AGE89280 | 23333 | 53837 | 84341, 114845, 145349, 175853, 206357 |
| 3120 | ACU12552 | 17151 | 47655 | 78159, 108663, 139167, 169671, 200175 | 9303 | AGE89290 | 23334 | 53838 | 84342, 114846, 145350, 175854, 206358 |
| 3121 | ACU12574 | 17152 | 47656 | 78160, 108664, 139168, 169672, 200176 | 9304 | AGE89301 | 23335 | 53839 | 84343, 114847, 145351, 175855, 206359 |
| 3122 | ACU12585 | 17153 | 47657 | 78161, 108665, 139169, 169673, 200177 | 9305 | AGE89311 | 23336 | 53840 | 84344, 114848, 145352, 175856, 206360 |
| 3123 | ACU12596 | 17154 | 47658 | 78162, 108666, 139170, 169674, 200178 | 9306 | AGE89321 | 23337 | 53841 | 84345, 114849, 145353, 175857, 206361 |
| 3124 | ACU13077 | 17155 | 47659 | 78163, 108667, 139171, 169675, 200179 | 9307 | AGE89332 | 23338 | 53842 | 84346, 114850, 145354, 175858, 206362 |
| 3125 | ACU13078 | 17156 | 47660 | 78164, 108668, 139172, 169676, 200180 | 9308 | AGE89343 | 23339 | 53843 | 84347, 114851, 145355, 175859, 206363 |

FIG. 3 continued

| | | | | | | | | | |
|---|---|---|---|---|---|---|---|---|---|
| 3126 | ACU13079 | 17157 | 47661 | 78165, 108669, 139173, 169677, 200181 | 9309 | AGE89353 | 23340 | 53844 | 84348, 114852, 145356, 175860, 206364 |
| 3127 | ACU13080 | 17158 | 47662 | 78166, 108670, 139174, 169678, 200182 | 9310 | AGE89364 | 23341 | 53845 | 84349, 114853, 145357, 175861, 206365 |
| 3128 | ACU13081 | 17159 | 47663 | 78167, 108671, 139175, 169679, 200183 | 9311 | AGE89374 | 23342 | 53846 | 84350, 114854, 145358, 175862, 206366 |
| 3129 | ACU13082 | 17160 | 47664 | 78168, 108672, 139176, 169680, 200184 | 9312 | AGE89385 | 23343 | 53847 | 84351, 114855, 145359, 175863, 206367 |
| 3130 | ACU13083 | 17161 | 47665 | 78169, 108673, 139177, 169681, 200185 | 9313 | AGE89395 | 23344 | 53848 | 84352, 114856, 145360, 175864, 206368 |
| 3131 | ACU13084 | 17162 | 47666 | 78170, 108674, 139178, 169682, 200186 | 9314 | AGE89425 | 23345 | 53849 | 84353, 114857, 145361, 175865, 206369 |
| 3132 | ACU16799 | 17163 | 47667 | 78171, 108675, 139179, 169683, 200187 | 9315 | AGE89722 | 23346 | 53850 | 84354, 114858, 145362, 175866, 206370 |
| 3133 | ACU16861 | 17164 | 47668 | 78172, 108676, 139180, 169684, 200188 | 9316 | AGE89733 | 23347 | 53851 | 84355, 114859, 145363, 175867, 206371 |
| 3134 | ACU16934 | 17165 | 47669 | 78173, 108677, 139181, 169685, 200189 | 9317 | AGE89743 | 23348 | 53852 | 84356, 114860, 145364, 175868, 206372 |
| 3135 | ACU16997 | 17166 | 47670 | 78174, 108678, 139182, 169686, 200190 | 9318 | AGE89754 | 23349 | 53853 | 84357, 114861, 145365, 175869, 206373 |
| 3136 | ACU17130 | 17167 | 47671 | 78175, 108679, 139183, 169687, 200191 | 9319 | AGE89765 | 23350 | 53854 | 84358, 114862, 145366, 175870, 206374 |
| 3137 | ACU17191 | 17168 | 47672 | 78176, 108680, 139184, 169688, 200192 | 9320 | AGG13414 | 23351 | 53855 | 84359, 114863, 145367, 175871, 206375 |
| 3138 | ACU17262 | 17169 | 47673 | 78177, 108681, 139185, 169689, 200193 | 9321 | AGG13426 | 23352 | 53856 | 84360, 114864, 145368, 175872, 206376 |
| 3139 | ACU17325 | 17170 | 47674 | 78178, 108682, 139186, 169690, 200194 | 9322 | AGG13438 | 23353 | 53857 | 84361, 114865, 145369, 175873, 206377 |
| 3140 | ACU17393 | 17171 | 47675 | 78179, 108683, 139187, 169691, 200195 | 9323 | AGG13498 | 23354 | 53858 | 84362, 114866, 145370, 175874, 206378 |
| 3141 | ACU17454 | 17172 | 47676 | 78180, 108684, 139188, 169692, 200196 | 9324 | AGG13510 | 23355 | 53859 | 84363, 114867, 145371, 175875, 206379 |
| 3142 | ACU17524 | 17173 | 47677 | 78181, 108685, 139189, 169693, 200197 | 9325 | AGG13522 | 23356 | 53860 | 84364, 114868, 145372, 175876, 206380 |
| 3143 | ACU27043 | 17174 | 47678 | 78182, 108686, 139190, 169694, 200198 | 9326 | AGG13534 | 23357 | 53861 | 84365, 114869, 145373, 175877, 206381 |

FIG. 3 continued

| | | | | | | | | | |
|---|---|---|---|---|---|---|---|---|---|
| 3144 | ACU27415 | 17175 | 47679 | 78183, 108687, 139191, 169695, 200199 | 9327 | AGG13546 | 23358 | 53862 | 84366, 114870, 145374, 175878, 206382 |
| 3145 | ACU27416 | 17176 | 47680 | 78184, 108688, 139192, 169696, 200200 | 9328 | AGG13558 | 23359 | 53863 | 84367, 114871, 145375, 175879, 206383 |
| 3146 | ACU29961 | 17177 | 47681 | 78185, 108689, 139193, 169697, 200201 | 9329 | AGG13570 | 23360 | 53864 | 84368, 114872, 145376, 175880, 206384 |
| 3147 | ACU29971 | 17178 | 47682 | 78186, 108690, 139194, 169698, 200202 | 9330 | AGG13582 | 23361 | 53865 | 84369, 114873, 145377, 175881, 206385 |
| 3148 | ACU29981 | 17179 | 47683 | 78187, 108691, 139195, 169699, 200203 | 9331 | AGG13606 | 23362 | 53866 | 84370, 114874, 145378, 175882, 206386 |
| 3149 | ACU29991 | 17180 | 47684 | 78188, 108692, 139196, 169700, 200204 | 9332 | AGG13618 | 23363 | 53867 | 84371, 114875, 145379, 175883, 206387 |
| 3150 | ACU30001 | 17181 | 47685 | 78189, 108693, 139197, 169701, 200205 | 9333 | AGG13630 | 23364 | 53868 | 84372, 114876, 145380, 175884, 206388 |
| 3151 | ACU30021 | 17182 | 47686 | 78190, 108694, 139198, 169702, 200206 | 9334 | AGG13642 | 23365 | 53869 | 84373, 114877, 145381, 175885, 206389 |
| 3152 | ACU30085 | 17183 | 47687 | 78191, 108695, 139199, 169703, 200207 | 9335 | AGG13654 | 23366 | 53870 | 84374, 114878, 145382, 175886, 206390 |
| 3153 | ACU30095 | 17184 | 47688 | 78192, 108696, 139200, 169704, 200208 | 9336 | AGG13666 | 23367 | 53871 | 84375, 114879, 145383, 175887, 206391 |
| 3154 | ACU30105 | 17185 | 47689 | 78193, 108697, 139201, 169705, 200209 | 9337 | AGG13678 | 23368 | 53872 | 84376, 114880, 145384, 175888, 206392 |
| 3155 | ACU30114 | 17186 | 47690 | 78194, 108698, 139202, 169706, 200210 | 9338 | AGG13690 | 23369 | 53873 | 84377, 114881, 145385, 175889, 206393 |
| 3156 | ACU30123 | 17187 | 47691 | 78195, 108699, 139203, 169707, 200211 | 9339 | AGG13702 | 23370 | 53874 | 84378, 114882, 145386, 175890, 206394 |
| 3157 | ACU31177 | 17188 | 47692 | 78196, 108700, 139204, 169708, 200212 | 9340 | AGG13714 | 23371 | 53875 | 84379, 114883, 145387, 175891, 206395 |
| 3158 | ACU31178 | 17189 | 47693 | 78197, 108701, 139205, 169709, 200213 | 9341 | AGG13726 | 23372 | 53876 | 84380, 114884, 145388, 175892, 206396 |
| 3159 | ACU31179 | 17190 | 47694 | 78198, 108702, 139206, 169710, 200214 | 9342 | AGG13738 | 23373 | 53877 | 84381, 114885, 145389, 175893, 206397 |
| 3160 | ACU31180 | 17191 | 47695 | 78199, 108703, 139207, 169711, 200215 | 9343 | AGG13750 | 23374 | 53878 | 84382, 114886, 145390, 175894, 206398 |
| 3161 | ACU31181 | 17192 | 47696 | 78200, 108704, 139208, 169712, 200216 | 9344 | AGG13762 | 23375 | 53879 | 84383, 114887, 145391, 175895, 206399 |

FIG. 3 continued

| | | | | | | | | | |
|---|---|---|---|---|---|---|---|---|---|
| 3162 | ACU31182 | 17193 | 47697 | 78201, 108705, 139209, 169713, 200217 | 9345 | AGG13774 | 23376 | 53880 | 84384, 114888, 145392, 175896, 206400 |
| 3163 | ACU31183 | 17194 | 47698 | 78202, 108706, 139210, 169714, 200218 | 9346 | AGG13786 | 23377 | 53881 | 84385, 114889, 145393, 175897, 206401 |
| 3164 | ACU31184 | 17195 | 47699 | 78203, 108707, 139211, 169715, 200219 | 9347 | AGG13798 | 23378 | 53882 | 84386, 114890, 145394, 175898, 206402 |
| 3165 | ACU31185 | 17196 | 47700 | 78204, 108708, 139212, 169716, 200220 | 9348 | AGG13810 | 23379 | 53883 | 84387, 114891, 145395, 175899, 206403 |
| 3166 | ACU31186 | 17197 | 47701 | 78205, 108709, 139213, 169717, 200221 | 9349 | AGG13822 | 23380 | 53884 | 84388, 114892, 145396, 175900, 206404 |
| 3167 | ACU31187 | 17198 | 47702 | 78206, 108710, 139214, 169718, 200222 | 9350 | AGG13834 | 23381 | 53885 | 84389, 114893, 145397, 175901, 206405 |
| 3168 | ACU31188 | 17199 | 47703 | 78207, 108711, 139215, 169719, 200223 | 9351 | AGG13846 | 23382 | 53886 | 84390, 114894, 145398, 175902, 206406 |
| 3169 | ACU46645 | 17200 | 47704 | 78208, 108712, 139216, 169720, 200224 | 9352 | AGG13858 | 23383 | 53887 | 84391, 114895, 145399, 175903, 206407 |
| 3170 | ACU56927 | 17201 | 47705 | 78209, 108713, 139217, 169721, 200225 | 9353 | AGG13870 | 23384 | 53888 | 84392, 114896, 145400, 175904, 206408 |
| 3171 | ACU56934 | 17202 | 47706 | 78210, 108714, 139218, 169722, 200226 | 9354 | AGG13894 | 23385 | 53889 | 84393, 114897, 145401, 175905, 206409 |
| 3172 | ACU64791 | 17203 | 47707 | 78211, 108715, 139219, 169723, 200227 | 9355 | AGG13906 | 23386 | 53890 | 84394, 114898, 145402, 175906, 206410 |
| 3173 | ACU64811 | 17204 | 47708 | 78212, 108716, 139220, 169724, 200228 | 9356 | AGG13930 | 23387 | 53891 | 84395, 114899, 145403, 175907, 206411 |
| 3174 | ACU79885 | 17205 | 47709 | 78213, 108717, 139221, 169725, 200229 | 9357 | AGG13942 | 23388 | 53892 | 84396, 114900, 145404, 175908, 206412 |
| 3175 | ACU79896 | 17206 | 47710 | 78214, 108718, 139222, 169726, 200230 | 9358 | AGG13965 | 23389 | 53893 | 84397, 114901, 145405, 175909, 206413 |
| 3176 | ACU79918 | 17207 | 47711 | 78215, 108719, 139223, 169727, 200231 | 9359 | AGG13976 | 23390 | 53894 | 84398, 114902, 145406, 175910, 206414 |
| 3177 | ACU79929 | 17208 | 47712 | 78216, 108720, 139224, 169728, 200232 | 9360 | AGG13988 | 23391 | 53895 | 84399, 114903, 145407, 175911, 206415 |
| 3178 | ACU79940 | 17209 | 47713 | 78217, 108721, 139225, 169729, 200233 | 9361 | AGG14000 | 23392 | 53896 | 84400, 114904, 145408, 175912, 206416 |
| 3179 | ACU79951 | 17210 | 47714 | 78218, 108722, 139226, 169730, 200234 | 9362 | AGG14012 | 23393 | 53897 | 84401, 114905, 145409, 175913, 206417 |

FIG. 3 continued

| | | | | | | | | | |
|---|---|---|---|---|---|---|---|---|---|
| 3180 | ACU79973 | 17211 | 47715 | 78219, 108723, 139227, 169731, 200235 | 9363 | AGG14024 | 23394 | 53898 | 84402, 114906, 145410, 175914, 206418 |
| 3181 | ACU79984 | 17212 | 47716 | 78220, 108724, 139228, 169732, 200236 | 9364 | AGG14036 | 23395 | 53899 | 84403, 114907, 145411, 175915, 206419 |
| 3182 | ACU80006 | 17213 | 47717 | 78221, 108725, 139229, 169733, 200237 | 9365 | AGG14321 | 23396 | 53900 | 84404, 114908, 145412, 175916, 206420 |
| 3183 | ACU80017 | 17214 | 47718 | 78222, 108726, 139230, 169734, 200238 | 9366 | AGG14333 | 23397 | 53901 | 84405, 114909, 145413, 175917, 206421 |
| 3184 | ACU80028 | 17215 | 47719 | 78223, 108727, 139231, 169735, 200239 | 9367 | AGG84182 | 23398 | 53902 | 84406, 114910, 145414, 175918, 206422 |
| 3185 | ACU80039 | 17216 | 47720 | 78224, 108728, 139232, 169736, 200240 | 9368 | AGJ51955 | 23399 | 53903 | 84407, 114911, 145415, 175919, 206423 |
| 3186 | ACU80050 | 17217 | 47721 | 78225, 108729, 139233, 169737, 200241 | 9369 | AGJ72863 | 23400 | 53904 | 84408, 114912, 145416, 175920, 206424 |
| 3187 | ACU80061 | 17218 | 47722 | 78226, 108730, 139234, 169738, 200242 | 9370 | AGJ73328 | 23401 | 53905 | 84409, 114913, 145417, 175921, 206425 |
| 3188 | ACU80072 | 17219 | 47723 | 78227, 108731, 139235, 169739, 200243 | 9371 | AGJ73330 | 23402 | 53906 | 84410, 114914, 145418, 175922, 206426 |
| 3189 | ACU80094 | 17220 | 47724 | 78228, 108732, 139236, 169740, 200244 | 9372 | AGJ73332 | 23403 | 53907 | 84411, 114915, 145419, 175923, 206427 |
| 3190 | ACU80105 | 17221 | 47725 | 78229, 108733, 139237, 169741, 200245 | 9373 | AGJ73334 | 23404 | 53908 | 84412, 114916, 145420, 175924, 206428 |
| 3191 | ACU80127 | 17222 | 47726 | 78230, 108734, 139238, 169742, 200246 | 9374 | AGJ73336 | 23405 | 53909 | 84413, 114917, 145421, 175925, 206429 |
| 3192 | ACU80138 | 17223 | 47727 | 78231, 108735, 139239, 169743, 200247 | 9375 | AGJ73338 | 23406 | 53910 | 84414, 114918, 145422, 175926, 206430 |
| 3193 | ACU80160 | 17224 | 47728 | 78232, 108736, 139240, 169744, 200248 | 9376 | AGJ73340 | 23407 | 53911 | 84415, 114919, 145423, 175927, 206431 |
| 3194 | ACU80171 | 17225 | 47729 | 78233, 108737, 139241, 169745, 200249 | 9377 | AGJ73342 | 23408 | 53912 | 84416, 114920, 145424, 175928, 206432 |
| 3195 | ACU80182 | 17226 | 47730 | 78234, 108738, 139242, 169746, 200250 | 9378 | AGJ73344 | 23409 | 53913 | 84417, 114921, 145425, 175929, 206433 |
| 3196 | ACU80193 | 17227 | 47731 | 78235, 108739, 139243, 169747, 200251 | 9379 | AGJ73346 | 23410 | 53914 | 84418, 114922, 145426, 175930, 206434 |
| 3197 | ACU80204 | 17228 | 47732 | 78236, 108740, 139244, 169748, 200252 | 9380 | AGJ73348 | 23411 | 53915 | 84419, 114923, 145427, 175931, 206435 |

FIG. 3 continued

| | | | | | | | | | |
|---|---|---|---|---|---|---|---|---|---|
| 3198 | ACU80237 | 17229 | 47733 | 78237, 108741, 139245, 169749, 200253 | 9381 | AGJ73350 | 23412 | 53916 | 84420, 114924, 145428, 175932, 206436 |
| 3199 | ACU80248 | 17230 | 47734 | 78238, 108742, 139246, 169750, 200254 | 9382 | AGJ73352 | 23413 | 53917 | 84421, 114925, 145429, 175933, 206437 |
| 3200 | ACU80259 | 17231 | 47735 | 78239, 108743, 139247, 169751, 200255 | 9383 | AGJ73354 | 23414 | 53918 | 84422, 114926, 145430, 175934, 206438 |
| 3201 | ACU80270 | 17232 | 47736 | 78240, 108744, 139248, 169752, 200256 | 9384 | AGJ73356 | 23415 | 53919 | 84423, 114927, 145431, 175935, 206439 |
| 3202 | ACU80281 | 17233 | 47737 | 78241, 108745, 139249, 169753, 200257 | 9385 | AGJ73358 | 23416 | 53920 | 84424, 114928, 145432, 175936, 206440 |
| 3203 | ACU80303 | 17234 | 47738 | 78242, 108746, 139250, 169754, 200258 | 9386 | AGJ73360 | 23417 | 53921 | 84425, 114929, 145433, 175937, 206441 |
| 3204 | ACU80314 | 17235 | 47739 | 78243, 108747, 139251, 169755, 200259 | 9387 | AGJ73362 | 23418 | 53922 | 84426, 114930, 145434, 175938, 206442 |
| 3205 | ACU80325 | 17236 | 47740 | 78244, 108748, 139252, 169756, 200260 | 9388 | AGJ73364 | 23419 | 53923 | 84427, 114931, 145435, 175939, 206443 |
| 3206 | ACU80336 | 17237 | 47741 | 78245, 108749, 139253, 169757, 200261 | 9389 | AGJ73366 | 23420 | 53924 | 84428, 114932, 145436, 175940, 206444 |
| 3207 | ACU80347 | 17238 | 47742 | 78246, 108750, 139254, 169758, 200262 | 9390 | AGJ73370 | 23421 | 53925 | 84429, 114933, 145437, 175941, 206445 |
| 3208 | ACU80358 | 17239 | 47743 | 78247, 108751, 139255, 169759, 200263 | 9391 | AGJ73372 | 23422 | 53926 | 84430, 114934, 145438, 175942, 206446 |
| 3209 | ACU80369 | 17240 | 47744 | 78248, 108752, 139256, 169760, 200264 | 9392 | AGJ73374 | 23423 | 53927 | 84431, 114935, 145439, 175943, 206447 |
| 3210 | ACU80380 | 17241 | 47745 | 78249, 108753, 139257, 169761, 200265 | 9393 | AGJ73376 | 23424 | 53928 | 84432, 114936, 145440, 175944, 206448 |
| 3211 | ACU80391 | 17242 | 47746 | 78250, 108754, 139258, 169762, 200266 | 9394 | AGJ73379 | 23425 | 53929 | 84433, 114937, 145441, 175945, 206449 |
| 3212 | ACU80402 | 17243 | 47747 | 78251, 108755, 139259, 169763, 200267 | 9395 | AGJ73381 | 23426 | 53930 | 84434, 114938, 145442, 175946, 206450 |
| 3213 | ACU80413 | 17244 | 47748 | 78252, 108756, 139260, 169764, 200268 | 9396 | AGK62992 | 23427 | 53931 | 84435, 114939, 145443, 175947, 206451 |
| 3214 | ACU80427 | 17245 | 47749 | 78253, 108757, 139261, 169765, 200269 | 9397 | AGK62996 | 23428 | 53932 | 84436, 114940, 145444, 175948, 206452 |
| 3215 | ACU80438 | 17246 | 47750 | 78254, 108758, 139262, 169766, 200270 | 9398 | AGK62998 | 23429 | 53933 | 84437, 114941, 145445, 175949, 206453 |

FIG. 3 continued

| | | | | | | | | | |
|---|---|---|---|---|---|---|---|---|---|
| 3216 | ACU80461 | 17247 | 47751 | 78255, 108759, 139263, 169767, 200271 | 9399 | AGK63000 | 23430 | 53934 | 84438, 114942, 145446, 175950, 206454 |
| 3217 | ACU80603 | 17248 | 47752 | 78256, 108760, 139264, 169768, 200272 | 9400 | AGK63002 | 23431 | 53935 | 84439, 114943, 145447, 175951, 206455 |
| 3218 | ACU80614 | 17249 | 47753 | 78257, 108761, 139265, 169769, 200273 | 9401 | AGK63004 | 23432 | 53936 | 84440, 114944, 145448, 175952, 206456 |
| 3219 | ACU80625 | 17250 | 47754 | 78258, 108762, 139266, 169770, 200274 | 9402 | AGK63006 | 23433 | 53937 | 84441, 114945, 145449, 175953, 206457 |
| 3220 | ACU80636 | 17251 | 47755 | 78259, 108763, 139267, 169771, 200275 | 9403 | AGK63008 | 23434 | 53938 | 84442, 114946, 145450, 175954, 206458 |
| 3221 | ACU80647 | 17252 | 47756 | 78260, 108764, 139268, 169772, 200276 | 9404 | AGK63010 | 23435 | 53939 | 84443, 114947, 145451, 175955, 206459 |
| 3222 | ACU80658 | 17253 | 47757 | 78261, 108765, 139269, 169773, 200277 | 9405 | AGK63012 | 23436 | 53940 | 84444, 114948, 145452, 175956, 206460 |
| 3223 | ACU80669 | 17254 | 47758 | 78262, 108766, 139270, 169774, 200278 | 9406 | AGK63014 | 23437 | 53941 | 84445, 114949, 145453, 175957, 206461 |
| 3224 | ACU80691 | 17255 | 47759 | 78263, 108767, 139271, 169775, 200279 | 9407 | AGK63018 | 23438 | 53942 | 84446, 114950, 145454, 175958, 206462 |
| 3225 | ACU80702 | 17256 | 47760 | 78264, 108768, 139272, 169776, 200280 | 9408 | AGK63020 | 23439 | 53943 | 84447, 114951, 145455, 175959, 206463 |
| 3226 | ACU80713 | 17257 | 47761 | 78265, 108769, 139273, 169777, 200281 | 9409 | AGK63022 | 23440 | 53944 | 84448, 114952, 145456, 175960, 206464 |
| 3227 | ACU80724 | 17258 | 47762 | 78266, 108770, 139274, 169778, 200282 | 9410 | AGK63024 | 23441 | 53945 | 84449, 114953, 145457, 175961, 206465 |
| 3228 | ACU80735 | 17259 | 47763 | 78267, 108771, 139275, 169779, 200283 | 9411 | AGK63026 | 23442 | 53946 | 84450, 114954, 145458, 175962, 206466 |
| 3229 | ACU80746 | 17260 | 47764 | 78268, 108772, 139276, 169780, 200284 | 9412 | AGK63028 | 23443 | 53947 | 84451, 114955, 145459, 175963, 206467 |
| 3230 | ACU80757 | 17261 | 47765 | 78269, 108773, 139277, 169781, 200285 | 9413 | AGK63030 | 23444 | 53948 | 84452, 114956, 145460, 175964, 206468 |
| 3231 | ACU80768 | 17262 | 47766 | 78270, 108774, 139278, 169782, 200286 | 9414 | AGK63032 | 23445 | 53949 | 84453, 114957, 145461, 175965, 206469 |
| 3232 | ACU80779 | 17263 | 47767 | 78271, 108775, 139279, 169783, 200287 | 9415 | AGK63034 | 23446 | 53950 | 84454, 114958, 145462, 175966, 206470 |
| 3233 | ACU80790 | 17264 | 47768 | 78272, 108776, 139280, 169784, 200288 | 9416 | AGK63036 | 23447 | 53951 | 84455, 114959, 145463, 175967, 206471 |

FIG. 3 continued

| | | | | | | | | | |
|---|---|---|---|---|---|---|---|---|---|
| 3234 | ACU80801 | 17265 | 47769 | 78273, 108777, 139281, 169785, 200289 | 9417 | AGK63038 | 23448 | 53952 | 84456, 114960, 145464, 175968, 206472 |
| 3235 | ACU81106 | 17266 | 47770 | 78274, 108778, 139282, 169786, 200290 | 9418 | AGK63040 | 23449 | 53953 | 84457, 114961, 145465, 175969, 206473 |
| 3236 | ACU87265 | 17267 | 47771 | 78275, 108779, 139283, 169787, 200291 | 9419 | AGK63042 | 23450 | 53954 | 84458, 114962, 145466, 175970, 206474 |
| 3237 | ACU87273 | 17268 | 47772 | 78276, 108780, 139284, 169788, 200292 | 9420 | AGK63044 | 23451 | 53955 | 84459, 114963, 145467, 175971, 206475 |
| 3238 | ACV04231 | 17269 | 47773 | 78277, 108781, 139285, 169789, 200293 | 9421 | AGK63046 | 23452 | 53956 | 84460, 114964, 145468, 175972, 206476 |
| 3239 | ACV04241 | 17270 | 47774 | 78278, 108782, 139286, 169790, 200294 | 9422 | AGK82159 | 23453 | 53957 | 84461, 114965, 145469, 175973, 206477 |
| 3240 | ACV04251 | 17271 | 47775 | 78279, 108783, 139287, 169791, 200295 | 9423 | AGK84858 | 23454 | 53958 | 84462, 114966, 145470, 175974, 206478 |
| 3241 | ACV04261 | 17272 | 47776 | 78280, 108784, 139288, 169792, 200296 | 9424 | AGK84861 | 23455 | 53959 | 84463, 114967, 145471, 175975, 206479 |
| 3242 | ACV04271 | 17273 | 47777 | 78281, 108785, 139289, 169793, 200297 | 9425 | AGK84864 | 23456 | 53960 | 84464, 114968, 145472, 175976, 206480 |
| 3243 | ACV04281 | 17274 | 47778 | 78282, 108786, 139290, 169794, 200298 | 9426 | AGL95090 | 23457 | 53961 | 84465, 114969, 145473, 175977, 206481 |
| 3244 | ACV04291 | 17275 | 47779 | 78283, 108787, 139291, 169795, 200299 | 9427 | AGL96802 | 23458 | 53962 | 84466, 114970, 145474, 175978, 206482 |
| 3245 | ACV04301 | 17276 | 47780 | 78284, 108788, 139292, 169796, 200300 | 9428 | AGL96807 | 23459 | 53963 | 84467, 114971, 145475, 175979, 206483 |
| 3246 | ACV04321 | 17277 | 47781 | 78285, 108789, 139293, 169797, 200301 | 9429 | AGL96808 | 23460 | 53964 | 84468, 114972, 145476, 175980, 206484 |
| 3247 | ACV04331 | 17278 | 47782 | 78286, 108790, 139294, 169798, 200302 | 9430 | AGL96809 | 23461 | 53965 | 84469, 114973, 145477, 175981, 206485 |
| 3248 | ACV04341 | 17279 | 47783 | 78287, 108791, 139295, 169799, 200303 | 9431 | AGL96818 | 23462 | 53966 | 84470, 114974, 145478, 175982, 206486 |
| 3249 | ACV04351 | 17280 | 47784 | 78288, 108792, 139296, 169800, 200304 | 9432 | AGL96820 | 23463 | 53967 | 84471, 114975, 145479, 175983, 206487 |
| 3250 | ACV04361 | 17281 | 47785 | 78289, 108793, 139297, 169801, 200305 | 9433 | AGL96821 | 23464 | 53968 | 84472, 114976, 145480, 175984, 206488 |
| 3251 | ACV04371 | 17282 | 47786 | 78290, 108794, 139298, 169802, 200306 | 9434 | AGN69269 | 23465 | 53969 | 84473, 114977, 145481, 175985, 206489 |

FIG. 3 continued

| | | | | | | | | | |
|---|---|---|---|---|---|---|---|---|---|
| 3252 | ACV04381 | 17283 | 47787 | 78291, 108795, 139299, 169803, 200307 | 9435 | AGN69280 | 23466 | 53970 | 84474, 114978, 145482, 175986, 206490 |
| 3253 | ACV04391 | 17284 | 47788 | 78292, 108796, 139300, 169804, 200308 | 9436 | AGN69292 | 23467 | 53971 | 84475, 114979, 145483, 175987, 206491 |
| 3254 | ACV04401 | 17285 | 47789 | 78293, 108797, 139301, 169805, 200309 | 9437 | AGN69316 | 23468 | 53972 | 84476, 114980, 145484, 175988, 206492 |
| 3255 | ACV04411 | 17286 | 47790 | 78294, 108798, 139302, 169806, 200310 | 9438 | AGN69328 | 23469 | 53973 | 84477, 114981, 145485, 175989, 206493 |
| 3256 | ACV04492 | 17287 | 47791 | 78295, 108799, 139303, 169807, 200311 | 9439 | AGN69340 | 23470 | 53974 | 84478, 114982, 145486, 175990, 206494 |
| 3257 | ACV04502 | 17288 | 47792 | 78296, 108800, 139304, 169808, 200312 | 9440 | AGO00268 | 23471 | 53975 | 84479, 114983, 145487, 175991, 206495 |
| 3258 | ACV04512 | 17289 | 47793 | 78297, 108801, 139305, 169809, 200313 | 9441 | AGO00280 | 23472 | 53976 | 84480, 114984, 145488, 175992, 206496 |
| 3259 | ACV04522 | 17290 | 47794 | 78298, 108802, 139306, 169810, 200314 | 9442 | AGO00292 | 23473 | 53977 | 84481, 114985, 145489, 175993, 206497 |
| 3260 | ACV04532 | 17291 | 47795 | 78299, 108803, 139307, 169811, 200315 | 9443 | AGO00304 | 23474 | 53978 | 84482, 114986, 145490, 175994, 206498 |
| 3261 | ACV04542 | 17292 | 47796 | 78300, 108804, 139308, 169812, 200316 | 9444 | AGO00316 | 23475 | 53979 | 84483, 114987, 145491, 175995, 206499 |
| 3262 | ACV04552 | 17293 | 47797 | 78301, 108805, 139309, 169813, 200317 | 9445 | AGO00328 | 23476 | 53980 | 84484, 114988, 145492, 175996, 206500 |
| 3263 | ACV04562 | 17294 | 47798 | 78302, 108806, 139310, 169814, 200318 | 9446 | AGO00340 | 23477 | 53981 | 84485, 114989, 145493, 175997, 206501 |
| 3264 | ACV04572 | 17295 | 47799 | 78303, 108807, 139311, 169815, 200319 | 9447 | AGO00352 | 23478 | 53982 | 84486, 114990, 145494, 175998, 206502 |
| 3265 | ACV04582 | 17296 | 47800 | 78304, 108808, 139312, 169816, 200320 | 9448 | AGO00376 | 23479 | 53983 | 84487, 114991, 145495, 175999, 206503 |
| 3266 | ACV04758 | 17297 | 47801 | 78305, 108809, 139313, 169817, 200321 | 9449 | AGO00388 | 23480 | 53984 | 84488, 114992, 145496, 176000, 206504 |
| 3267 | ACV33087 | 17298 | 47802 | 78306, 108810, 139314, 169818, 200322 | 9450 | AGO00400 | 23481 | 53985 | 84489, 114993, 145497, 176001, 206505 |
| 3268 | ACV33107 | 17299 | 47803 | 78307, 108811, 139315, 169819, 200323 | 9451 | AGO00412 | 23482 | 53986 | 84490, 114994, 145498, 176002, 206506 |
| 3269 | ACV33117 | 17300 | 47804 | 78308, 108812, 139316, 169820, 200324 | 9452 | AGO00424 | 23483 | 53987 | 84491, 114995, 145499, 176003, 206507 |

FIG. 3 continued

| | | | | | | | | | |
|---|---|---|---|---|---|---|---|---|---|
| 3270 | ACV33127 | 17301 | 47805 | 78309, 108813, 139317, 169821, 200325 | 9453 | AGO00436 | 23484 | 53988 | 84492, 114996, 145500, 176004, 206508 |
| 3271 | ACV33137 | 17302 | 47806 | 78310, 108814, 139318, 169822, 200326 | 9454 | AGO00448 | 23485 | 53989 | 84493, 114997, 145501, 176005, 206509 |
| 3272 | ACV33147 | 17303 | 47807 | 78311, 108815, 139319, 169823, 200327 | 9455 | AGQ47722 | 23486 | 53990 | 84494, 114998, 145502, 176006, 206510 |
| 3273 | ACV33157 | 17304 | 47808 | 78312, 108816, 139320, 169824, 200328 | 9456 | AGQ47731 | 23487 | 53991 | 84495, 114999, 145503, 176007, 206511 |
| 3274 | ACV33167 | 17305 | 47809 | 78313, 108817, 139321, 169825, 200329 | 9457 | AGQ47743 | 23488 | 53992 | 84496, 115000, 145504, 176008, 206512 |
| 3275 | ACV33177 | 17306 | 47810 | 78314, 108818, 139322, 169826, 200330 | 9458 | AGQ47755 | 23489 | 53993 | 84497, 115001, 145505, 176009, 206513 |
| 3276 | ACV41993 | 17307 | 47811 | 78315, 108819, 139323, 169827, 200331 | 9459 | AGQ47767 | 23490 | 53994 | 84498, 115002, 145506, 176010, 206514 |
| 3277 | ACV42010 | 17308 | 47812 | 78316, 108820, 139324, 169828, 200332 | 9460 | AGQ47779 | 23491 | 53995 | 84499, 115003, 145507, 176011, 206515 |
| 3278 | ACV42020 | 17309 | 47813 | 78317, 108821, 139325, 169829, 200333 | 9461 | AGQ47791 | 23492 | 53996 | 84500, 115004, 145508, 176012, 206516 |
| 3279 | ACV49504 | 17310 | 47814 | 78318, 108822, 139326, 169830, 200334 | 9462 | AGQ47803 | 23493 | 53997 | 84501, 115005, 145509, 176013, 206517 |
| 3280 | ACV49537 | 17311 | 47815 | 78319, 108823, 139327, 169831, 200335 | 9463 | AGQ47814 | 23494 | 53998 | 84502, 115006, 145510, 176014, 206518 |
| 3281 | ACV49559 | 17312 | 47816 | 78320, 108824, 139328, 169832, 200336 | 9464 | AGQ47826 | 23495 | 53999 | 84503, 115007, 145511, 176015, 206519 |
| 3282 | ACV49570 | 17313 | 47817 | 78321, 108825, 139329, 169833, 200337 | 9465 | AGQ47838 | 23496 | 54000 | 84504, 115008, 145512, 176016, 206520 |
| 3283 | ACV49581 | 17314 | 47818 | 78322, 108826, 139330, 169834, 200338 | 9466 | AGQ47850 | 23497 | 54001 | 84505, 115009, 145513, 176017, 206521 |
| 3284 | ACV49592 | 17315 | 47819 | 78323, 108827, 139331, 169835, 200339 | 9467 | AGQ47873 | 23498 | 54002 | 84506, 115010, 145514, 176018, 206522 |
| 3285 | ACV49603 | 17316 | 47820 | 78324, 108828, 139332, 169836, 200340 | 9468 | AGQ47885 | 23499 | 54003 | 84507, 115011, 145515, 176019, 206523 |
| 3286 | ACV49625 | 17317 | 47821 | 78325, 108829, 139333, 169837, 200341 | 9469 | AGQ47897 | 23500 | 54004 | 84508, 115012, 145516, 176020, 206524 |
| 3287 | ACV49647 | 17318 | 47822 | 78326, 108830, 139334, 169838, 200342 | 9470 | AGQ47909 | 23501 | 54005 | 84509, 115013, 145517, 176021, 206525 |

FIG. 3 continued

| | | | | | | | | | |
|---|---|---|---|---|---|---|---|---|---|
| 3288 | ACV49669 | 17319 | 47823 | 78327, 108831, 139335, 169839, 200343 | 9471 | AGQ47921 | 23502 | 54006 | 84510, 115014, 145518, 176022, 206526 |
| 3289 | ACV49679 | 17320 | 47824 | 78328, 108832, 139336, 169840, 200344 | 9472 | AGQ47933 | 23503 | 54007 | 84511, 115015, 145519, 176023, 206527 |
| 3290 | ACV53442 | 17321 | 47825 | 78329, 108833, 139337, 169841, 200345 | 9473 | AGQ47945 | 23504 | 54008 | 84512, 115016, 145520, 176024, 206528 |
| 3291 | ACV53452 | 17322 | 47826 | 78330, 108834, 139338, 169842, 200346 | 9474 | AGQ47957 | 23505 | 54009 | 84513, 115017, 145521, 176025, 206529 |
| 3292 | ACV53462 | 17323 | 47827 | 78331, 108835, 139339, 169843, 200347 | 9475 | AGQ47969 | 23506 | 54010 | 84514, 115018, 145522, 176026, 206530 |
| 3293 | ACV53472 | 17324 | 47828 | 78332, 108836, 139340, 169844, 200348 | 9476 | AGQ47981 | 23507 | 54011 | 84515, 115019, 145523, 176027, 206531 |
| 3294 | ACV53482 | 17325 | 47829 | 78333, 108837, 139341, 169845, 200349 | 9477 | AGQ48005 | 23508 | 54012 | 84516, 115020, 145524, 176028, 206532 |
| 3295 | ACV53492 | 17326 | 47830 | 78334, 108838, 139342, 169846, 200350 | 9478 | AGQ48017 | 23509 | 54013 | 84517, 115021, 145525, 176029, 206533 |
| 3296 | ACV53502 | 17327 | 47831 | 78335, 108839, 139343, 169847, 200351 | 9479 | AGQ48029 | 23510 | 54014 | 84518, 115022, 145526, 176030, 206534 |
| 3297 | ACV53891 | 17328 | 47832 | 78336, 108840, 139344, 169848, 200352 | 9480 | AGQ48041 | 23511 | 54015 | 84519, 115023, 145527, 176031, 206535 |
| 3298 | ACV53901 | 17329 | 47833 | 78337, 108841, 139345, 169849, 200353 | 9481 | AGQ48053 | 23512 | 54016 | 84520, 115024, 145528, 176032, 206536 |
| 3299 | ACV53911 | 17330 | 47834 | 78338, 108842, 139346, 169850, 200354 | 9482 | AGQ81707 | 23513 | 54017 | 84521, 115025, 145529, 176033, 206537 |
| 3300 | ACV67088 | 17331 | 47835 | 78339, 108843, 139347, 169851, 200355 | 9483 | AGQ81715 | 23514 | 54018 | 84522, 115026, 145530, 176034, 206538 |
| 3301 | ACV67168 | 17332 | 47836 | 78340, 108844, 139348, 169852, 200356 | 9484 | AGQ81717 | 23515 | 54019 | 84523, 115027, 145531, 176035, 206539 |
| 3302 | ACV67169 | 17333 | 47837 | 78341, 108845, 139349, 169853, 200357 | 9485 | AGQ81718 | 23516 | 54020 | 84524, 115028, 145532, 176036, 206540 |
| 3303 | ACV67171 | 17334 | 47838 | 78342, 108846, 139350, 169854, 200358 | 9486 | AGQ81719 | 23517 | 54021 | 84525, 115029, 145533, 176037, 206541 |
| 3304 | ACV67172 | 17335 | 47839 | 78343, 108847, 139351, 169855, 200359 | 9487 | AGQ81722 | 23518 | 54022 | 84526, 115030, 145534, 176038, 206542 |
| 3305 | ACV67173 | 17336 | 47840 | 78344, 108848, 139352, 169856, 200360 | 9488 | AGQ81724 | 23519 | 54023 | 84527, 115031, 145535, 176039, 206543 |

FIG. 3 continued

| | | | | | | | | | |
|---|---|---|---|---|---|---|---|---|---|
| 3306 | ACV67174 | 17337 | 47841 | 78345, 108849, 139353, 169857, 200361 | 9489 | AGQ81726 | 23520 | 54024 | 84528, 115032, 145536, 176040, 206544 |
| 3307 | ACV67175 | 17338 | 47842 | 78346, 108850, 139354, 169858, 200362 | 9490 | AGQ81727 | 23521 | 54025 | 84529, 115033, 145537, 176041, 206545 |
| 3308 | ACV67176 | 17339 | 47843 | 78347, 108851, 139355, 169859, 200363 | 9491 | AGQ81728 | 23522 | 54026 | 84530, 115034, 145538, 176042, 206546 |
| 3309 | ACV67177 | 17340 | 47844 | 78348, 108852, 139356, 169860, 200364 | 9492 | AGQ81729 | 23523 | 54027 | 84531, 115035, 145539, 176043, 206547 |
| 3310 | ACV67178 | 17341 | 47845 | 78349, 108853, 139357, 169861, 200365 | 9493 | AGQ81730 | 23524 | 54028 | 84532, 115036, 145540, 176044, 206548 |
| 3311 | ACV67179 | 17342 | 47846 | 78350, 108854, 139358, 169862, 200366 | 9494 | AGQ81731 | 23525 | 54029 | 84533, 115037, 145541, 176045, 206549 |
| 3312 | ACV67180 | 17343 | 47847 | 78351, 108855, 139359, 169863, 200367 | 9495 | AGQ81732 | 23526 | 54030 | 84534, 115038, 145542, 176046, 206550 |
| 3313 | ACV67181 | 17344 | 47848 | 78352, 108856, 139360, 169864, 200368 | 9496 | AGQ81733 | 23527 | 54031 | 84535, 115039, 145543, 176047, 206551 |
| 3314 | ACV67182 | 17345 | 47849 | 78353, 108857, 139361, 169865, 200369 | 9497 | AGQ81734 | 23528 | 54032 | 84536, 115040, 145544, 176048, 206552 |
| 3315 | ACV67183 | 17346 | 47850 | 78354, 108858, 139362, 169866, 200370 | 9498 | AGQ81735 | 23529 | 54033 | 84537, 115041, 145545, 176049, 206553 |
| 3316 | ACV67184 | 17347 | 47851 | 78355, 108859, 139363, 169867, 200371 | 9499 | AGQ81736 | 23530 | 54034 | 84538, 115042, 145546, 176050, 206554 |
| 3317 | ACV67186 | 17348 | 47852 | 78356, 108860, 139364, 169868, 200372 | 9500 | AGQ81737 | 23531 | 54035 | 84539, 115043, 145547, 176051, 206555 |
| 3318 | ACV67187 | 17349 | 47853 | 78357, 108861, 139365, 169869, 200373 | 9501 | AGQ81738 | 23532 | 54036 | 84540, 115044, 145548, 176052, 206556 |
| 3319 | ACV67188 | 17350 | 47854 | 78358, 108862, 139366, 169870, 200374 | 9502 | AGQ81739 | 23533 | 54037 | 84541, 115045, 145549, 176053, 206557 |
| 3320 | ACV67189 | 17351 | 47855 | 78359, 108863, 139367, 169871, 200375 | 9503 | AGQ81740 | 23534 | 54038 | 84542, 115046, 145550, 176054, 206558 |
| 3321 | ACV67190 | 17352 | 47856 | 78360, 108864, 139368, 169872, 200376 | 9504 | AGQ81741 | 23535 | 54039 | 84543, 115047, 145551, 176055, 206559 |
| 3322 | ACV67191 | 17353 | 47857 | 78361, 108865, 139369, 169873, 200377 | 9505 | AGQ81742 | 23536 | 54040 | 84544, 115048, 145552, 176056, 206560 |
| 3323 | ACV67192 | 17354 | 47858 | 78362, 108866, 139370, 169874, 200378 | 9506 | AGQ81744 | 23537 | 54041 | 84545, 115049, 145553, 176057, 206561 |

FIG. 3 continued

| | | | | | | | | | |
|---|---|---|---|---|---|---|---|---|---|
| 3324 | ACV67193 | 17355 | 47859 | 78363, 108867, 139371, 169875, 200379 | 9507 | AGQ81746 | 23538 | 54042 | 84546, 115050, 145554, 176058, 206562 |
| 3325 | ACV67194 | 17356 | 47860 | 78364, 108868, 139372, 169876, 200380 | 9508 | AGQ81747 | 23539 | 54043 | 84547, 115051, 145555, 176059, 206563 |
| 3326 | ACV67195 | 17357 | 47861 | 78365, 108869, 139373, 169877, 200381 | 9509 | AGQ81749 | 23540 | 54044 | 84548, 115052, 145556, 176060, 206564 |
| 3327 | ACV67196 | 17358 | 47862 | 78366, 108870, 139374, 169878, 200382 | 9510 | AGQ81750 | 23541 | 54045 | 84549, 115053, 145557, 176061, 206565 |
| 3328 | ACV67197 | 17359 | 47863 | 78367, 108871, 139375, 169879, 200383 | 9511 | AGQ81751 | 23542 | 54046 | 84550, 115054, 145558, 176062, 206566 |
| 3329 | ACV67199 | 17360 | 47864 | 78368, 108872, 139376, 169880, 200384 | 9512 | AGQ81753 | 23543 | 54047 | 84551, 115055, 145559, 176063, 206567 |
| 3330 | ACV67200 | 17361 | 47865 | 78369, 108873, 139377, 169881, 200385 | 9513 | AGQ81754 | 23544 | 54048 | 84552, 115056, 145560, 176064, 206568 |
| 3331 | ACV67201 | 17362 | 47866 | 78370, 108874, 139378, 169882, 200386 | 9514 | AGQ81756 | 23545 | 54049 | 84553, 115057, 145561, 176065, 206569 |
| 3332 | ACV67202 | 17363 | 47867 | 78371, 108875, 139379, 169883, 200387 | 9515 | AGQ81757 | 23546 | 54050 | 84554, 115058, 145562, 176066, 206570 |
| 3333 | ACV67203 | 17364 | 47868 | 78372, 108876, 139380, 169884, 200388 | 9516 | AGQ81758 | 23547 | 54051 | 84555, 115059, 145563, 176067, 206571 |
| 3334 | ACV67204 | 17365 | 47869 | 78373, 108877, 139381, 169885, 200389 | 9517 | AGQ81759 | 23548 | 54052 | 84556, 115060, 145564, 176068, 206572 |
| 3335 | ACV67205 | 17366 | 47870 | 78374, 108878, 139382, 169886, 200390 | 9518 | AGQ81760 | 23549 | 54053 | 84557, 115061, 145565, 176069, 206573 |
| 3336 | ACV67206 | 17367 | 47871 | 78375, 108879, 139383, 169887, 200391 | 9519 | AGQ81761 | 23550 | 54054 | 84558, 115062, 145566, 176070, 206574 |
| 3337 | ACV67207 | 17368 | 47872 | 78376, 108880, 139384, 169888, 200392 | 9520 | AGQ81763 | 23551 | 54055 | 84559, 115063, 145567, 176071, 206575 |
| 3338 | ACV67208 | 17369 | 47873 | 78377, 108881, 139385, 169889, 200393 | 9521 | AGQ81766 | 23552 | 54056 | 84560, 115064, 145568, 176072, 206576 |
| 3339 | ACV67210 | 17370 | 47874 | 78378, 108882, 139386, 169890, 200394 | 9522 | AGQ81767 | 23553 | 54057 | 84561, 115065, 145569, 176073, 206577 |
| 3340 | ACV67211 | 17371 | 47875 | 78379, 108883, 139387, 169891, 200395 | 9523 | AGQ81768 | 23554 | 54058 | 84562, 115066, 145570, 176074, 206578 |
| 3341 | ACV70076 | 17372 | 47876 | 78380, 108884, 139388, 169892, 200396 | 9524 | AGQ81769 | 23555 | 54059 | 84563, 115067, 145571, 176075, 206579 |

FIG. 3 continued

| | | | | | | | | | |
|---|---|---|---|---|---|---|---|---|---|
| 3342 | ACV70086 | 17373 | 47877 | 78381, 108885, 139389, 169893, 200397 | 9525 | AGQ81770 | 23556 | 54060 | 84564, 115068, 145572, 176076, 206580 |
| 3343 | ACV70096 | 17374 | 47878 | 78382, 108886, 139390, 169894, 200398 | 9526 | AGQ81772 | 23557 | 54061 | 84565, 115069, 145573, 176077, 206581 |
| 3344 | ACV70106 | 17375 | 47879 | 78383, 108887, 139391, 169895, 200399 | 9527 | AGQ81773 | 23558 | 54062 | 84566, 115070, 145574, 176078, 206582 |
| 3345 | ACV70116 | 17376 | 47880 | 78384, 108888, 139392, 169896, 200400 | 9528 | AGQ81774 | 23559 | 54063 | 84567, 115071, 145575, 176079, 206583 |
| 3346 | ACV70126 | 17377 | 47881 | 78385, 108889, 139393, 169897, 200401 | 9529 | AGQ81776 | 23560 | 54064 | 84568, 115072, 145576, 176080, 206584 |
| 3347 | ACV70157 | 17378 | 47882 | 78386, 108890, 139394, 169898, 200402 | 9530 | AGQ81777 | 23561 | 54065 | 84569, 115073, 145577, 176081, 206585 |
| 3348 | ACV70167 | 17379 | 47883 | 78387, 108891, 139395, 169899, 200403 | 9531 | AGQ81778 | 23562 | 54066 | 84570, 115074, 145578, 176082, 206586 |
| 3349 | ACV70177 | 17380 | 47884 | 78388, 108892, 139396, 169900, 200404 | 9532 | AGQ81779 | 23563 | 54067 | 84571, 115075, 145579, 176083, 206587 |
| 3350 | ACV70187 | 17381 | 47885 | 78389, 108893, 139397, 169901, 200405 | 9533 | AGQ81780 | 23564 | 54068 | 84572, 115076, 145580, 176084, 206588 |
| 3351 | ACV70197 | 17382 | 47886 | 78390, 108894, 139398, 169902, 200406 | 9534 | AGQ81781 | 23565 | 54069 | 84573, 115077, 145581, 176085, 206589 |
| 3352 | ACV70207 | 17383 | 47887 | 78391, 108895, 139399, 169903, 200407 | 9535 | AGQ81783 | 23566 | 54070 | 84574, 115078, 145582, 176086, 206590 |
| 3353 | ACV70217 | 17384 | 47888 | 78392, 108896, 139400, 169904, 200408 | 9536 | AGQ81784 | 23567 | 54071 | 84575, 115079, 145583, 176087, 206591 |
| 3354 | ACV70227 | 17385 | 47889 | 78393, 108897, 139401, 169905, 200409 | 9537 | AGQ81785 | 23568 | 54072 | 84576, 115080, 145584, 176088, 206592 |
| 3355 | ACV70237 | 17386 | 47890 | 78394, 108898, 139402, 169906, 200410 | 9538 | AGQ81787 | 23569 | 54073 | 84577, 115081, 145585, 176089, 206593 |
| 3356 | ACV70247 | 17387 | 47891 | 78395, 108899, 139403, 169907, 200411 | 9539 | AGQ81789 | 23570 | 54074 | 84578, 115082, 145586, 176090, 206594 |
| 3357 | ACV70257 | 17388 | 47892 | 78396, 108900, 139404, 169908, 200412 | 9540 | AGQ81790 | 23571 | 54075 | 84579, 115083, 145587, 176091, 206595 |
| 3358 | ACV70267 | 17389 | 47893 | 78397, 108901, 139405, 169909, 200413 | 9541 | AGQ81792 | 23572 | 54076 | 84580, 115084, 145588, 176092, 206596 |
| 3359 | ACV70277 | 17390 | 47894 | 78398, 108902, 139406, 169910, 200414 | 9542 | AGQ81793 | 23573 | 54077 | 84581, 115085, 145589, 176093, 206597 |

FIG. 3 continued

| | | | | | | | | | |
|---|---|---|---|---|---|---|---|---|---|
| 3360 | ACV70287 | 17391 | 47895 | 78399, 108903, 139407, 169911, 200415 | 9543 | AGQ81794 | 23574 | 54078 | 84582, 115086, 145590, 176094, 206598 |
| 3361 | ACV70297 | 17392 | 47896 | 78400, 108904, 139408, 169912, 200416 | 9544 | AGQ81795 | 23575 | 54079 | 84583, 115087, 145591, 176095, 206599 |
| 3362 | ACV70307 | 17393 | 47897 | 78401, 108905, 139409, 169913, 200417 | 9545 | AGQ81796 | 23576 | 54080 | 84584, 115088, 145592, 176096, 206600 |
| 3363 | ACV70317 | 17394 | 47898 | 78402, 108906, 139410, 169914, 200418 | 9546 | AGQ81798 | 23577 | 54081 | 84585, 115089, 145593, 176097, 206601 |
| 3364 | ACV70327 | 17395 | 47899 | 78403, 108907, 139411, 169915, 200419 | 9547 | AGQ81799 | 23578 | 54082 | 84586, 115090, 145594, 176098, 206602 |
| 3365 | ACV70337 | 17396 | 47900 | 78404, 108908, 139412, 169916, 200420 | 9548 | AGQ81800 | 23579 | 54083 | 84587, 115091, 145595, 176099, 206603 |
| 3366 | ACV70347 | 17397 | 47901 | 78405, 108909, 139413, 169917, 200421 | 9549 | AGQ81801 | 23580 | 54084 | 84588, 115092, 145596, 176100, 206604 |
| 3367 | ACV70357 | 17398 | 47902 | 78406, 108910, 139414, 169918, 200422 | 9550 | AGQ81802 | 23581 | 54085 | 84589, 115093, 145597, 176101, 206605 |
| 3368 | ACV70367 | 17399 | 47903 | 78407, 108911, 139415, 169919, 200423 | 9551 | AGQ81803 | 23582 | 54086 | 84590, 115094, 145598, 176102, 206606 |
| 3369 | ACV70377 | 17400 | 47904 | 78408, 108912, 139416, 169920, 200424 | 9552 | AGQ81804 | 23583 | 54087 | 84591, 115095, 145599, 176103, 206607 |
| 3370 | ACV70387 | 17401 | 47905 | 78409, 108913, 139417, 169921, 200425 | 9553 | AGQ81805 | 23584 | 54088 | 84592, 115096, 145600, 176104, 206608 |
| 3371 | ACV70397 | 17402 | 47906 | 78410, 108914, 139418, 169922, 200426 | 9554 | AGQ81807 | 23585 | 54089 | 84593, 115097, 145601, 176105, 206609 |
| 3372 | ACV70407 | 17403 | 47907 | 78411, 108915, 139419, 169923, 200427 | 9555 | AGQ81808 | 23586 | 54090 | 84594, 115098, 145602, 176106, 206610 |
| 3373 | ACV70417 | 17404 | 47908 | 78412, 108916, 139420, 169924, 200428 | 9556 | AGQ81809 | 23587 | 54091 | 84595, 115099, 145603, 176107, 206611 |
| 3374 | ACV70427 | 17405 | 47909 | 78413, 108917, 139421, 169925, 200429 | 9557 | AGQ81810 | 23588 | 54092 | 84596, 115100, 145604, 176108, 206612 |
| 3375 | ACV70437 | 17406 | 47910 | 78414, 108918, 139422, 169926, 200430 | 9558 | AGQ81811 | 23589 | 54093 | 84597, 115101, 145605, 176109, 206613 |
| 3376 | ACV70447 | 17407 | 47911 | 78415, 108919, 139423, 169927, 200431 | 9559 | AGQ81812 | 23590 | 54094 | 84598, 115102, 145606, 176110, 206614 |
| 3377 | ACV70457 | 17408 | 47912 | 78416, 108920, 139424, 169928, 200432 | 9560 | AGQ81814 | 23591 | 54095 | 84599, 115103, 145607, 176111, 206615 |

FIG. 3 continued

| | | | | | | | | | |
|---|---|---|---|---|---|---|---|---|---|
| 3378 | ACV70467 | 17409 | 47913 | 78417, 108921, 139425, 169929, 200433 | 9561 | AGQ81815 | 23592 | 54096 | 84600, 115104, 145608, 176112, 206616 |
| 3379 | ACV70477 | 17410 | 47914 | 78418, 108922, 139426, 169930, 200434 | 9562 | AGQ81816 | 23593 | 54097 | 84601, 115105, 145609, 176113, 206617 |
| 3380 | ACV70487 | 17411 | 47915 | 78419, 108923, 139427, 169931, 200435 | 9563 | AGQ81817 | 23594 | 54098 | 84602, 115106, 145610, 176114, 206618 |
| 3381 | ACV70497 | 17412 | 47916 | 78420, 108924, 139428, 169932, 200436 | 9564 | AGQ81818 | 23595 | 54099 | 84603, 115107, 145611, 176115, 206619 |
| 3382 | ACV70507 | 17413 | 47917 | 78421, 108925, 139429, 169933, 200437 | 9565 | AGQ81819 | 23596 | 54100 | 84604, 115108, 145612, 176116, 206620 |
| 3383 | ACV70517 | 17414 | 47918 | 78422, 108926, 139430, 169934, 200438 | 9566 | AGQ81820 | 23597 | 54101 | 84605, 115109, 145613, 176117, 206621 |
| 3384 | ACV70527 | 17415 | 47919 | 78423, 108927, 139431, 169935, 200439 | 9567 | AGQ81822 | 23598 | 54102 | 84606, 115110, 145614, 176118, 206622 |
| 3385 | ACV70547 | 17416 | 47920 | 78424, 108928, 139432, 169936, 200440 | 9568 | AGQ81823 | 23599 | 54103 | 84607, 115111, 145615, 176119, 206623 |
| 3386 | ACV70557 | 17417 | 47921 | 78425, 108929, 139433, 169937, 200441 | 9569 | AGQ81824 | 23600 | 54104 | 84608, 115112, 145616, 176120, 206624 |
| 3387 | ACV70567 | 17418 | 47922 | 78426, 108930, 139434, 169938, 200442 | 9570 | AGQ81825 | 23601 | 54105 | 84609, 115113, 145617, 176121, 206625 |
| 3388 | ACV70577 | 17419 | 47923 | 78427, 108931, 139435, 169939, 200443 | 9571 | AGQ81831 | 23602 | 54106 | 84610, 115114, 145618, 176122, 206626 |
| 3389 | ACV70587 | 17420 | 47924 | 78428, 108932, 139436, 169940, 200444 | 9572 | AGQ81837 | 23603 | 54107 | 84611, 115115, 145619, 176123, 206627 |
| 3390 | ACV70597 | 17421 | 47925 | 78429, 108933, 139437, 169941, 200445 | 9573 | AGQ81838 | 23604 | 54108 | 84612, 115116, 145620, 176124, 206628 |
| 3391 | ACV70607 | 17422 | 47926 | 78430, 108934, 139438, 169942, 200446 | 9574 | AGQ81839 | 23605 | 54109 | 84613, 115117, 145621, 176125, 206629 |
| 3392 | ACV70617 | 17423 | 47927 | 78431, 108935, 139439, 169943, 200447 | 9575 | AGQ81840 | 23606 | 54110 | 84614, 115118, 145622, 176126, 206630 |
| 3393 | ACV70647 | 17424 | 47928 | 78432, 108936, 139440, 169944, 200448 | 9576 | AGQ81841 | 23607 | 54111 | 84615, 115119, 145623, 176127, 206631 |
| 3394 | ACV70657 | 17425 | 47929 | 78433, 108937, 139441, 169945, 200449 | 9577 | AGQ81843 | 23608 | 54112 | 84616, 115120, 145624, 176128, 206632 |
| 3395 | ACV70667 | 17426 | 47930 | 78434, 108938, 139442, 169946, 200450 | 9578 | AGQ81845 | 23609 | 54113 | 84617, 115121, 145625, 176129, 206633 |

FIG. 3 continued

| | | | | | | | | | |
|---|---|---|---|---|---|---|---|---|---|
| 3396 | ACV70677 | 17427 | 47931 | 78435, 108939, 139443, 169947, 200451 | 9579 | AGQ81846 | 23610 | 54114 | 84618, 115122, 145626, 176130, 206634 |
| 3397 | ACV70687 | 17428 | 47932 | 78436, 108940, 139444, 169948, 200452 | 9580 | AGQ81847 | 23611 | 54115 | 84619, 115123, 145627, 176131, 206635 |
| 3398 | ACV70697 | 17429 | 47933 | 78437, 108941, 139445, 169949, 200453 | 9581 | AGQ81848 | 23612 | 54116 | 84620, 115124, 145628, 176132, 206636 |
| 3399 | ACV70707 | 17430 | 47934 | 78438, 108942, 139446, 169950, 200454 | 9582 | AGQ81850 | 23613 | 54117 | 84621, 115125, 145629, 176133, 206637 |
| 3400 | ACV70717 | 17431 | 47935 | 78439, 108943, 139447, 169951, 200455 | 9583 | AGQ81852 | 23614 | 54118 | 84622, 115126, 145630, 176134, 206638 |
| 3401 | ACV70727 | 17432 | 47936 | 78440, 108944, 139448, 169952, 200456 | 9584 | AGQ81853 | 23615 | 54119 | 84623, 115127, 145631, 176135, 206639 |
| 3402 | ACV70737 | 17433 | 47937 | 78441, 108945, 139449, 169953, 200457 | 9585 | AGQ81854 | 23616 | 54120 | 84624, 115128, 145632, 176136, 206640 |
| 3403 | ACV70757 | 17434 | 47938 | 78442, 108946, 139450, 169954, 200458 | 9586 | AGQ81855 | 23617 | 54121 | 84625, 115129, 145633, 176137, 206641 |
| 3404 | ACV70767 | 17435 | 47939 | 78443, 108947, 139451, 169955, 200459 | 9587 | AGQ81856 | 23618 | 54122 | 84626, 115130, 145634, 176138, 206642 |
| 3405 | ACV70777 | 17436 | 47940 | 78444, 108948, 139452, 169956, 200460 | 9588 | AGQ81857 | 23619 | 54123 | 84627, 115131, 145635, 176139, 206643 |
| 3406 | ACV70787 | 17437 | 47941 | 78445, 108949, 139453, 169957, 200461 | 9589 | AGQ81858 | 23620 | 54124 | 84628, 115132, 145636, 176140, 206644 |
| 3407 | ACV70797 | 17438 | 47942 | 78446, 108950, 139454, 169958, 200462 | 9590 | AGQ81859 | 23621 | 54125 | 84629, 115133, 145637, 176141, 206645 |
| 3408 | ACV70807 | 17439 | 47943 | 78447, 108951, 139455, 169959, 200463 | 9591 | AGQ81860 | 23622 | 54126 | 84630, 115134, 145638, 176142, 206646 |
| 3409 | ACV70817 | 17440 | 47944 | 78448, 108952, 139456, 169960, 200464 | 9592 | AGQ81861 | 23623 | 54127 | 84631, 115135, 145639, 176143, 206647 |
| 3410 | ACV70827 | 17441 | 47945 | 78449, 108953, 139457, 169961, 200465 | 9593 | AGQ81862 | 23624 | 54128 | 84632, 115136, 145640, 176144, 206648 |
| 3411 | ACV70837 | 17442 | 47946 | 78450, 108954, 139458, 169962, 200466 | 9594 | AGQ81863 | 23625 | 54129 | 84633, 115137, 145641, 176145, 206649 |
| 3412 | ACV70847 | 17443 | 47947 | 78451, 108955, 139459, 169963, 200467 | 9595 | AGQ81864 | 23626 | 54130 | 84634, 115138, 145642, 176146, 206650 |
| 3413 | ACV70867 | 17444 | 47948 | 78452, 108956, 139460, 169964, 200468 | 9596 | AGQ81865 | 23627 | 54131 | 84635, 115139, 145643, 176147, 206651 |

FIG. 3 continued

| | | | | | | | | | |
|---|---|---|---|---|---|---|---|---|---|
| 3414 | ACV70877 | 17445 | 47949 | 78453, 108957, 139461, 169965, 200469 | 9597 | AGQ81868 | 23628 | 54132 | 84636, 115140, 145644, 176148, 206652 |
| 3415 | ACV70887 | 17446 | 47950 | 78454, 108958, 139462, 169966, 200470 | 9598 | AGQ81869 | 23629 | 54133 | 84637, 115141, 145645, 176149, 206653 |
| 3416 | ACV70897 | 17447 | 47951 | 78455, 108959, 139463, 169967, 200471 | 9599 | AGQ81870 | 23630 | 54134 | 84638, 115142, 145646, 176150, 206654 |
| 3417 | ACV70907 | 17448 | 47952 | 78456, 108960, 139464, 169968, 200472 | 9600 | AGQ81871 | 23631 | 54135 | 84639, 115143, 145647, 176151, 206655 |
| 3418 | ACV70917 | 17449 | 47953 | 78457, 108961, 139465, 169969, 200473 | 9601 | AGQ81872 | 23632 | 54136 | 84640, 115144, 145648, 176152, 206656 |
| 3419 | ACV70927 | 17450 | 47954 | 78458, 108962, 139466, 169970, 200474 | 9602 | AGQ81875 | 23633 | 54137 | 84641, 115145, 145649, 176153, 206657 |
| 3420 | ACV70937 | 17451 | 47955 | 78459, 108963, 139467, 169971, 200475 | 9603 | AGQ81876 | 23634 | 54138 | 84642, 115146, 145650, 176154, 206658 |
| 3421 | ACV70947 | 17452 | 47956 | 78460, 108964, 139468, 169972, 200476 | 9604 | AGQ81877 | 23635 | 54139 | 84643, 115147, 145651, 176155, 206659 |
| 3422 | ACV70957 | 17453 | 47957 | 78461, 108965, 139469, 169973, 200477 | 9605 | AGQ81878 | 23636 | 54140 | 84644, 115148, 145652, 176156, 206660 |
| 3423 | ACV70967 | 17454 | 47958 | 78462, 108966, 139470, 169974, 200478 | 9606 | AGQ81882 | 23637 | 54141 | 84645, 115149, 145653, 176157, 206661 |
| 3424 | ACV70977 | 17455 | 47959 | 78463, 108967, 139471, 169975, 200479 | 9607 | AGQ81883 | 23638 | 54142 | 84646, 115150, 145654, 176158, 206662 |
| 3425 | ACV70987 | 17456 | 47960 | 78464, 108968, 139472, 169976, 200480 | 9608 | AGQ81884 | 23639 | 54143 | 84647, 115151, 145655, 176159, 206663 |
| 3426 | ACV71007 | 17457 | 47961 | 78465, 108969, 139473, 169977, 200481 | 9609 | AGQ81885 | 23640 | 54144 | 84648, 115152, 145656, 176160, 206664 |
| 3427 | ACV82218 | 17458 | 47962 | 78466, 108970, 139474, 169978, 200482 | 9610 | AGQ81886 | 23641 | 54145 | 84649, 115153, 145657, 176161, 206665 |
| 3428 | ACV82219 | 17459 | 47963 | 78467, 108971, 139475, 169979, 200483 | 9611 | AGQ81888 | 23642 | 54146 | 84650, 115154, 145658, 176162, 206666 |
| 3429 | ACV82220 | 17460 | 47964 | 78468, 108972, 139476, 169980, 200484 | 9612 | AGQ81889 | 23643 | 54147 | 84651, 115155, 145659, 176163, 206667 |
| 3430 | ACV82221 | 17461 | 47965 | 78469, 108973, 139477, 169981, 200485 | 9613 | AGQ81890 | 23644 | 54148 | 84652, 115156, 145660, 176164, 206668 |
| 3431 | ACV88402 | 17462 | 47966 | 78470, 108974, 139478, 169982, 200486 | 9614 | AGQ81891 | 23645 | 54149 | 84653, 115157, 145661, 176165, 206669 |

FIG. 3 continued

| | | | | | | | | | |
|---|---|---|---|---|---|---|---|---|---|
| 3432 | ACV88412 | 17463 | 47967 | 78471, 108975, 139479, 169983, 200487 | 9615 | AGQ81893 | 23646 | 54150 | 84654, 115158, 145662, 176166, 206670 |
| 3433 | ACV88422 | 17464 | 47968 | 78472, 108976, 139480, 169984, 200488 | 9616 | AGQ81894 | 23647 | 54151 | 84655, 115159, 145663, 176167, 206671 |
| 3434 | ACV89505 | 17465 | 47969 | 78473, 108977, 139481, 169985, 200489 | 9617 | AGQ81895 | 23648 | 54152 | 84656, 115160, 145664, 176168, 206672 |
| 3435 | ACV91673 | 17466 | 47970 | 78474, 108978, 139482, 169986, 200490 | 9618 | AGQ81896 | 23649 | 54153 | 84657, 115161, 145665, 176169, 206673 |
| 3436 | ACV91681 | 17467 | 47971 | 78475, 108979, 139483, 169987, 200491 | 9619 | AGQ81897 | 23650 | 54154 | 84658, 115162, 145666, 176170, 206674 |
| 3437 | ACX31593 | 17468 | 47972 | 78476, 108980, 139484, 169988, 200492 | 9620 | AGQ81898 | 23651 | 54155 | 84659, 115163, 145667, 176171, 206675 |
| 3438 | ACX31901 | 17469 | 47973 | 78477, 108981, 139485, 169989, 200493 | 9621 | AGQ81899 | 23652 | 54156 | 84660, 115164, 145668, 176172, 206676 |
| 3439 | ACX31902 | 17470 | 47974 | 78478, 108982, 139486, 169990, 200494 | 9622 | AGQ81900 | 23653 | 54157 | 84661, 115165, 145669, 176173, 206677 |
| 3440 | ACX31905 | 17471 | 47975 | 78479, 108983, 139487, 169991, 200495 | 9623 | AGQ81901 | 23654 | 54158 | 84662, 115166, 145670, 176174, 206678 |
| 3441 | ACX31906 | 17472 | 47976 | 78480, 108984, 139488, 169992, 200496 | 9624 | AGQ81902 | 23655 | 54159 | 84663, 115167, 145671, 176175, 206679 |
| 3442 | ACX31907 | 17473 | 47977 | 78481, 108985, 139489, 169993, 200497 | 9625 | AGQ81903 | 23656 | 54160 | 84664, 115168, 145672, 176176, 206680 |
| 3443 | ACX31908 | 17474 | 47978 | 78482, 108986, 139490, 169994, 200498 | 9626 | AGQ81904 | 23657 | 54161 | 84665, 115169, 145673, 176177, 206681 |
| 3444 | ACX31909 | 17475 | 47979 | 78483, 108987, 139491, 169995, 200499 | 9627 | AGQ81905 | 23658 | 54162 | 84666, 115170, 145674, 176178, 206682 |
| 3445 | ACX31911 | 17476 | 47980 | 78484, 108988, 139492, 169996, 200500 | 9628 | AGQ81906 | 23659 | 54163 | 84667, 115171, 145675, 176179, 206683 |
| 3446 | ACX31912 | 17477 | 47981 | 78485, 108989, 139493, 169997, 200501 | 9629 | AGQ81907 | 23660 | 54164 | 84668, 115172, 145676, 176180, 206684 |
| 3447 | ACX31913 | 17478 | 47982 | 78486, 108990, 139494, 169998, 200502 | 9630 | AGQ81908 | 23661 | 54165 | 84669, 115173, 145677, 176181, 206685 |
| 3448 | ACX31914 | 17479 | 47983 | 78487, 108991, 139495, 169999, 200503 | 9631 | AGQ81909 | 23662 | 54166 | 84670, 115174, 145678, 176182, 206686 |
| 3449 | ACX31915 | 17480 | 47984 | 78488, 108992, 139496, 170000, 200504 | 9632 | AGQ81910 | 23663 | 54167 | 84671, 115175, 145679, 176183, 206687 |

FIG. 3 continued

| | | | | | | | | | |
|---|---|---|---|---|---|---|---|---|---|
| 3450 | ACX31916 | 17481 | 47985 | 78489, 108993, 139497, 170001, 200505 | 9633 | AGQ81911 | 23664 | 54168 | 84672, 115176, 145680, 176184, 206688 |
| 3451 | ACX31917 | 17482 | 47986 | 78490, 108994, 139498, 170002, 200506 | 9634 | AGQ81912 | 23665 | 54169 | 84673, 115177, 145681, 176185, 206689 |
| 3452 | ACX31918 | 17483 | 47987 | 78491, 108995, 139499, 170003, 200507 | 9635 | AGQ81913 | 23666 | 54170 | 84674, 115178, 145682, 176186, 206690 |
| 3453 | ACX31919 | 17484 | 47988 | 78492, 108996, 139500, 170004, 200508 | 9636 | AGQ81914 | 23667 | 54171 | 84675, 115179, 145683, 176187, 206691 |
| 3454 | ACX31920 | 17485 | 47989 | 78493, 108997, 139501, 170005, 200509 | 9637 | AGQ81915 | 23668 | 54172 | 84676, 115180, 145684, 176188, 206692 |
| 3455 | ACX31922 | 17486 | 47990 | 78494, 108998, 139502, 170006, 200510 | 9638 | AGQ81917 | 23669 | 54173 | 84677, 115181, 145685, 176189, 206693 |
| 3456 | ACX31923 | 17487 | 47991 | 78495, 108999, 139503, 170007, 200511 | 9639 | AGQ81918 | 23670 | 54174 | 84678, 115182, 145686, 176190, 206694 |
| 3457 | ACX31924 | 17488 | 47992 | 78496, 109000, 139504, 170008, 200512 | 9640 | AGQ81919 | 23671 | 54175 | 84679, 115183, 145687, 176191, 206695 |
| 3458 | ACX31925 | 17489 | 47993 | 78497, 109001, 139505, 170009, 200513 | 9641 | AGQ81920 | 23672 | 54176 | 84680, 115184, 145688, 176192, 206696 |
| 3459 | ACX31926 | 17490 | 47994 | 78498, 109002, 139506, 170010, 200514 | 9642 | AGQ81921 | 23673 | 54177 | 84681, 115185, 145689, 176193, 206697 |
| 3460 | ACX31927 | 17491 | 47995 | 78499, 109003, 139507, 170011, 200515 | 9643 | AGQ81922 | 23674 | 54178 | 84682, 115186, 145690, 176194, 206698 |
| 3461 | ACX31928 | 17492 | 47996 | 78500, 109004, 139508, 170012, 200516 | 9644 | AGQ81923 | 23675 | 54179 | 84683, 115187, 145691, 176195, 206699 |
| 3462 | ACX31929 | 17493 | 47997 | 78501, 109005, 139509, 170013, 200517 | 9645 | AGQ81924 | 23676 | 54180 | 84684, 115188, 145692, 176196, 206700 |
| 3463 | ACX31930 | 17494 | 47998 | 78502, 109006, 139510, 170014, 200518 | 9646 | AGQ81925 | 23677 | 54181 | 84685, 115189, 145693, 176197, 206701 |
| 3464 | ACX31931 | 17495 | 47999 | 78503, 109007, 139511, 170015, 200519 | 9647 | AGQ81926 | 23678 | 54182 | 84686, 115190, 145694, 176198, 206702 |
| 3465 | ACX31932 | 17496 | 48000 | 78504, 109008, 139512, 170016, 200520 | 9648 | AGQ81927 | 23679 | 54183 | 84687, 115191, 145695, 176199, 206703 |
| 3466 | ACX35250 | 17497 | 48001 | 78505, 109009, 139513, 170017, 200521 | 9649 | AGQ81928 | 23680 | 54184 | 84688, 115192, 145696, 176200, 206704 |
| 3467 | ACX35260 | 17498 | 48002 | 78506, 109010, 139514, 170018, 200522 | 9650 | AGQ81929 | 23681 | 54185 | 84689, 115193, 145697, 176201, 206705 |

FIG. 3 continued

| | | | | | | | | | |
|---|---|---|---|---|---|---|---|---|---|
| 3468 | ACX35270 | 17499 | 48003 | 78507, 109011, 139515, 170019, 200523 | 9651 | AGQ81930 | 23682 | 54186 | 84690, 115194, 145698, 176202, 206706 |
| 3469 | ACX35280 | 17500 | 48004 | 78508, 109012, 139516, 170020, 200524 | 9652 | AGQ81931 | 23683 | 54187 | 84691, 115195, 145699, 176203, 206707 |
| 3470 | ACX35290 | 17501 | 48005 | 78509, 109013, 139517, 170021, 200525 | 9653 | AGQ81932 | 23684 | 54188 | 84692, 115196, 145700, 176204, 206708 |
| 3471 | ACX35300 | 17502 | 48006 | 78510, 109014, 139518, 170022, 200526 | 9654 | AGQ81934 | 23685 | 54189 | 84693, 115197, 145701, 176205, 206709 |
| 3472 | ACX35310 | 17503 | 48007 | 78511, 109015, 139519, 170023, 200527 | 9655 | AGQ81935 | 23686 | 54190 | 84694, 115198, 145702, 176206, 206710 |
| 3473 | ACX35320 | 17504 | 48008 | 78512, 109016, 139520, 170024, 200528 | 9656 | AGQ81936 | 23687 | 54191 | 84695, 115199, 145703, 176207, 206711 |
| 3474 | ACX35330 | 17505 | 48009 | 78513, 109017, 139521, 170025, 200529 | 9657 | AGQ81937 | 23688 | 54192 | 84696, 115200, 145704, 176208, 206712 |
| 3475 | ACX48479 | 17506 | 48010 | 78514, 109018, 139522, 170026, 200530 | 9658 | AGQ81938 | 23689 | 54193 | 84697, 115201, 145705, 176209, 206713 |
| 3476 | ACX48481 | 17507 | 48011 | 78515, 109019, 139523, 170027, 200531 | 9659 | AGQ81939 | 23690 | 54194 | 84698, 115202, 145706, 176210, 206714 |
| 3477 | ACX55836 | 17508 | 48012 | 78516, 109020, 139524, 170028, 200532 | 9660 | AGQ81940 | 23691 | 54195 | 84699, 115203, 145707, 176211, 206715 |
| 3478 | ACX56269 | 17509 | 48013 | 78517, 109021, 139525, 170029, 200533 | 9661 | AGQ81941 | 23692 | 54196 | 84700, 115204, 145708, 176212, 206716 |
| 3479 | ACX56270 | 17510 | 48014 | 78518, 109022, 139526, 170030, 200534 | 9662 | AGQ81942 | 23693 | 54197 | 84701, 115205, 145709, 176213, 206717 |
| 3480 | ACX56271 | 17511 | 48015 | 78519, 109023, 139527, 170031, 200535 | 9663 | AGQ81943 | 23694 | 54198 | 84702, 115206, 145710, 176214, 206718 |
| 3481 | ACX83579 | 17512 | 48016 | 78520, 109024, 139528, 170032, 200536 | 9664 | AGQ81944 | 23695 | 54199 | 84703, 115207, 145711, 176215, 206719 |
| 3482 | ACX85425 | 17513 | 48017 | 78521, 109025, 139529, 170033, 200537 | 9665 | AGQ81947 | 23696 | 54200 | 84704, 115208, 145712, 176216, 206720 |
| 3483 | ACX85426 | 17514 | 48018 | 78522, 109026, 139530, 170034, 200538 | 9666 | AGQ81948 | 23697 | 54201 | 84705, 115209, 145713, 176217, 206721 |
| 3484 | ACY02998 | 17515 | 48019 | 78523, 109027, 139531, 170035, 200539 | 9667 | AGQ81951 | 23698 | 54202 | 84706, 115210, 145714, 176218, 206722 |
| 3485 | ACY03005 | 17516 | 48020 | 78524, 109028, 139532, 170036, 200540 | 9668 | AGQ81952 | 23699 | 54203 | 84707, 115211, 145715, 176219, 206723 |

FIG. 3 continued

| | | | | | | | | | |
|---|---|---|---|---|---|---|---|---|---|
| 3486 | ACY03008 | 17517 | 48021 | 78525, 109029, 139533, 170037, 200541 | 9669 | AGQ81954 | 23700 | 54204 | 84708, 115212, 145716, 176220, 206724 |
| 3487 | ACY03011 | 17518 | 48022 | 78526, 109030, 139534, 170038, 200542 | 9670 | AGQ81956 | 23701 | 54205 | 84709, 115213, 145717, 176221, 206725 |
| 3488 | ACY03012 | 17519 | 48023 | 78527, 109031, 139535, 170039, 200543 | 9671 | AGQ81957 | 23702 | 54206 | 84710, 115214, 145718, 176222, 206726 |
| 3489 | ACY03016 | 17520 | 48024 | 78528, 109032, 139536, 170040, 200544 | 9672 | AGQ81958 | 23703 | 54207 | 84711, 115215, 145719, 176223, 206727 |
| 3490 | ACY26194 | 17521 | 48025 | 78529, 109033, 139537, 170041, 200545 | 9673 | AGQ81959 | 23704 | 54208 | 84712, 115216, 145720, 176224, 206728 |
| 3491 | ACY26204 | 17522 | 48026 | 78530, 109034, 139538, 170042, 200546 | 9674 | AGQ81960 | 23705 | 54209 | 84713, 115217, 145721, 176225, 206729 |
| 3492 | ACY30123 | 17523 | 48027 | 78531, 109035, 139539, 170043, 200547 | 9675 | AGQ81961 | 23706 | 54210 | 84714, 115218, 145722, 176226, 206730 |
| 3493 | ACY30124 | 17524 | 48028 | 78532, 109036, 139540, 170044, 200548 | 9676 | AGQ81962 | 23707 | 54211 | 84715, 115219, 145723, 176227, 206731 |
| 3494 | ACY30125 | 17525 | 48029 | 78533, 109037, 139541, 170045, 200549 | 9677 | AGQ81963 | 23708 | 54212 | 84716, 115220, 145724, 176228, 206732 |
| 3495 | ACY30127 | 17526 | 48030 | 78534, 109038, 139542, 170046, 200550 | 9678 | AGQ81964 | 23709 | 54213 | 84717, 115221, 145725, 176229, 206733 |
| 3496 | ACY30128 | 17527 | 48031 | 78535, 109039, 139543, 170047, 200551 | 9679 | AGQ81966 | 23710 | 54214 | 84718, 115222, 145726, 176230, 206734 |
| 3497 | ACY46105 | 17528 | 48032 | 78536, 109040, 139544, 170048, 200552 | 9680 | AGQ81967 | 23711 | 54215 | 84719, 115223, 145727, 176231, 206735 |
| 3498 | ACY46165 | 17529 | 48033 | 78537, 109041, 139545, 170049, 200553 | 9681 | AGQ81968 | 23712 | 54216 | 84720, 115224, 145728, 176232, 206736 |
| 3499 | ACY46175 | 17530 | 48034 | 78538, 109042, 139546, 170050, 200554 | 9682 | AGQ81969 | 23713 | 54217 | 84721, 115225, 145729, 176233, 206737 |
| 3500 | ACY46345 | 17531 | 48035 | 78539, 109043, 139547, 170051, 200555 | 9683 | AGQ81970 | 23714 | 54218 | 84722, 115226, 145730, 176234, 206738 |
| 3501 | ACY46385 | 17532 | 48036 | 78540, 109044, 139548, 170052, 200556 | 9684 | AGQ81971 | 23715 | 54219 | 84723, 115227, 145731, 176235, 206739 |
| 3502 | ACY46485 | 17533 | 48037 | 78541, 109045, 139549, 170053, 200557 | 9685 | AGQ81972 | 23716 | 54220 | 84724, 115228, 145732, 176236, 206740 |
| 3503 | ACY77536 | 17534 | 48038 | 78542, 109046, 139550, 170054, 200558 | 9686 | AGQ81973 | 23717 | 54221 | 84725, 115229, 145733, 176237, 206741 |

FIG. 3 continued

| | | | | | | | | | |
|---|---|---|---|---|---|---|---|---|---|
| 3504 | ACY77546 | 17535 | 48039 | 78543, 109047, 139551, 170055, 200559 | 9687 | AGQ81974 | 23718 | 54222 | 84726, 115230, 145734, 176238, 206742 |
| 3505 | ACY77565 | 17536 | 48040 | 78544, 109048, 139552, 170056, 200560 | 9688 | AGQ81975 | 23719 | 54223 | 84727, 115231, 145735, 176239, 206743 |
| 3506 | ACY77575 | 17537 | 48041 | 78545, 109049, 139553, 170057, 200561 | 9689 | AGQ81977 | 23720 | 54224 | 84728, 115232, 145736, 176240, 206744 |
| 3507 | ACY77585 | 17538 | 48042 | 78546, 109050, 139554, 170058, 200562 | 9690 | AGQ81979 | 23721 | 54225 | 84729, 115233, 145737, 176241, 206745 |
| 3508 | ACY77595 | 17539 | 48043 | 78547, 109051, 139555, 170059, 200563 | 9691 | AGQ81980 | 23722 | 54226 | 84730, 115234, 145738, 176242, 206746 |
| 3509 | ACY77605 | 17540 | 48044 | 78548, 109052, 139556, 170060, 200564 | 9692 | AGQ88501 | 23723 | 54227 | 84731, 115235, 145739, 176243, 206747 |
| 3510 | ACY77625 | 17541 | 48045 | 78549, 109053, 139557, 170061, 200565 | 9693 | AGR33906 | 23724 | 54228 | 84732, 115236, 145740, 176244, 206748 |
| 3511 | ACY77655 | 17542 | 48046 | 78550, 109054, 139558, 170062, 200566 | 9694 | AGR33908 | 23725 | 54229 | 84733, 115237, 145741, 176245, 206749 |
| 3512 | ACY77665 | 17543 | 48047 | 78551, 109055, 139559, 170063, 200567 | 9695 | AGR33910 | 23726 | 54230 | 84734, 115238, 145742, 176246, 206750 |
| 3513 | ACY77675 | 17544 | 48048 | 78552, 109056, 139560, 170064, 200568 | 9696 | AGR33911 | 23727 | 54231 | 84735, 115239, 145743, 176247, 206751 |
| 3514 | ACY77685 | 17545 | 48049 | 78553, 109057, 139561, 170065, 200569 | 9697 | AGR33912 | 23728 | 54232 | 84736, 115240, 145744, 176248, 206752 |
| 3515 | ACY77695 | 17546 | 48050 | 78554, 109058, 139562, 170066, 200570 | 9698 | AGR33913 | 23729 | 54233 | 84737, 115241, 145745, 176249, 206753 |
| 3516 | ACY77705 | 17547 | 48051 | 78555, 109059, 139563, 170067, 200571 | 9699 | AGR33915 | 23730 | 54234 | 84738, 115242, 145746, 176250, 206754 |
| 3517 | ACY77725 | 17548 | 48052 | 78556, 109060, 139564, 170068, 200572 | 9700 | AGR33916 | 23731 | 54235 | 84739, 115243, 145747, 176251, 206755 |
| 3518 | ACY77735 | 17549 | 48053 | 78557, 109061, 139565, 170069, 200573 | 9701 | AGR33917 | 23732 | 54236 | 84740, 115244, 145748, 176252, 206756 |
| 3519 | ACY77745 | 17550 | 48054 | 78558, 109062, 139566, 170070, 200574 | 9702 | AGR33918 | 23733 | 54237 | 84741, 115245, 145749, 176253, 206757 |
| 3520 | ACY77755 | 17551 | 48055 | 78559, 109063, 139567, 170071, 200575 | 9703 | AGR33919 | 23734 | 54238 | 84742, 115246, 145750, 176254, 206758 |
| 3521 | ACY77775 | 17552 | 48056 | 78560, 109064, 139568, 170072, 200576 | 9704 | AGR45094 | 23735 | 54239 | 84743, 115247, 145751, 176255, 206759 |

FIG. 3 continued

| | | | | | | | | | |
|---|---|---|---|---|---|---|---|---|---|
| 3522 | ACY77785 | 17553 | 48057 | 78561, 109065, 139569, 170073, 200577 | 9705 | AGR49780 | 23736 | 54240 | 84744, 115248, 145752, 176256, 206760 |
| 3523 | ACY77795 | 17554 | 48058 | 78562, 109066, 139570, 170074, 200578 | 9706 | AGR49804 | 23737 | 54241 | 84745, 115249, 145753, 176257, 206761 |
| 3524 | ACY77825 | 17555 | 48059 | 78563, 109067, 139571, 170075, 200579 | 9707 | AGR49820 | 23738 | 54242 | 84746, 115250, 145754, 176258, 206762 |
| 3525 | ACY77835 | 17556 | 48060 | 78564, 109068, 139572, 170076, 200580 | 9708 | AGR49832 | 23739 | 54243 | 84747, 115251, 145755, 176259, 206763 |
| 3526 | ACY77845 | 17557 | 48061 | 78565, 109069, 139573, 170077, 200581 | 9709 | AGR49844 | 23740 | 54244 | 84748, 115252, 145756, 176260, 206764 |
| 3527 | ACY77865 | 17558 | 48062 | 78566, 109070, 139574, 170078, 200582 | 9710 | AGR49856 | 23741 | 54245 | 84749, 115253, 145757, 176261, 206765 |
| 3528 | ACY77870 | 17559 | 48063 | 78567, 109071, 139575, 170079, 200583 | 9711 | AGR49868 | 23742 | 54246 | 84750, 115254, 145758, 176262, 206766 |
| 3529 | ACY77877 | 17560 | 48064 | 78568, 109072, 139576, 170080, 200584 | 9712 | AGR49880 | 23743 | 54247 | 84751, 115255, 145759, 176263, 206767 |
| 3530 | ACY77887 | 17561 | 48065 | 78569, 109073, 139577, 170081, 200585 | 9713 | AGR49891 | 23744 | 54248 | 84752, 115256, 145760, 176264, 206768 |
| 3531 | ACY77907 | 17562 | 48066 | 78570, 109074, 139578, 170082, 200586 | 9714 | AGR49903 | 23745 | 54249 | 84753, 115257, 145761, 176265, 206769 |
| 3532 | ACY77917 | 17563 | 48067 | 78571, 109075, 139579, 170083, 200587 | 9715 | AGR49915 | 23746 | 54250 | 84754, 115258, 145762, 176266, 206770 |
| 3533 | ACY77927 | 17564 | 48068 | 78572, 109076, 139580, 170084, 200588 | 9716 | AGR49927 | 23747 | 54251 | 84755, 115259, 145763, 176267, 206771 |
| 3534 | ACY77937 | 17565 | 48069 | 78573, 109077, 139581, 170085, 200589 | 9717 | AGR49939 | 23748 | 54252 | 84756, 115260, 145764, 176268, 206772 |
| 3535 | ACY77947 | 17566 | 48070 | 78574, 109078, 139582, 170086, 200590 | 9718 | AGR49951 | 23749 | 54253 | 84757, 115261, 145765, 176269, 206773 |
| 3536 | ACY77967 | 17567 | 48071 | 78575, 109079, 139583, 170087, 200591 | 9719 | AGR49963 | 23750 | 54254 | 84758, 115262, 145766, 176270, 206774 |
| 3537 | ACY77977 | 17568 | 48072 | 78576, 109080, 139584, 170088, 200592 | 9720 | AGR49975 | 23751 | 54255 | 84759, 115263, 145767, 176271, 206775 |
| 3538 | ACY77987 | 17569 | 48073 | 78577, 109081, 139585, 170089, 200593 | 9721 | AGR49986 | 23752 | 54256 | 84760, 115264, 145768, 176272, 206776 |
| 3539 | ACY77997 | 17570 | 48074 | 78578, 109082, 139586, 170090, 200594 | 9722 | AGR49998 | 23753 | 54257 | 84761, 115265, 145769, 176273, 206777 |

FIG. 3 continued

| | | | | | | | | | |
|---|---|---|---|---|---|---|---|---|---|
| 3540 | ACY78017 | 17571 | 48075 | 78579, 109083, 139587, 170091, 200595 | 9723 | AGR50010 | 23754 | 54258 | 84762, 115266, 145770, 176274, 206778 |
| 3541 | ACZ01955 | 17572 | 48076 | 78580, 109084, 139588, 170092, 200596 | 9724 | AGR50021 | 23755 | 54259 | 84763, 115267, 145771, 176275, 206779 |
| 3542 | ACZ05053 | 17573 | 48077 | 78581, 109085, 139589, 170093, 200597 | 9725 | AGR50032 | 23756 | 54260 | 84764, 115268, 145772, 176276, 206780 |
| 3543 | ACZ05064 | 17574 | 48078 | 78582, 109086, 139590, 170094, 200598 | 9726 | AGR50043 | 23757 | 54261 | 84765, 115269, 145773, 176277, 206781 |
| 3544 | ACZ05074 | 17575 | 48079 | 78583, 109087, 139591, 170095, 200599 | 9727 | AGR50055 | 23758 | 54262 | 84766, 115270, 145774, 176278, 206782 |
| 3545 | ACZ05084 | 17576 | 48080 | 78584, 109088, 139592, 170096, 200600 | 9728 | AGR50066 | 23759 | 54263 | 84767, 115271, 145775, 176279, 206783 |
| 3546 | ACZ05094 | 17577 | 48081 | 78585, 109089, 139593, 170097, 200601 | 9729 | AGR50077 | 23760 | 54264 | 84768, 115272, 145776, 176280, 206784 |
| 3547 | ACZ05104 | 17578 | 48082 | 78586, 109090, 139594, 170098, 200602 | 9730 | AGR50088 | 23761 | 54265 | 84769, 115273, 145777, 176281, 206785 |
| 3548 | ACZ05114 | 17579 | 48083 | 78587, 109091, 139595, 170099, 200603 | 9731 | AGR50099 | 23762 | 54266 | 84770, 115274, 145778, 176282, 206786 |
| 3549 | ACZ05124 | 17580 | 48084 | 78588, 109092, 139596, 170100, 200604 | 9732 | AGR50110 | 23763 | 54267 | 84771, 115275, 145779, 176283, 206787 |
| 3550 | ACZ05144 | 17581 | 48085 | 78589, 109093, 139597, 170101, 200605 | 9733 | AGR50121 | 23764 | 54268 | 84772, 115276, 145780, 176284, 206788 |
| 3551 | ACZ05154 | 17582 | 48086 | 78590, 109094, 139598, 170102, 200606 | 9734 | AGR50132 | 23765 | 54269 | 84773, 115277, 145781, 176285, 206789 |
| 3552 | ACZ05164 | 17583 | 48087 | 78591, 109095, 139599, 170103, 200607 | 9735 | AGR50143 | 23766 | 54270 | 84774, 115278, 145782, 176286, 206790 |
| 3553 | ACZ05175 | 17584 | 48088 | 78592, 109096, 139600, 170104, 200608 | 9736 | AGR50154 | 23767 | 54271 | 84775, 115279, 145783, 176287, 206791 |
| 3554 | ACZ05197 | 17585 | 48089 | 78593, 109097, 139601, 170105, 200609 | 9737 | AGR50165 | 23768 | 54272 | 84776, 115280, 145784, 176288, 206792 |
| 3555 | ACZ05208 | 17586 | 48090 | 78594, 109098, 139602, 170106, 200610 | 9738 | AGR50177 | 23769 | 54273 | 84777, 115281, 145785, 176289, 206793 |
| 3556 | ACZ05219 | 17587 | 48091 | 78595, 109099, 139603, 170107, 200611 | 9739 | AGR50188 | 23770 | 54274 | 84778, 115282, 145786, 176290, 206794 |
| 3557 | ACZ05230 | 17588 | 48092 | 78596, 109100, 139604, 170108, 200612 | 9740 | AGR50199 | 23771 | 54275 | 84779, 115283, 145787, 176291, 206795 |

FIG. 3 continued

| | | | | | | | | | |
|---|---|---|---|---|---|---|---|---|---|
| 3558 | ACZ05241 | 17589 | 48093 | 78597, 109101, 139605, 170109, 200613 | 9741 | AGR50210 | 23772 | 54276 | 84780, 115284, 145788, 176292, 206796 |
| 3559 | ACZ05296 | 17590 | 48094 | 78598, 109102, 139606, 170110, 200614 | 9742 | AGR50221 | 23773 | 54277 | 84781, 115285, 145789, 176293, 206797 |
| 3560 | ACZ05307 | 17591 | 48095 | 78599, 109103, 139607, 170111, 200615 | 9743 | AGR50232 | 23774 | 54278 | 84782, 115286, 145790, 176294, 206798 |
| 3561 | ACZ05318 | 17592 | 48096 | 78600, 109104, 139608, 170112, 200616 | 9744 | AGR50243 | 23775 | 54279 | 84783, 115287, 145791, 176295, 206799 |
| 3562 | ACZ05329 | 17593 | 48097 | 78601, 109105, 139609, 170113, 200617 | 9745 | AGR50254 | 23776 | 54280 | 84784, 115288, 145792, 176296, 206800 |
| 3563 | ACZ05340 | 17594 | 48098 | 78602, 109106, 139610, 170114, 200618 | 9746 | AGR50265 | 23777 | 54281 | 84785, 115289, 145793, 176297, 206801 |
| 3564 | ACZ05362 | 17595 | 48099 | 78603, 109107, 139611, 170115, 200619 | 9747 | AGR50276 | 23778 | 54282 | 84786, 115290, 145794, 176298, 206802 |
| 3565 | ACZ05373 | 17596 | 48100 | 78604, 109108, 139612, 170116, 200620 | 9748 | AGR50287 | 23779 | 54283 | 84787, 115291, 145795, 176299, 206803 |
| 3566 | ACZ05395 | 17597 | 48101 | 78605, 109109, 139613, 170117, 200621 | 9749 | AGR50298 | 23780 | 54284 | 84788, 115292, 145796, 176300, 206804 |
| 3567 | ACZ05406 | 17598 | 48102 | 78606, 109110, 139614, 170118, 200622 | 9750 | AGR50309 | 23781 | 54285 | 84789, 115293, 145797, 176301, 206805 |
| 3568 | ACZ05450 | 17599 | 48103 | 78607, 109111, 139615, 170119, 200623 | 9751 | AGR50320 | 23782 | 54286 | 84790, 115294, 145798, 176302, 206806 |
| 3569 | ACZ05461 | 17600 | 48104 | 78608, 109112, 139616, 170120, 200624 | 9752 | AGR50331 | 23783 | 54287 | 84791, 115295, 145799, 176303, 206807 |
| 3570 | ACZ05472 | 17601 | 48105 | 78609, 109113, 139617, 170121, 200625 | 9753 | AGR50342 | 23784 | 54288 | 84792, 115296, 145800, 176304, 206808 |
| 3571 | ACZ05483 | 17602 | 48106 | 78610, 109114, 139618, 170122, 200626 | 9754 | AGR50353 | 23785 | 54289 | 84793, 115297, 145801, 176305, 206809 |
| 3572 | ACZ05494 | 17603 | 48107 | 78611, 109115, 139619, 170123, 200627 | 9755 | AGR50364 | 23786 | 54290 | 84794, 115298, 145802, 176306, 206810 |
| 3573 | ACZ05516 | 17604 | 48108 | 78612, 109116, 139620, 170124, 200628 | 9756 | AGR55170 | 23787 | 54291 | 84795, 115299, 145803, 176307, 206811 |
| 3574 | ACZ05527 | 17605 | 48109 | 78613, 109117, 139621, 170125, 200629 | 9757 | AGR55180 | 23788 | 54292 | 84796, 115300, 145804, 176308, 206812 |
| 3575 | ACZ05538 | 17606 | 48110 | 78614, 109118, 139622, 170126, 200630 | 9758 | AGR55181 | 23789 | 54293 | 84797, 115301, 145805, 176309, 206813 |

FIG. 3 continued

| | | | | | | | | | |
|---|---|---|---|---|---|---|---|---|---|
| 3576 | ACZ05593 | 17607 | 48111 | 78615, 109119, 139623, 170127, 200631 | 9759 | AGR55183 | 23790 | 54294 | 84798, 115302, 145806, 176310, 206814 |
| 3577 | ACZ05604 | 17608 | 48112 | 78616, 109120, 139624, 170128, 200632 | 9760 | AGR55184 | 23791 | 54295 | 84799, 115303, 145807, 176311, 206815 |
| 3578 | ACZ05953 | 17609 | 48113 | 78617, 109121, 139625, 170129, 200633 | 9761 | AGR55185 | 23792 | 54296 | 84800, 115304, 145808, 176312, 206816 |
| 3579 | ACZ05964 | 17610 | 48114 | 78618, 109122, 139626, 170130, 200634 | 9762 | AGR55186 | 23793 | 54297 | 84801, 115305, 145809, 176313, 206817 |
| 3580 | ACZ05997 | 17611 | 48115 | 78619, 109123, 139627, 170131, 200635 | 9763 | AGR55187 | 23794 | 54298 | 84802, 115306, 145810, 176314, 206818 |
| 3581 | ACZ06008 | 17612 | 48116 | 78620, 109124, 139628, 170132, 200636 | 9764 | AGR55192 | 23795 | 54299 | 84803, 115307, 145811, 176315, 206819 |
| 3582 | ACZ06019 | 17613 | 48117 | 78621, 109125, 139629, 170133, 200637 | 9765 | AGR55195 | 23796 | 54300 | 84804, 115308, 145812, 176316, 206820 |
| 3583 | ACZ16015 | 17614 | 48118 | 78622, 109126, 139630, 170134, 200638 | 9766 | AGR55204 | 23797 | 54301 | 84805, 115309, 145813, 176317, 206821 |
| 3584 | ACZ16025 | 17615 | 48119 | 78623, 109127, 139631, 170135, 200639 | 9767 | AGR55218 | 23798 | 54302 | 84806, 115310, 145814, 176318, 206822 |
| 3585 | ACZ16035 | 17616 | 48120 | 78624, 109128, 139632, 170136, 200640 | 9768 | AGT18726 | 23799 | 54303 | 84807, 115311, 145815, 176319, 206823 |
| 3586 | ACZ16043 | 17617 | 48121 | 78625, 109129, 139633, 170137, 200641 | 9769 | AGT18727 | 23800 | 54304 | 84808, 115312, 145816, 176320, 206824 |
| 3587 | ACZ16053 | 17618 | 48122 | 78626, 109130, 139634, 170138, 200642 | 9770 | AGT18728 | 23801 | 54305 | 84809, 115313, 145817, 176321, 206825 |
| 3588 | ACZ16073 | 17619 | 48123 | 78627, 109131, 139635, 170139, 200643 | 9771 | AGT18729 | 23802 | 54306 | 84810, 115314, 145818, 176322, 206826 |
| 3589 | ACZ16083 | 17620 | 48124 | 78628, 109132, 139636, 170140, 200644 | 9772 | AGT18730 | 23803 | 54307 | 84811, 115315, 145819, 176323, 206827 |
| 3590 | ACZ16093 | 17621 | 48125 | 78629, 109133, 139637, 170141, 200645 | 9773 | AGT18731 | 23804 | 54308 | 84812, 115316, 145820, 176324, 206828 |
| 3591 | ACZ16103 | 17622 | 48126 | 78630, 109134, 139638, 170142, 200646 | 9774 | AGT18732 | 23805 | 54309 | 84813, 115317, 145821, 176325, 206829 |
| 3592 | ACZ16113 | 17623 | 48127 | 78631, 109135, 139639, 170143, 200647 | 9775 | AGT18733 | 23806 | 54310 | 84814, 115318, 145822, 176326, 206830 |
| 3593 | ACZ16123 | 17624 | 48128 | 78632, 109136, 139640, 170144, 200648 | 9776 | AGT18762 | 23807 | 54311 | 84815, 115319, 145823, 176327, 206831 |

FIG. 3 continued

| | | | | | | | | | |
|---|---|---|---|---|---|---|---|---|---|
| 3594 | ACZ16133 | 17625 | 48129 | 78633, 109137, 139641, 170145, 200649 | 9777 | AGT18764 | 23808 | 54312 | 84816, 115320, 145824, 176328, 206832 |
| 3595 | ACZ16143 | 17626 | 48130 | 78634, 109138, 139642, 170146, 200650 | 9778 | AGT18765 | 23809 | 54313 | 84817, 115321, 145825, 176329, 206833 |
| 3596 | ACZ16153 | 17627 | 48131 | 78635, 109139, 139643, 170147, 200651 | 9779 | AGT18766 | 23810 | 54314 | 84818, 115322, 145826, 176330, 206834 |
| 3597 | ACZ16163 | 17628 | 48132 | 78636, 109140, 139644, 170148, 200652 | 9780 | AGT18767 | 23811 | 54315 | 84819, 115323, 145827, 176331, 206835 |
| 3598 | ACZ16173 | 17629 | 48133 | 78637, 109141, 139645, 170149, 200653 | 9781 | AGT18768 | 23812 | 54316 | 84820, 115324, 145828, 176332, 206836 |
| 3599 | ACZ16193 | 17630 | 48134 | 78638, 109142, 139646, 170150, 200654 | 9782 | AGT18769 | 23813 | 54317 | 84821, 115325, 145829, 176333, 206837 |
| 3600 | ACZ16203 | 17631 | 48135 | 78639, 109143, 139647, 170151, 200655 | 9783 | AGT18770 | 23814 | 54318 | 84822, 115326, 145830, 176334, 206838 |
| 3601 | ACZ16213 | 17632 | 48136 | 78640, 109144, 139648, 170152, 200656 | 9784 | AGT18771 | 23815 | 54319 | 84823, 115327, 145831, 176335, 206839 |
| 3602 | ACZ16223 | 17633 | 48137 | 78641, 109145, 139649, 170153, 200657 | 9785 | AGT18772 | 23816 | 54320 | 84824, 115328, 145832, 176336, 206840 |
| 3603 | ACZ16233 | 17634 | 48138 | 78642, 109146, 139650, 170154, 200658 | 9786 | AGT37104 | 23817 | 54321 | 84825, 115329, 145833, 176337, 206841 |
| 3604 | ACZ16243 | 17635 | 48139 | 78643, 109147, 139651, 170155, 200659 | 9787 | AGU69973 | 23818 | 54322 | 84826, 115330, 145834, 176338, 206842 |
| 3605 | ACZ16253 | 17636 | 48140 | 78644, 109148, 139652, 170156, 200660 | 9788 | AGU92648 | 23819 | 54323 | 84827, 115331, 145835, 176339, 206843 |
| 3606 | ACZ16263 | 17637 | 48141 | 78645, 109149, 139653, 170157, 200661 | 9789 | AGU92670 | 23820 | 54324 | 84828, 115332, 145836, 176340, 206844 |
| 3607 | ACZ16283 | 17638 | 48142 | 78646, 109150, 139654, 170158, 200662 | 9790 | AGU92681 | 23821 | 54325 | 84829, 115333, 145837, 176341, 206845 |
| 3608 | ACZ16293 | 17639 | 48143 | 78647, 109151, 139655, 170159, 200663 | 9791 | AGU92692 | 23822 | 54326 | 84830, 115334, 145838, 176342, 206846 |
| 3609 | ACZ16303 | 17640 | 48144 | 78648, 109152, 139656, 170160, 200664 | 9792 | AGU92703 | 23823 | 54327 | 84831, 115335, 145839, 176343, 206847 |
| 3610 | ACZ16313 | 17641 | 48145 | 78649, 109153, 139657, 170161, 200665 | 9793 | AGU92714 | 23824 | 54328 | 84832, 115336, 145840, 176344, 206848 |
| 3611 | ACZ16323 | 17642 | 48146 | 78650, 109154, 139658, 170162, 200666 | 9794 | AGU92725 | 23825 | 54329 | 84833, 115337, 145841, 176345, 206849 |

FIG. 3 continued

| | | | | | | | | | |
|---|---|---|---|---|---|---|---|---|---|
| 3612 | ACZ16333 | 17643 | 48147 | 78651, 109155, 139659, 170163, 200667 | 9795 | AGU92736 | 23826 | 54330 | 84834, 115338, 145842, 176346, 206850 |
| 3613 | ACZ16343 | 17644 | 48148 | 78652, 109156, 139660, 170164, 200668 | 9796 | AGU92747 | 23827 | 54331 | 84835, 115339, 145843, 176347, 206851 |
| 3614 | ACZ16353 | 17645 | 48149 | 78653, 109157, 139661, 170165, 200669 | 9797 | AGU92758 | 23828 | 54332 | 84836, 115340, 145844, 176348, 206852 |
| 3615 | ACZ16363 | 17646 | 48150 | 78654, 109158, 139662, 170166, 200670 | 9798 | AGU92769 | 23829 | 54333 | 84837, 115341, 145845, 176349, 206853 |
| 3616 | ACZ16373 | 17647 | 48151 | 78655, 109159, 139663, 170167, 200671 | 9799 | AGU92780 | 23830 | 54334 | 84838, 115342, 145846, 176350, 206854 |
| 3617 | ACZ16383 | 17648 | 48152 | 78656, 109160, 139664, 170168, 200672 | 9800 | AGU92791 | 23831 | 54335 | 84839, 115343, 145847, 176351, 206855 |
| 3618 | ACZ16393 | 17649 | 48153 | 78657, 109161, 139665, 170169, 200673 | 9801 | AGU92802 | 23832 | 54336 | 84840, 115344, 145848, 176352, 206856 |
| 3619 | ACZ16403 | 17650 | 48154 | 78658, 109162, 139666, 170170, 200674 | 9802 | AGU92813 | 23833 | 54337 | 84841, 115345, 145849, 176353, 206857 |
| 3620 | ACZ16423 | 17651 | 48155 | 78659, 109163, 139667, 170171, 200675 | 9803 | AGU92824 | 23834 | 54338 | 84842, 115346, 145850, 176354, 206858 |
| 3621 | ACZ16433 | 17652 | 48156 | 78660, 109164, 139668, 170172, 200676 | 9804 | AGU92846 | 23835 | 54339 | 84843, 115347, 145851, 176355, 206859 |
| 3622 | ACZ16443 | 17653 | 48157 | 78661, 109165, 139669, 170173, 200677 | 9805 | AGU92868 | 23836 | 54340 | 84844, 115348, 145852, 176356, 206860 |
| 3623 | ACZ16453 | 17654 | 48158 | 78662, 109166, 139670, 170174, 200678 | 9806 | AGU92890 | 23837 | 54341 | 84845, 115349, 145853, 176357, 206861 |
| 3624 | ACZ16463 | 17655 | 48159 | 78663, 109167, 139671, 170175, 200679 | 9807 | AGU92901 | 23838 | 54342 | 84846, 115350, 145854, 176358, 206862 |
| 3625 | ACZ16483 | 17656 | 48160 | 78664, 109168, 139672, 170176, 200680 | 9808 | AGU92912 | 23839 | 54343 | 84847, 115351, 145855, 176359, 206863 |
| 3626 | ACZ16493 | 17657 | 48161 | 78665, 109169, 139673, 170177, 200681 | 9809 | AGU92923 | 23840 | 54344 | 84848, 115352, 145856, 176360, 206864 |
| 3627 | ACZ16503 | 17658 | 48162 | 78666, 109170, 139674, 170178, 200682 | 9810 | AGU92934 | 23841 | 54345 | 84849, 115353, 145857, 176361, 206865 |
| 3628 | ACZ16513 | 17659 | 48163 | 78667, 109171, 139675, 170179, 200683 | 9811 | AGU92945 | 23842 | 54346 | 84850, 115354, 145858, 176362, 206866 |
| 3629 | ACZ16523 | 17660 | 48164 | 78668, 109172, 139676, 170180, 200684 | 9812 | AGU92956 | 23843 | 54347 | 84851, 115355, 145859, 176363, 206867 |

FIG. 3 continued

| | | | | | | | | | |
|---|---|---|---|---|---|---|---|---|---|
| 3630 | ACZ16533 | 17661 | 48165 | 78669, 109173, 139677, 170181, 200685 | 9813 | AGU92967 | 23844 | 54348 | 84852, 115356, 145860, 176364, 206868 |
| 3631 | ACZ16543 | 17662 | 48166 | 78670, 109174, 139678, 170182, 200686 | 9814 | AGU92978 | 23845 | 54349 | 84853, 115357, 145861, 176365, 206869 |
| 3632 | ACZ16553 | 17663 | 48167 | 78671, 109175, 139679, 170183, 200687 | 9815 | AGU92989 | 23846 | 54350 | 84854, 115358, 145862, 176366, 206870 |
| 3633 | ACZ16586 | 17664 | 48168 | 78672, 109176, 139680, 170184, 200688 | 9816 | AGU93000 | 23847 | 54351 | 84855, 115359, 145863, 176367, 206871 |
| 3634 | ACZ16596 | 17665 | 48169 | 78673, 109177, 139681, 170185, 200689 | 9817 | AGU93011 | 23848 | 54352 | 84856, 115360, 145864, 176368, 206872 |
| 3635 | ACZ16606 | 17666 | 48170 | 78674, 109178, 139682, 170186, 200690 | 9818 | AGU93022 | 23849 | 54353 | 84857, 115361, 145865, 176369, 206873 |
| 3636 | ACZ16633 | 17667 | 48171 | 78675, 109179, 139683, 170187, 200691 | 9819 | AGU93034 | 23850 | 54354 | 84858, 115362, 145866, 176370, 206874 |
| 3637 | ACZ16643 | 17668 | 48172 | 78676, 109180, 139684, 170188, 200692 | 9820 | AGU93045 | 23851 | 54355 | 84859, 115363, 145867, 176371, 206875 |
| 3638 | ACZ16653 | 17669 | 48173 | 78677, 109181, 139685, 170189, 200693 | 9821 | AGU93056 | 23852 | 54356 | 84860, 115364, 145868, 176372, 206876 |
| 3639 | ACZ16663 | 17670 | 48174 | 78678, 109182, 139686, 170190, 200694 | 9822 | AGV98980 | 23853 | 54357 | 84861, 115365, 145869, 176373, 206877 |
| 3640 | ACZ16673 | 17671 | 48175 | 78679, 109183, 139687, 170191, 200695 | 9823 | AGV98993 | 23854 | 54358 | 84862, 115366, 145870, 176374, 206878 |
| 3641 | ACZ16683 | 17672 | 48176 | 78680, 109184, 139688, 170192, 200696 | 9824 | AGV99005 | 23855 | 54359 | 84863, 115367, 145871, 176375, 206879 |
| 3642 | ACZ16693 | 17673 | 48177 | 78681, 109185, 139689, 170193, 200697 | 9825 | AGV99017 | 23856 | 54360 | 84864, 115368, 145872, 176376, 206880 |
| 3643 | ACZ16703 | 17674 | 48178 | 78682, 109186, 139690, 170194, 200698 | 9826 | AGV99040 | 23857 | 54361 | 84865, 115369, 145873, 176377, 206881 |
| 3644 | ACZ16713 | 17675 | 48179 | 78683, 109187, 139691, 170195, 200699 | 9827 | AGV99052 | 23858 | 54362 | 84866, 115370, 145874, 176378, 206882 |
| 3645 | ACZ16723 | 17676 | 48180 | 78684, 109188, 139692, 170196, 200700 | 9828 | AGV99100 | 23859 | 54363 | 84867, 115371, 145875, 176379, 206883 |
| 3646 | ACZ16733 | 17677 | 48181 | 78685, 109189, 139693, 170197, 200701 | 9829 | AGV99112 | 23860 | 54364 | 84868, 115372, 145876, 176380, 206884 |
| 3647 | ACZ16743 | 17678 | 48182 | 78686, 109190, 139694, 170198, 200702 | 9830 | AGV99124 | 23861 | 54365 | 84869, 115373, 145877, 176381, 206885 |

FIG. 3 continued

| | | | | | | | | | |
|---|---|---|---|---|---|---|---|---|---|
| 3648 | ACZ16753 | 17679 | 48183 | 78687, 109191, 139695, 170199, 200703 | 9831 | AGV99136 | 23862 | 54366 | 84870, 115374, 145878, 176382, 206886 |
| 3649 | ACZ16763 | 17680 | 48184 | 78688, 109192, 139696, 170200, 200704 | 9832 | AGV99148 | 23863 | 54367 | 84871, 115375, 145879, 176383, 206887 |
| 3650 | ACZ16773 | 17681 | 48185 | 78689, 109193, 139697, 170201, 200705 | 9833 | AGV99160 | 23864 | 54368 | 84872, 115376, 145880, 176384, 206888 |
| 3651 | ACZ16783 | 17682 | 48186 | 78690, 109194, 139698, 170202, 200706 | 9834 | AGV99172 | 23865 | 54369 | 84873, 115377, 145881, 176385, 206889 |
| 3652 | ACZ16793 | 17683 | 48187 | 78691, 109195, 139699, 170203, 200707 | 9835 | AGV99196 | 23866 | 54370 | 84874, 115378, 145882, 176386, 206890 |
| 3653 | ACZ16803 | 17684 | 48188 | 78692, 109196, 139700, 170204, 200708 | 9836 | AGV99208 | 23867 | 54371 | 84875, 115379, 145883, 176387, 206891 |
| 3654 | ACZ16813 | 17685 | 48189 | 78693, 109197, 139701, 170205, 200709 | 9837 | AGV99959 | 23868 | 54372 | 84876, 115380, 145884, 176388, 206892 |
| 3655 | ACZ16823 | 17686 | 48190 | 78694, 109198, 139702, 170206, 200710 | 9838 | AGW00005 | 23869 | 54373 | 84877, 115381, 145885, 176389, 206893 |
| 3656 | ACZ16833 | 17687 | 48191 | 78695, 109199, 139703, 170207, 200711 | 9839 | AGW00068 | 23870 | 54374 | 84878, 115382, 145886, 176390, 206894 |
| 3657 | ACZ16843 | 17688 | 48192 | 78696, 109200, 139704, 170208, 200712 | 9840 | AGW00080 | 23871 | 54375 | 84879, 115383, 145887, 176391, 206895 |
| 3658 | ACZ16853 | 17689 | 48193 | 78697, 109201, 139705, 170209, 200713 | 9841 | AGW00104 | 23872 | 54376 | 84880, 115384, 145888, 176392, 206896 |
| 3659 | ACZ16863 | 17690 | 48194 | 78698, 109202, 139706, 170210, 200714 | 9842 | AGW00116 | 23873 | 54377 | 84881, 115385, 145889, 176393, 206897 |
| 3660 | ACZ16873 | 17691 | 48195 | 78699, 109203, 139707, 170211, 200715 | 9843 | AGW00128 | 23874 | 54378 | 84882, 115386, 145890, 176394, 206898 |
| 3661 | ACZ16883 | 17692 | 48196 | 78700, 109204, 139708, 170212, 200716 | 9844 | AGW00140 | 23875 | 54379 | 84883, 115387, 145891, 176395, 206899 |
| 3662 | ACZ16893 | 17693 | 48197 | 78701, 109205, 139709, 170213, 200717 | 9845 | AGW00152 | 23876 | 54380 | 84884, 115388, 145892, 176396, 206900 |
| 3663 | ACZ16903 | 17694 | 48198 | 78702, 109206, 139710, 170214, 200718 | 9846 | AGW00164 | 23877 | 54381 | 84885, 115389, 145893, 176397, 206901 |
| 3664 | ACZ16913 | 17695 | 48199 | 78703, 109207, 139711, 170215, 200719 | 9847 | AGW00176 | 23878 | 54382 | 84886, 115390, 145894, 176398, 206902 |
| 3665 | ACZ16923 | 17696 | 48200 | 78704, 109208, 139712, 170216, 200720 | 9848 | AGW00188 | 23879 | 54383 | 84887, 115391, 145895, 176399, 206903 |

FIG. 3 continued

| | | | | | | | | | |
|---|---|---|---|---|---|---|---|---|---|
| 3666 | ACZ16933 | 17697 | 48201 | 78705, 109209, 139713, 170217, 200721 | 9849 | AGW00712 | 23880 | 54384 | 84888, 115392, 145896, 176400, 206904 |
| 3667 | ACZ16943 | 17698 | 48202 | 78706, 109210, 139714, 170218, 200722 | 9850 | AGW00724 | 23881 | 54385 | 84889, 115393, 145897, 176401, 206905 |
| 3668 | ACZ16953 | 17699 | 48203 | 78707, 109211, 139715, 170219, 200723 | 9851 | AGW00736 | 23882 | 54386 | 84890, 115394, 145898, 176402, 206906 |
| 3669 | ACZ16963 | 17700 | 48204 | 78708, 109212, 139716, 170220, 200724 | 9852 | AGW00748 | 23883 | 54387 | 84891, 115395, 145899, 176403, 206907 |
| 3670 | ACZ16973 | 17701 | 48205 | 78709, 109213, 139717, 170221, 200725 | 9853 | AGW00760 | 23884 | 54388 | 84892, 115396, 145900, 176404, 206908 |
| 3671 | ACZ16983 | 17702 | 48206 | 78710, 109214, 139718, 170222, 200726 | 9854 | AGW00784 | 23885 | 54389 | 84893, 115397, 145901, 176405, 206909 |
| 3672 | ACZ16993 | 17703 | 48207 | 78711, 109215, 139719, 170223, 200727 | 9855 | AGW00796 | 23886 | 54390 | 84894, 115398, 145902, 176406, 206910 |
| 3673 | ACZ17003 | 17704 | 48208 | 78712, 109216, 139720, 170224, 200728 | 9856 | AGW00808 | 23887 | 54391 | 84895, 115399, 145903, 176407, 206911 |
| 3674 | ACZ17023 | 17705 | 48209 | 78713, 109217, 139721, 170225, 200729 | 9857 | AGW00820 | 23888 | 54392 | 84896, 115400, 145904, 176408, 206912 |
| 3675 | ACZ17043 | 17706 | 48210 | 78714, 109218, 139722, 170226, 200730 | 9858 | AGW00832 | 23889 | 54393 | 84897, 115401, 145905, 176409, 206913 |
| 3676 | ACZ17053 | 17707 | 48211 | 78715, 109219, 139723, 170227, 200731 | 9859 | AGW00844 | 23890 | 54394 | 84898, 115402, 145906, 176410, 206914 |
| 3677 | ACZ17063 | 17708 | 48212 | 78716, 109220, 139724, 170228, 200732 | 9860 | AGW00868 | 23891 | 54395 | 84899, 115403, 145907, 176411, 206915 |
| 3678 | ACZ17073 | 17709 | 48213 | 78717, 109221, 139725, 170229, 200733 | 9861 | AGW00880 | 23892 | 54396 | 84900, 115404, 145908, 176412, 206916 |
| 3679 | ACZ17083 | 17710 | 48214 | 78718, 109222, 139726, 170230, 200734 | 9862 | AGW00892 | 23893 | 54397 | 84901, 115405, 145909, 176413, 206917 |
| 3680 | ACZ17093 | 17711 | 48215 | 78719, 109223, 139727, 170231, 200735 | 9863 | AGW00904 | 23894 | 54398 | 84902, 115406, 145910, 176414, 206918 |
| 3681 | ACZ17113 | 17712 | 48216 | 78720, 109224, 139728, 170232, 200736 | 9864 | AGW00916 | 23895 | 54399 | 84903, 115407, 145911, 176415, 206919 |
| 3682 | ACZ17123 | 17713 | 48217 | 78721, 109225, 139729, 170233, 200737 | 9865 | AGW00934 | 23896 | 54400 | 84904, 115408, 145912, 176416, 206920 |
| 3683 | ACZ17133 | 17714 | 48218 | 78722, 109226, 139730, 170234, 200738 | 9866 | AGW01247 | 23897 | 54401 | 84905, 115409, 145913, 176417, 206921 |

FIG. 3 continued

| | | | | | | | | | |
|---|---|---|---|---|---|---|---|---|---|
| 3684 | ACZ17163 | 17715 | 48219 | 78723, 109227, 139731, 170235, 200739 | 9867 | AGW01259 | 23898 | 54402 | 84906, 115410, 145914, 176418, 206922 |
| 3685 | ACZ17173 | 17716 | 48220 | 78724, 109228, 139732, 170236, 200740 | 9868 | AGW01298 | 23899 | 54403 | 84907, 115411, 145915, 176419, 206923 |
| 3686 | ACZ17183 | 17717 | 48221 | 78725, 109229, 139733, 170237, 200741 | 9869 | AGW01322 | 23900 | 54404 | 84908, 115412, 145916, 176420, 206924 |
| 3687 | ACZ17193 | 17718 | 48222 | 78726, 109230, 139734, 170238, 200742 | 9870 | AGW01334 | 23901 | 54405 | 84909, 115413, 145917, 176421, 206925 |
| 3688 | ACZ17203 | 17719 | 48223 | 78727, 109231, 139735, 170239, 200743 | 9871 | AGW01346 | 23902 | 54406 | 84910, 115414, 145918, 176422, 206926 |
| 3689 | ACZ17213 | 17720 | 48224 | 78728, 109232, 139736, 170240, 200744 | 9872 | AGW01358 | 23903 | 54407 | 84911, 115415, 145919, 176423, 206927 |
| 3690 | ACZ17223 | 17721 | 48225 | 78729, 109233, 139737, 170241, 200745 | 9873 | AGW01370 | 23904 | 54408 | 84912, 115416, 145920, 176424, 206928 |
| 3691 | ACZ17233 | 17722 | 48226 | 78730, 109234, 139738, 170242, 200746 | 9874 | AGW01382 | 23905 | 54409 | 84913, 115417, 145921, 176425, 206929 |
| 3692 | ACZ17243 | 17723 | 48227 | 78731, 109235, 139739, 170243, 200747 | 9875 | AGW01394 | 23906 | 54410 | 84914, 115418, 145922, 176426, 206930 |
| 3693 | ACZ17263 | 17724 | 48228 | 78732, 109236, 139740, 170244, 200748 | 9876 | AGW01406 | 23907 | 54411 | 84915, 115419, 145923, 176427, 206931 |
| 3694 | ACZ17273 | 17725 | 48229 | 78733, 109237, 139741, 170245, 200749 | 9877 | AGW01418 | 23908 | 54412 | 84916, 115420, 145924, 176428, 206932 |
| 3695 | ACZ17283 | 17726 | 48230 | 78734, 109238, 139742, 170246, 200750 | 9878 | AGW01430 | 23909 | 54413 | 84917, 115421, 145925, 176429, 206933 |
| 3696 | ACZ17293 | 17727 | 48231 | 78735, 109239, 139743, 170247, 200751 | 9879 | AGW01442 | 23910 | 54414 | 84918, 115422, 145926, 176430, 206934 |
| 3697 | ACZ17303 | 17728 | 48232 | 78736, 109240, 139744, 170248, 200752 | 9880 | AGW01454 | 23911 | 54415 | 84919, 115423, 145927, 176431, 206935 |
| 3698 | ACZ17313 | 17729 | 48233 | 78737, 109241, 139745, 170249, 200753 | 9881 | AGW01466 | 23912 | 54416 | 84920, 115424, 145928, 176432, 206936 |
| 3699 | ACZ17401 | 17730 | 48234 | 78738, 109242, 139746, 170250, 200754 | 9882 | AGW01478 | 23913 | 54417 | 84921, 115425, 145929, 176433, 206937 |
| 3700 | ACZ17411 | 17731 | 48235 | 78739, 109243, 139747, 170251, 200755 | 9883 | AGW01490 | 23914 | 54418 | 84922, 115426, 145930, 176434, 206938 |
| 3701 | ACZ17421 | 17732 | 48236 | 78740, 109244, 139748, 170252, 200756 | 9884 | AGW01538 | 23915 | 54419 | 84923, 115427, 145931, 176435, 206939 |

FIG. 3 continued

| | | | | | | | | | |
|---|---|---|---|---|---|---|---|---|---|
| 3702 | ACZ17431 | 17733 | 48237 | 78741, 109245, 139749, 170253, 200757 | 9885 | AGW01562 | 23916 | 54420 | 84924, 115428, 145932, 176436, 206940 |
| 3703 | ACZ17441 | 17734 | 48238 | 78742, 109246, 139750, 170254, 200758 | 9886 | AGW01574 | 23917 | 54421 | 84925, 115429, 145933, 176437, 206941 |
| 3704 | ACZ17451 | 17735 | 48239 | 78743, 109247, 139751, 170255, 200759 | 9887 | AGW01586 | 23918 | 54422 | 84926, 115430, 145934, 176438, 206942 |
| 3705 | ACZ17461 | 17736 | 48240 | 78744, 109248, 139752, 170256, 200760 | 9888 | AGW01598 | 23919 | 54423 | 84927, 115431, 145935, 176439, 206943 |
| 3706 | ACZ17471 | 17737 | 48241 | 78745, 109249, 139753, 170257, 200761 | 9889 | AGW01610 | 23920 | 54424 | 84928, 115432, 145936, 176440, 206944 |
| 3707 | ACZ17481 | 17738 | 48242 | 78746, 109250, 139754, 170258, 200762 | 9890 | AGW01622 | 23921 | 54425 | 84929, 115433, 145937, 176441, 206945 |
| 3708 | ACZ17491 | 17739 | 48243 | 78747, 109251, 139755, 170259, 200763 | 9891 | AGW01634 | 23922 | 54426 | 84930, 115434, 145938, 176442, 206946 |
| 3709 | ACZ27803 | 17740 | 48244 | 78748, 109252, 139756, 170260, 200764 | 9892 | AGW01646 | 23923 | 54427 | 84931, 115435, 145939, 176443, 206947 |
| 3710 | ACZ27813 | 17741 | 48245 | 78749, 109253, 139757, 170261, 200765 | 9893 | AGW01670 | 23924 | 54428 | 84932, 115436, 145940, 176444, 206948 |
| 3711 | ACZ27823 | 17742 | 48246 | 78750, 109254, 139758, 170262, 200766 | 9894 | AGW01682 | 23925 | 54429 | 84933, 115437, 145941, 176445, 206949 |
| 3712 | ACZ27833 | 17743 | 48247 | 78751, 109255, 139759, 170263, 200767 | 9895 | AGW01704 | 23926 | 54430 | 84934, 115438, 145942, 176446, 206950 |
| 3713 | ACZ45022 | 17744 | 48248 | 78752, 109256, 139760, 170264, 200768 | 9896 | AGW01716 | 23927 | 54431 | 84935, 115439, 145943, 176447, 206951 |
| 3714 | ACZ53958 | 17745 | 48249 | 78753, 109257, 139761, 170265, 200769 | 9897 | AGW01728 | 23928 | 54432 | 84936, 115440, 145944, 176448, 206952 |
| 3715 | ACZ53969 | 17746 | 48250 | 78754, 109258, 139762, 170266, 200770 | 9898 | AGW01740 | 23929 | 54433 | 84937, 115441, 145945, 176449, 206953 |
| 3716 | ACZ53980 | 17747 | 48251 | 78755, 109259, 139763, 170267, 200771 | 9899 | AGW01752 | 23930 | 54434 | 84938, 115442, 145946, 176450, 206954 |
| 3717 | ACZ56082 | 17748 | 48252 | 78756, 109260, 139764, 170268, 200772 | 9900 | AGW01764 | 23931 | 54435 | 84939, 115443, 145947, 176451, 206955 |
| 3718 | ACZ57183 | 17749 | 48253 | 78757, 109261, 139765, 170269, 200773 | 9901 | AGW01776 | 23932 | 54436 | 84940, 115444, 145948, 176452, 206956 |
| 3719 | ACZ81542 | 17750 | 48254 | 78758, 109262, 139766, 170270, 200774 | 9902 | AGW01788 | 23933 | 54437 | 84941, 115445, 145949, 176453, 206957 |

FIG. 3 continued

| | | | | | | | | | |
|---|---|---|---|---|---|---|---|---|---|
| 3720 | ACZ81543 | 17751 | 48255 | 78759, 109263, 139767, 170271, 200775 | 9903 | AGW01800 | 23934 | 54438 | 84942, 115446, 145950, 176454, 206958 |
| 3721 | ACZ81546 | 17752 | 48256 | 78760, 109264, 139768, 170272, 200776 | 9904 | AGW01812 | 23935 | 54439 | 84943, 115447, 145951, 176455, 206959 |
| 3722 | ACZ81547 | 17753 | 48257 | 78761, 109265, 139769, 170273, 200777 | 9905 | AGW01824 | 23936 | 54440 | 84944, 115448, 145952, 176456, 206960 |
| 3723 | ACZ81634 | 17754 | 48258 | 78762, 109266, 139770, 170274, 200778 | 9906 | AGW01848 | 23937 | 54441 | 84945, 115449, 145953, 176457, 206961 |
| 3724 | ACZ81644 | 17755 | 48259 | 78763, 109267, 139771, 170275, 200779 | 9907 | AGW01860 | 23938 | 54442 | 84946, 115450, 145954, 176458, 206962 |
| 3725 | ACZ81653 | 17756 | 48260 | 78764, 109268, 139772, 170276, 200780 | 9908 | AGW01884 | 23939 | 54443 | 84947, 115451, 145955, 176459, 206963 |
| 3726 | ACZ95840 | 17757 | 48261 | 78765, 109269, 139773, 170277, 200781 | 9909 | AGW01896 | 23940 | 54444 | 84948, 115452, 145956, 176460, 206964 |
| 3727 | ACZ95850 | 17758 | 48262 | 78766, 109270, 139774, 170278, 200782 | 9910 | AGW01908 | 23941 | 54445 | 84949, 115453, 145957, 176461, 206965 |
| 3728 | ACZ95860 | 17759 | 48263 | 78767, 109271, 139775, 170279, 200783 | 9911 | AGW01920 | 23942 | 54446 | 84950, 115454, 145958, 176462, 206966 |
| 3729 | ACZ95870 | 17760 | 48264 | 78768, 109272, 139776, 170280, 200784 | 9912 | AGW01932 | 23943 | 54447 | 84951, 115455, 145959, 176463, 206967 |
| 3730 | ACZ95880 | 17761 | 48265 | 78769, 109273, 139777, 170281, 200785 | 9913 | AGW01944 | 23944 | 54448 | 84952, 115456, 145960, 176464, 206968 |
| 3731 | ACZ95890 | 17762 | 48266 | 78770, 109274, 139778, 170282, 200786 | 9914 | AGW01956 | 23945 | 54449 | 84953, 115457, 145961, 176465, 206969 |
| 3732 | ACZ95900 | 17763 | 48267 | 78771, 109275, 139779, 170283, 200787 | 9915 | AGW01968 | 23946 | 54450 | 84954, 115458, 145962, 176466, 206970 |
| 3733 | ACZ95910 | 17764 | 48268 | 78772, 109276, 139780, 170284, 200788 | 9916 | AGW01980 | 23947 | 54451 | 84955, 115459, 145963, 176467, 206971 |
| 3734 | ACZ95920 | 17765 | 48269 | 78773, 109277, 139781, 170285, 200789 | 9917 | AGW01992 | 23948 | 54452 | 84956, 115460, 145964, 176468, 206972 |
| 3735 | ACZ95930 | 17766 | 48270 | 78774, 109278, 139782, 170286, 200790 | 9918 | AGW02004 | 23949 | 54453 | 84957, 115461, 145965, 176469, 206973 |
| 3736 | ACZ95940 | 17767 | 48271 | 78775, 109279, 139783, 170287, 200791 | 9919 | AGW02016 | 23950 | 54454 | 84958, 115462, 145966, 176470, 206974 |
| 3737 | ACZ95950 | 17768 | 48272 | 78776, 109280, 139784, 170288, 200792 | 9920 | AGW02040 | 23951 | 54455 | 84959, 115463, 145967, 176471, 206975 |

FIG. 3 continued

| | | | | | | | | | |
|---|---|---|---|---|---|---|---|---|---|
| 3738 | ACZ95960 | 17769 | 48273 | 78777, 109281, 139785, 170289, 200793 | 9921 | AGW02064 | 23952 | 54456 | 84960, 115464, 145968, 176472, 206976 |
| 3739 | ACZ95970 | 17770 | 48274 | 78778, 109282, 139786, 170290, 200794 | 9922 | AGW02076 | 23953 | 54457 | 84961, 115465, 145969, 176473, 206977 |
| 3740 | ACZ95980 | 17771 | 48275 | 78779, 109283, 139787, 170291, 200795 | 9923 | AGW02088 | 23954 | 54458 | 84962, 115466, 145970, 176474, 206978 |
| 3741 | ACZ95990 | 17772 | 48276 | 78780, 109284, 139788, 170292, 200796 | 9924 | AGW02100 | 23955 | 54459 | 84963, 115467, 145971, 176475, 206979 |
| 3742 | ACZ96000 | 17773 | 48277 | 78781, 109285, 139789, 170293, 200797 | 9925 | AGW02112 | 23956 | 54460 | 84964, 115468, 145972, 176476, 206980 |
| 3743 | ACZ96010 | 17774 | 48278 | 78782, 109286, 139790, 170294, 200798 | 9926 | AGW02124 | 23957 | 54461 | 84965, 115469, 145973, 176477, 206981 |
| 3744 | ACZ96020 | 17775 | 48279 | 78783, 109287, 139791, 170295, 200799 | 9927 | AGW02136 | 23958 | 54462 | 84966, 115470, 145974, 176478, 206982 |
| 3745 | ACZ96050 | 17776 | 48280 | 78784, 109288, 139792, 170296, 200800 | 9928 | AGW02148 | 23959 | 54463 | 84967, 115471, 145975, 176479, 206983 |
| 3746 | ACZ96060 | 17777 | 48281 | 78785, 109289, 139793, 170297, 200801 | 9929 | AGW02160 | 23960 | 54464 | 84968, 115472, 145976, 176480, 206984 |
| 3747 | ACZ96072 | 17778 | 48282 | 78786, 109290, 139794, 170298, 200802 | 9930 | AGW02172 | 23961 | 54465 | 84969, 115473, 145977, 176481, 206985 |
| 3748 | ACZ96082 | 17779 | 48283 | 78787, 109291, 139795, 170299, 200803 | 9931 | AGW02184 | 23962 | 54466 | 84970, 115474, 145978, 176482, 206986 |
| 3749 | ACZ96092 | 17780 | 48284 | 78788, 109292, 139796, 170300, 200804 | 9932 | AGW02196 | 23963 | 54467 | 84971, 115475, 145979, 176483, 206987 |
| 3750 | ACZ96102 | 17781 | 48285 | 78789, 109293, 139797, 170301, 200805 | 9933 | AGW04174 | 23964 | 54468 | 84972, 115476, 145980, 176484, 206988 |
| 3751 | ACZ96112 | 17782 | 48286 | 78790, 109294, 139798, 170302, 200806 | 9934 | AGW25784 | 23965 | 54469 | 84973, 115477, 145981, 176485, 206989 |
| 3752 | ACZ96122 | 17783 | 48287 | 78791, 109295, 139799, 170303, 200807 | 9935 | AGW27062 | 23966 | 54470 | 84974, 115478, 145982, 176486, 206990 |
| 3753 | ACZ96132 | 17784 | 48288 | 78792, 109296, 139800, 170304, 200808 | 9936 | AGY14472 | 23967 | 54471 | 84975, 115479, 145983, 176487, 206991 |
| 3754 | ACZ96142 | 17785 | 48289 | 78793, 109297, 139801, 170305, 200809 | 9937 | AHA11501 | 23968 | 54472 | 84976, 115480, 145984, 176488, 206992 |
| 3755 | ACZ96152 | 17786 | 48290 | 78794, 109298, 139802, 170306, 200810 | 9938 | AHC57462 | 23969 | 54473 | 84977, 115481, 145985, 176489, 206993 |

FIG. 3 continued

| | | | | | | | | | |
|---|---|---|---|---|---|---|---|---|---|
| 3756 | ACZ96162 | 17787 | 48291 | 78795, 109299, 139803, 170307, 200811 | 9939 | AHC57490 | 23970 | 54474 | 84978, 115482, 145986, 176490, 206994 |
| 3757 | ACZ96172 | 17788 | 48292 | 78796, 109300, 139804, 170308, 200812 | 9940 | AHC57514 | 23971 | 54475 | 84979, 115483, 145987, 176491, 206995 |
| 3758 | ACZ96182 | 17789 | 48293 | 78797, 109301, 139805, 170309, 200813 | 9941 | AHC57526 | 23972 | 54476 | 84980, 115484, 145988, 176492, 206996 |
| 3759 | ACZ96192 | 17790 | 48294 | 78798, 109302, 139806, 170310, 200814 | 9942 | AHC57806 | 23973 | 54477 | 84981, 115485, 145989, 176493, 206997 |
| 3760 | ACZ96232 | 17791 | 48295 | 78799, 109303, 139807, 170311, 200815 | 9943 | AHC57818 | 23974 | 54478 | 84982, 115486, 145990, 176494, 206998 |
| 3761 | ACZ96242 | 17792 | 48296 | 78800, 109304, 139808, 170312, 200816 | 9944 | AHC57830 | 23975 | 54479 | 84983, 115487, 145991, 176495, 206999 |
| 3762 | ACZ96252 | 17793 | 48297 | 78801, 109305, 139809, 170313, 200817 | 9945 | AHC57971 | 23976 | 54480 | 84984, 115488, 145992, 176496, 207000 |
| 3763 | ACZ96292 | 17794 | 48298 | 78802, 109306, 139810, 170314, 200818 | 9946 | AHC57984 | 23977 | 54481 | 84985, 115489, 145993, 176497, 207001 |
| 3764 | ACZ96302 | 17795 | 48299 | 78803, 109307, 139811, 170315, 200819 | 9947 | AHC57996 | 23978 | 54482 | 84986, 115490, 145994, 176498, 207002 |
| 3765 | ACZ96312 | 17796 | 48300 | 78804, 109308, 139812, 170316, 200820 | 9948 | AHC58008 | 23979 | 54483 | 84987, 115491, 145995, 176499, 207003 |
| 3766 | ACZ96322 | 17797 | 48301 | 78805, 109309, 139813, 170317, 200821 | 9949 | AHC58020 | 23980 | 54484 | 84988, 115492, 145996, 176500, 207004 |
| 3767 | ACZ96332 | 17798 | 48302 | 78806, 109310, 139814, 170318, 200822 | 9950 | AHC58032 | 23981 | 54485 | 84989, 115493, 145997, 176501, 207005 |
| 3768 | ACZ96352 | 17799 | 48303 | 78807, 109311, 139815, 170319, 200823 | 9951 | AHC58053 | 23982 | 54486 | 84990, 115494, 145998, 176502, 207006 |
| 3769 | ACZ96362 | 17800 | 48304 | 78808, 109312, 139816, 170320, 200824 | 9952 | AHC58077 | 23983 | 54487 | 84991, 115495, 145999, 176503, 207007 |
| 3770 | ACZ96375 | 17801 | 48305 | 78809, 109313, 139817, 170321, 200825 | 9953 | AHC58089 | 23984 | 54488 | 84992, 115496, 146000, 176504, 207008 |
| 3771 | ACZ96385 | 17802 | 48306 | 78810, 109314, 139818, 170322, 200826 | 9954 | AHC58101 | 23985 | 54489 | 84993, 115497, 146001, 176505, 207009 |
| 3772 | ACZ96395 | 17803 | 48307 | 78811, 109315, 139819, 170323, 200827 | 9955 | AHC58113 | 23986 | 54490 | 84994, 115498, 146002, 176506, 207010 |
| 3773 | ACZ96408 | 17804 | 48308 | 78812, 109316, 139820, 170324, 200828 | 9956 | AHC58129 | 23987 | 54491 | 84995, 115499, 146003, 176507, 207011 |

FIG. 3 continued

| | | | | | | | | | |
|---|---|---|---|---|---|---|---|---|---|
| 3774 | ACZ96428 | 17805 | 48309 | 78813, 109317, 139821, 170325, 200829 | 9957 | AHC58153 | 23988 | 54492 | 84996, 115500, 146004, 176508, 207012 |
| 3775 | ACZ96438 | 17806 | 48310 | 78814, 109318, 139822, 170326, 200830 | 9958 | AHC58165 | 23989 | 54493 | 84997, 115501, 146005, 176509, 207013 |
| 3776 | ACZ96448 | 17807 | 48311 | 78815, 109319, 139823, 170327, 200831 | 9959 | AHC58177 | 23990 | 54494 | 84998, 115502, 146006, 176510, 207014 |
| 3777 | ACZ96479 | 17808 | 48312 | 78816, 109320, 139824, 170328, 200832 | 9960 | AHC58189 | 23991 | 54495 | 84999, 115503, 146007, 176511, 207015 |
| 3778 | ACZ96489 | 17809 | 48313 | 78817, 109321, 139825, 170329, 200833 | 9961 | AHC58201 | 23992 | 54496 | 85000, 115504, 146008, 176512, 207016 |
| 3779 | ACZ96499 | 17810 | 48314 | 78818, 109322, 139826, 170330, 200834 | 9962 | AHC58225 | 23993 | 54497 | 85001, 115505, 146009, 176513, 207017 |
| 3780 | ACZ96509 | 17811 | 48315 | 78819, 109323, 139827, 170331, 200835 | 9963 | AHC58237 | 23994 | 54498 | 85002, 115506, 146010, 176514, 207018 |
| 3781 | ACZ96519 | 17812 | 48316 | 78820, 109324, 139828, 170332, 200836 | 9964 | AHC58249 | 23995 | 54499 | 85003, 115507, 146011, 176515, 207019 |
| 3782 | ACZ96529 | 17813 | 48317 | 78821, 109325, 139829, 170333, 200837 | 9965 | AHC58273 | 23996 | 54500 | 85004, 115508, 146012, 176516, 207020 |
| 3783 | ACZ96552 | 17814 | 48318 | 78822, 109326, 139830, 170334, 200838 | 9966 | AHC58363 | 23997 | 54501 | 85005, 115509, 146013, 176517, 207021 |
| 3784 | ACZ96562 | 17815 | 48319 | 78823, 109327, 139831, 170335, 200839 | 9967 | AHC58375 | 23998 | 54502 | 85006, 115510, 146014, 176518, 207022 |
| 3785 | ACZ96572 | 17816 | 48320 | 78824, 109328, 139832, 170336, 200840 | 9968 | AHC58387 | 23999 | 54503 | 85007, 115511, 146015, 176519, 207023 |
| 3786 | ACZ96582 | 17817 | 48321 | 78825, 109329, 139833, 170337, 200841 | 9969 | AHC58399 | 24000 | 54504 | 85008, 115512, 146016, 176520, 207024 |
| 3787 | ACZ96592 | 17818 | 48322 | 78826, 109330, 139834, 170338, 200842 | 9970 | AHC58411 | 24001 | 54505 | 85009, 115513, 146017, 176521, 207025 |
| 3788 | ACZ96602 | 17819 | 48323 | 78827, 109331, 139835, 170339, 200843 | 9971 | AHC58423 | 24002 | 54506 | 85010, 115514, 146018, 176522, 207026 |
| 3789 | ACZ96612 | 17820 | 48324 | 78828, 109332, 139836, 170340, 200844 | 9972 | AHC58459 | 24003 | 54507 | 85011, 115515, 146019, 176523, 207027 |
| 3790 | ACZ96622 | 17821 | 48325 | 78829, 109333, 139837, 170341, 200845 | 9973 | AHC58471 | 24004 | 54508 | 85012, 115516, 146020, 176524, 207028 |
| 3791 | ACZ96632 | 17822 | 48326 | 78830, 109334, 139838, 170342, 200846 | 9974 | AHC58482 | 24005 | 54509 | 85013, 115517, 146021, 176525, 207029 |

FIG. 3 continued

| | | | | | | | | | |
|---|---|---|---|---|---|---|---|---|---|
| 3792 | ACZ96642 | 17823 | 48327 | 78831, 109335, 139839, 170343, 200847 | 9975 | AHC58494 | 24006 | 54510 | 85014, 115518, 146022, 176526, 207030 |
| 3793 | ACZ96652 | 17824 | 48328 | 78832, 109336, 139840, 170344, 200848 | 9976 | AHC58518 | 24007 | 54511 | 85015, 115519, 146023, 176527, 207031 |
| 3794 | ACZ96662 | 17825 | 48329 | 78833, 109337, 139841, 170345, 200849 | 9977 | AHC58530 | 24008 | 54512 | 85016, 115520, 146024, 176528, 207032 |
| 3795 | ACZ96672 | 17826 | 48330 | 78834, 109338, 139842, 170346, 200850 | 9978 | AHC58554 | 24009 | 54513 | 85017, 115521, 146025, 176529, 207033 |
| 3796 | ACZ96682 | 17827 | 48331 | 78835, 109339, 139843, 170347, 200851 | 9979 | AHC58566 | 24010 | 54514 | 85018, 115522, 146026, 176530, 207034 |
| 3797 | ACZ96692 | 17828 | 48332 | 78836, 109340, 139844, 170348, 200852 | 9980 | AHC58578 | 24011 | 54515 | 85019, 115523, 146027, 176531, 207035 |
| 3798 | ACZ96702 | 17829 | 48333 | 78837, 109341, 139845, 170349, 200853 | 9981 | AHC58590 | 24012 | 54516 | 85020, 115524, 146028, 176532, 207036 |
| 3799 | ACZ96712 | 17830 | 48334 | 78838, 109342, 139846, 170350, 200854 | 9982 | AHC58602 | 24013 | 54517 | 85021, 115525, 146029, 176533, 207037 |
| 3800 | ACZ96722 | 17831 | 48335 | 78839, 109343, 139847, 170351, 200855 | 9983 | AHC58614 | 24014 | 54518 | 85022, 115526, 146030, 176534, 207038 |
| 3801 | ACZ96732 | 17832 | 48336 | 78840, 109344, 139848, 170352, 200856 | 9984 | AHC58626 | 24015 | 54519 | 85023, 115527, 146031, 176535, 207039 |
| 3802 | ACZ96742 | 17833 | 48337 | 78841, 109345, 139849, 170353, 200857 | 9985 | AHC58638 | 24016 | 54520 | 85024, 115528, 146032, 176536, 207040 |
| 3803 | ACZ96752 | 17834 | 48338 | 78842, 109346, 139850, 170354, 200858 | 9986 | AHC58650 | 24017 | 54521 | 85025, 115529, 146033, 176537, 207041 |
| 3804 | ACZ96762 | 17835 | 48339 | 78843, 109347, 139851, 170355, 200859 | 9987 | AHC58662 | 24018 | 54522 | 85026, 115530, 146034, 176538, 207042 |
| 3805 | ACZ96772 | 17836 | 48340 | 78844, 109348, 139852, 170356, 200860 | 9988 | AHC58686 | 24019 | 54523 | 85027, 115531, 146035, 176539, 207043 |
| 3806 | ACZ96782 | 17837 | 48341 | 78845, 109349, 139853, 170357, 200861 | 9989 | AHC58698 | 24020 | 54524 | 85028, 115532, 146036, 176540, 207044 |
| 3807 | ACZ96792 | 17838 | 48342 | 78846, 109350, 139854, 170358, 200862 | 9990 | AHC58710 | 24021 | 54525 | 85029, 115533, 146037, 176541, 207045 |
| 3808 | ACZ96802 | 17839 | 48343 | 78847, 109351, 139855, 170359, 200863 | 9991 | AHC58722 | 24022 | 54526 | 85030, 115534, 146038, 176542, 207046 |
| 3809 | ACZ96812 | 17840 | 48344 | 78848, 109352, 139856, 170360, 200864 | 9992 | AHC58734 | 24023 | 54527 | 85031, 115535, 146039, 176543, 207047 |

FIG. 3 continued

| | | | | | | | | | |
|---|---|---|---|---|---|---|---|---|---|
| 3810 | ACZ96822 | 17841 | 48345 | 78849, 109353, 139857, 170361, 200865 | 9993 | AHC58746 | 24024 | 54528 | 85032, 115536, 146040, 176544, 207048 |
| 3811 | ACZ96842 | 17842 | 48346 | 78850, 109354, 139858, 170362, 200866 | 9994 | AHC58758 | 24025 | 54529 | 85033, 115537, 146041, 176545, 207049 |
| 3812 | ACZ96852 | 17843 | 48347 | 78851, 109355, 139859, 170363, 200867 | 9995 | AHC58770 | 24026 | 54530 | 85034, 115538, 146042, 176546, 207050 |
| 3813 | ACZ96862 | 17844 | 48348 | 78852, 109356, 139860, 170364, 200868 | 9996 | AHC58782 | 24027 | 54531 | 85035, 115539, 146043, 176547, 207051 |
| 3814 | ACZ96872 | 17845 | 48349 | 78853, 109357, 139861, 170365, 200869 | 9997 | AHC58806 | 24028 | 54532 | 85036, 115540, 146044, 176548, 207052 |
| 3815 | ACZ96882 | 17846 | 48350 | 78854, 109358, 139862, 170366, 200870 | 9998 | AHC58818 | 24029 | 54533 | 85037, 115541, 146045, 176549, 207053 |
| 3816 | ACZ96892 | 17847 | 48351 | 78855, 109359, 139863, 170367, 200871 | 9999 | AHC58830 | 24030 | 54534 | 85038, 115542, 146046, 176550, 207054 |
| 3817 | ACZ96902 | 17848 | 48352 | 78856, 109360, 139864, 170368, 200872 | 10000 | AHC58842 | 24031 | 54535 | 85039, 115543, 146047, 176551, 207055 |
| 3818 | ACZ96912 | 17849 | 48353 | 78857, 109361, 139865, 170369, 200873 | 10001 | AHC58866 | 24032 | 54536 | 85040, 115544, 146048, 176552, 207056 |
| 3819 | ACZ96922 | 17850 | 48354 | 78858, 109362, 139866, 170370, 200874 | 10002 | AHC58878 | 24033 | 54537 | 85041, 115545, 146049, 176553, 207057 |
| 3820 | ACZ96932 | 17851 | 48355 | 78859, 109363, 139867, 170371, 200875 | 10003 | AHC58890 | 24034 | 54538 | 85042, 115546, 146050, 176554, 207058 |
| 3821 | ACZ96942 | 17852 | 48356 | 78860, 109364, 139868, 170372, 200876 | 10004 | AHC58902 | 24035 | 54539 | 85043, 115547, 146051, 176555, 207059 |
| 3822 | ACZ96952 | 17853 | 48357 | 78861, 109365, 139869, 170373, 200877 | 10005 | AHC58996 | 24036 | 54540 | 85044, 115548, 146052, 176556, 207060 |
| 3823 | ACZ97024 | 17854 | 48358 | 78862, 109366, 139870, 170374, 200878 | 10006 | AHC59008 | 24037 | 54541 | 85045, 115549, 146053, 176557, 207061 |
| 3824 | ACZ97336 | 17855 | 48359 | 78863, 109367, 139871, 170375, 200879 | 10007 | AHC59020 | 24038 | 54542 | 85046, 115550, 146054, 176558, 207062 |
| 3825 | ACZ97346 | 17856 | 48360 | 78864, 109368, 139872, 170376, 200880 | 10008 | AHC59032 | 24039 | 54543 | 85047, 115551, 146055, 176559, 207063 |
| 3826 | ACZ97366 | 17857 | 48361 | 78865, 109369, 139873, 170377, 200881 | 10009 | AHC59044 | 24040 | 54544 | 85048, 115552, 146056, 176560, 207064 |
| 3827 | ACZ97376 | 17858 | 48362 | 78866, 109370, 139874, 170378, 200882 | 10010 | AHC59056 | 24041 | 54545 | 85049, 115553, 146057, 176561, 207065 |

FIG. 3 continued

| | | | | | | | | | |
|---|---|---|---|---|---|---|---|---|---|
| 3828 | ACZ97386 | 17859 | 48363 | 78867, 109371, 139875, 170379, 200883 | 10011 | AHC59068 | 24042 | 54546 | 85050, 115554, 146058, 176562, 207066 |
| 3829 | ACZ97396 | 17860 | 48364 | 78868, 109372, 139876, 170380, 200884 | 10012 | AHC59080 | 24043 | 54547 | 85051, 115555, 146059, 176563, 207067 |
| 3830 | ACZ98171 | 17861 | 48365 | 78869, 109373, 139877, 170381, 200885 | 10013 | AHC59092 | 24044 | 54548 | 85052, 115556, 146060, 176564, 207068 |
| 3831 | ACZ98181 | 17862 | 48366 | 78870, 109374, 139878, 170382, 200886 | 10014 | AHC59104 | 24045 | 54549 | 85053, 115557, 146061, 176565, 207069 |
| 3832 | ACZ98191 | 17863 | 48367 | 78871, 109375, 139879, 170383, 200887 | 10015 | AHC59116 | 24046 | 54550 | 85054, 115558, 146062, 176566, 207070 |
| 3833 | ACZ98201 | 17864 | 48368 | 78872, 109376, 139880, 170384, 200888 | 10016 | AHC59128 | 24047 | 54551 | 85055, 115559, 146063, 176567, 207071 |
| 3834 | ACZ98211 | 17865 | 48369 | 78873, 109377, 139881, 170385, 200889 | 10017 | AHC59152 | 24048 | 54552 | 85056, 115560, 146064, 176568, 207072 |
| 3835 | ACZ98221 | 17866 | 48370 | 78874, 109378, 139882, 170386, 200890 | 10018 | AHC59188 | 24049 | 54553 | 85057, 115561, 146065, 176569, 207073 |
| 3836 | ACZ98231 | 17867 | 48371 | 78875, 109379, 139883, 170387, 200891 | 10019 | AHC59200 | 24050 | 54554 | 85058, 115562, 146066, 176570, 207074 |
| 3837 | ACZ98241 | 17868 | 48372 | 78876, 109380, 139884, 170388, 200892 | 10020 | AHC59212 | 24051 | 54555 | 85059, 115563, 146067, 176571, 207075 |
| 3838 | ACZ98251 | 17869 | 48373 | 78877, 109381, 139885, 170389, 200893 | 10021 | AHC59224 | 24052 | 54556 | 85060, 115564, 146068, 176572, 207076 |
| 3839 | ACZ98261 | 17870 | 48374 | 78878, 109382, 139886, 170390, 200894 | 10022 | AHC59236 | 24053 | 54557 | 85061, 115565, 146069, 176573, 207077 |
| 3840 | ACZ98271 | 17871 | 48375 | 78879, 109383, 139887, 170391, 200895 | 10023 | AHC59260 | 24054 | 54558 | 85062, 115566, 146070, 176574, 207078 |
| 3841 | ACZ98281 | 17872 | 48376 | 78880, 109384, 139888, 170392, 200896 | 10024 | AHC59272 | 24055 | 54559 | 85063, 115567, 146071, 176575, 207079 |
| 3842 | ACZ98291 | 17873 | 48377 | 78881, 109385, 139889, 170393, 200897 | 10025 | AHC59284 | 24056 | 54560 | 85064, 115568, 146072, 176576, 207080 |
| 3843 | ACZ98301 | 17874 | 48378 | 78882, 109386, 139890, 170394, 200898 | 10026 | AHC59296 | 24057 | 54561 | 85065, 115569, 146073, 176577, 207081 |
| 3844 | ACZ98321 | 17875 | 48379 | 78883, 109387, 139891, 170395, 200899 | 10027 | AHC59308 | 24058 | 54562 | 85066, 115570, 146074, 176578, 207082 |
| 3845 | ACZ98331 | 17876 | 48380 | 78884, 109388, 139892, 170396, 200900 | 10028 | AHC59320 | 24059 | 54563 | 85067, 115571, 146075, 176579, 207083 |

FIG. 3 continued

| | | | | | | | | | |
|---|---|---|---|---|---|---|---|---|---|
| 3846 | ACZ98341 | 17877 | 48381 | 78885, 109389, 139893, 170397, 200901 | 10029 | AHC59332 | 24060 | 54564 | 85068, 115572, 146076, 176580, 207084 |
| 3847 | ACZ98351 | 17878 | 48382 | 78886, 109390, 139894, 170398, 200902 | 10030 | AHC59344 | 24061 | 54565 | 85069, 115573, 146077, 176581, 207085 |
| 3848 | ACZ98361 | 17879 | 48383 | 78887, 109391, 139895, 170399, 200903 | 10031 | AHC59368 | 24062 | 54566 | 85070, 115574, 146078, 176582, 207086 |
| 3849 | ACZ98371 | 17880 | 48384 | 78888, 109392, 139896, 170400, 200904 | 10032 | AHC59380 | 24063 | 54567 | 85071, 115575, 146079, 176583, 207087 |
| 3850 | ACZ98381 | 17881 | 48385 | 78889, 109393, 139897, 170401, 200905 | 10033 | AHC59392 | 24064 | 54568 | 85072, 115576, 146080, 176584, 207088 |
| 3851 | ACZ98391 | 17882 | 48386 | 78890, 109394, 139898, 170402, 200906 | 10034 | AHC59404 | 24065 | 54569 | 85073, 115577, 146081, 176585, 207089 |
| 3852 | ACZ98401 | 17883 | 48387 | 78891, 109395, 139899, 170403, 200907 | 10035 | AHC59416 | 24066 | 54570 | 85074, 115578, 146082, 176586, 207090 |
| 3853 | ACZ98411 | 17884 | 48388 | 78892, 109396, 139900, 170404, 200908 | 10036 | AHC59428 | 24067 | 54571 | 85075, 115579, 146083, 176587, 207091 |
| 3854 | ACZ98421 | 17885 | 48389 | 78893, 109397, 139901, 170405, 200909 | 10037 | AHC59440 | 24068 | 54572 | 85076, 115580, 146084, 176588, 207092 |
| 3855 | ACZ98431 | 17886 | 48390 | 78894, 109398, 139902, 170406, 200910 | 10038 | AHC59452 | 24069 | 54573 | 85077, 115581, 146085, 176589, 207093 |
| 3856 | ACZ98441 | 17887 | 48391 | 78895, 109399, 139903, 170407, 200911 | 10039 | AHC59464 | 24070 | 54574 | 85078, 115582, 146086, 176590, 207094 |
| 3857 | ACZ98451 | 17888 | 48392 | 78896, 109400, 139904, 170408, 200912 | 10040 | AHC59476 | 24071 | 54575 | 85079, 115583, 146087, 176591, 207095 |
| 3858 | ACZ98461 | 17889 | 48393 | 78897, 109401, 139905, 170409, 200913 | 10041 | AHC59488 | 24072 | 54576 | 85080, 115584, 146088, 176592, 207096 |
| 3859 | ACZ98674 | 17890 | 48394 | 78898, 109402, 139906, 170410, 200914 | 10042 | AHC59500 | 24073 | 54577 | 85081, 115585, 146089, 176593, 207097 |
| 3860 | ACZ98684 | 17891 | 48395 | 78899, 109403, 139907, 170411, 200915 | 10043 | AHC59512 | 24074 | 54578 | 85082, 115586, 146090, 176594, 207098 |
| 3861 | ACZ98694 | 17892 | 48396 | 78900, 109404, 139908, 170412, 200916 | 10044 | AHC59524 | 24075 | 54579 | 85083, 115587, 146091, 176595, 207099 |
| 3862 | ADA60801 | 17893 | 48397 | 78901, 109405, 139909, 170413, 200917 | 10045 | AHC59536 | 24076 | 54580 | 85084, 115588, 146092, 176596, 207100 |
| 3863 | ADA69294 | 17894 | 48398 | 78902, 109406, 139910, 170414, 200918 | 10046 | AHC59548 | 24077 | 54581 | 85085, 115589, 146093, 176597, 207101 |

FIG. 3 continued

| | | | | | | | | | |
|---|---|---|---|---|---|---|---|---|---|
| 3864 | ADA69304 | 17895 | 48399 | 78903, 109407, 139911, 170415, 200919 | 10047 | AHC59560 | 24078 | 54582 | 85086, 115590, 146094, 176598, 207102 |
| 3865 | ADA69314 | 17896 | 48400 | 78904, 109408, 139912, 170416, 200920 | 10048 | AHC59572 | 24079 | 54583 | 85087, 115591, 146095, 176599, 207103 |
| 3866 | ADA69324 | 17897 | 48401 | 78905, 109409, 139913, 170417, 200921 | 10049 | AHC59584 | 24080 | 54584 | 85088, 115592, 146096, 176600, 207104 |
| 3867 | ADA69334 | 17898 | 48402 | 78906, 109410, 139914, 170418, 200922 | 10050 | AHC59596 | 24081 | 54585 | 85089, 115593, 146097, 176601, 207105 |
| 3868 | ADA69451 | 17899 | 48403 | 78907, 109411, 139915, 170419, 200923 | 10051 | AHC59608 | 24082 | 54586 | 85090, 115594, 146098, 176602, 207106 |
| 3869 | ADA69453 | 17900 | 48404 | 78908, 109412, 139916, 170420, 200924 | 10052 | AHC59620 | 24083 | 54587 | 85091, 115595, 146099, 176603, 207107 |
| 3870 | ADA71153 | 17901 | 48405 | 78909, 109413, 139917, 170421, 200925 | 10053 | AHC59632 | 24084 | 54588 | 85092, 115596, 146100, 176604, 207108 |
| 3871 | ADA71155 | 17902 | 48406 | 78910, 109414, 139918, 170422, 200926 | 10054 | AHC59644 | 24085 | 54589 | 85093, 115597, 146101, 176605, 207109 |
| 3872 | ADA71157 | 17903 | 48407 | 78911, 109415, 139919, 170423, 200927 | 10055 | AHC59656 | 24086 | 54590 | 85094, 115598, 146102, 176606, 207110 |
| 3873 | ADA71159 | 17904 | 48408 | 78912, 109416, 139920, 170424, 200928 | 10056 | AHC59668 | 24087 | 54591 | 85095, 115599, 146103, 176607, 207111 |
| 3874 | ADA71161 | 17905 | 48409 | 78913, 109417, 139921, 170425, 200929 | 10057 | AHC59680 | 24088 | 54592 | 85096, 115600, 146104, 176608, 207112 |
| 3875 | ADA71165 | 17906 | 48410 | 78914, 109418, 139922, 170426, 200930 | 10058 | AHC59704 | 24089 | 54593 | 85097, 115601, 146105, 176609, 207113 |
| 3876 | ADA71167 | 17907 | 48411 | 78915, 109419, 139923, 170427, 200931 | 10059 | AHC59716 | 24090 | 54594 | 85098, 115602, 146106, 176610, 207114 |
| 3877 | ADA71169 | 17908 | 48412 | 78916, 109420, 139924, 170428, 200932 | 10060 | AHC59728 | 24091 | 54595 | 85099, 115603, 146107, 176611, 207115 |
| 3878 | ADA71171 | 17909 | 48413 | 78917, 109421, 139925, 170429, 200933 | 10061 | AHC59752 | 24092 | 54596 | 85100, 115604, 146108, 176612, 207116 |
| 3879 | ADA71173 | 17910 | 48414 | 78918, 109422, 139926, 170430, 200934 | 10062 | AHC59764 | 24093 | 54597 | 85101, 115605, 146109, 176613, 207117 |
| 3880 | ADA71175 | 17911 | 48415 | 78919, 109423, 139927, 170431, 200935 | 10063 | AHC59776 | 24094 | 54598 | 85102, 115606, 146110, 176614, 207118 |
| 3881 | ADA71177 | 17912 | 48416 | 78920, 109424, 139928, 170432, 200936 | 10064 | AHC59788 | 24095 | 54599 | 85103, 115607, 146111, 176615, 207119 |

FIG. 3 continued

| | | | | | | | | | |
|---|---|---|---|---|---|---|---|---|---|
| 3882 | ADA71193 | 17913 | 48417 | 78921, 109425, 139929, 170433, 200937 | 10065 | AHC59800 | 24096 | 54600 | 85104, 115608, 146112, 176616, 207120 |
| 3883 | ADA79589 | 17914 | 48418 | 78922, 109426, 139930, 170434, 200938 | 10066 | AHC59812 | 24097 | 54601 | 85105, 115609, 146113, 176617, 207121 |
| 3884 | ADA79599 | 17915 | 48419 | 78923, 109427, 139931, 170435, 200939 | 10067 | AHC59824 | 24098 | 54602 | 85106, 115610, 146114, 176618, 207122 |
| 3885 | ADA79609 | 17916 | 48420 | 78924, 109428, 139932, 170436, 200940 | 10068 | AHC59836 | 24099 | 54603 | 85107, 115611, 146115, 176619, 207123 |
| 3886 | ADA79619 | 17917 | 48421 | 78925, 109429, 139933, 170437, 200941 | 10069 | AHC59848 | 24100 | 54604 | 85108, 115612, 146116, 176620, 207124 |
| 3887 | ADA81211 | 17918 | 48422 | 78926, 109430, 139934, 170438, 200942 | 10070 | AHC59860 | 24101 | 54605 | 85109, 115613, 146117, 176621, 207125 |
| 3888 | ADA83035 | 17919 | 48423 | 78927, 109431, 139935, 170439, 200943 | 10071 | AHC59872 | 24102 | 54606 | 85110, 115614, 146118, 176622, 207126 |
| 3889 | ADA83037 | 17920 | 48424 | 78928, 109432, 139936, 170440, 200944 | 10072 | AHC59884 | 24103 | 54607 | 85111, 115615, 146119, 176623, 207127 |
| 3890 | ADA83588 | 17921 | 48425 | 78929, 109433, 139937, 170441, 200945 | 10073 | AHC59895 | 24104 | 54608 | 85112, 115616, 146120, 176624, 207128 |
| 3891 | ADA83592 | 17922 | 48426 | 78930, 109434, 139938, 170442, 200946 | 10074 | AHC59907 | 24105 | 54609 | 85113, 115617, 146121, 176625, 207129 |
| 3892 | ADA83596 | 17923 | 48427 | 78931, 109435, 139939, 170443, 200947 | 10075 | AHC59918 | 24106 | 54610 | 85114, 115618, 146122, 176626, 207130 |
| 3893 | ADA83600 | 17924 | 48428 | 78932, 109436, 139940, 170444, 200948 | 10076 | AHC59930 | 24107 | 54611 | 85115, 115619, 146123, 176627, 207131 |
| 3894 | ADA83604 | 17925 | 48429 | 78933, 109437, 139941, 170445, 200949 | 10077 | AHC59942 | 24108 | 54612 | 85116, 115620, 146124, 176628, 207132 |
| 3895 | ADA83608 | 17926 | 48430 | 78934, 109438, 139942, 170446, 200950 | 10078 | AHC59954 | 24109 | 54613 | 85117, 115621, 146125, 176629, 207133 |
| 3896 | ADA83612 | 17927 | 48431 | 78935, 109439, 139943, 170447, 200951 | 10079 | AHC59966 | 24110 | 54614 | 85118, 115622, 146126, 176630, 207134 |
| 3897 | ADA83616 | 17928 | 48432 | 78936, 109440, 139944, 170448, 200952 | 10080 | AHC59978 | 24111 | 54615 | 85119, 115623, 146127, 176631, 207135 |
| 3898 | ADA83624 | 17929 | 48433 | 78937, 109441, 139945, 170449, 200953 | 10081 | AHC59990 | 24112 | 54616 | 85120, 115624, 146128, 176632, 207136 |
| 3899 | ADA83630 | 17930 | 48434 | 78938, 109442, 139946, 170450, 200954 | 10082 | AHC60002 | 24113 | 54617 | 85121, 115625, 146129, 176633, 207137 |

FIG. 3 continued

| | | | | | | | | | |
|---|---|---|---|---|---|---|---|---|---|
| 3900 | ADA83634 | 17931 | 48435 | 78939, 109443, 139947, 170451, 200955 | 10083 | AHC60014 | 24114 | 54618 | 85122, 115626, 146130, 176634, 207138 |
| 3901 | ADA83638 | 17932 | 48436 | 78940, 109444, 139948, 170452, 200956 | 10084 | AHC60026 | 24115 | 54619 | 85123, 115627, 146131, 176635, 207139 |
| 3902 | ADA83642 | 17933 | 48437 | 78941, 109445, 139949, 170453, 200957 | 10085 | AHC60038 | 24116 | 54620 | 85124, 115628, 146132, 176636, 207140 |
| 3903 | ADA83649 | 17934 | 48438 | 78942, 109446, 139950, 170454, 200958 | 10086 | AHC60050 | 24117 | 54621 | 85125, 115629, 146133, 176637, 207141 |
| 3904 | ADA83653 | 17935 | 48439 | 78943, 109447, 139951, 170455, 200959 | 10087 | AHC60062 | 24118 | 54622 | 85126, 115630, 146134, 176638, 207142 |
| 3905 | ADA83657 | 17936 | 48440 | 78944, 109448, 139952, 170456, 200960 | 10088 | AHC60074 | 24119 | 54623 | 85127, 115631, 146135, 176639, 207143 |
| 3906 | ADA83661 | 17937 | 48441 | 78945, 109449, 139953, 170457, 200961 | 10089 | AHC60086 | 24120 | 54624 | 85128, 115632, 146136, 176640, 207144 |
| 3907 | ADA83669 | 17938 | 48442 | 78946, 109450, 139954, 170458, 200962 | 10090 | AHC60098 | 24121 | 54625 | 85129, 115633, 146137, 176641, 207145 |
| 3908 | ADA83673 | 17939 | 48443 | 78947, 109451, 139955, 170459, 200963 | 10091 | AHC60110 | 24122 | 54626 | 85130, 115634, 146138, 176642, 207146 |
| 3909 | ADA83677 | 17940 | 48444 | 78948, 109452, 139956, 170460, 200964 | 10092 | AHC60122 | 24123 | 54627 | 85131, 115635, 146139, 176643, 207147 |
| 3910 | ADA83681 | 17941 | 48445 | 78949, 109453, 139957, 170461, 200965 | 10093 | AHC60134 | 24124 | 54628 | 85132, 115636, 146140, 176644, 207148 |
| 3911 | ADA83685 | 17942 | 48446 | 78950, 109454, 139958, 170462, 200966 | 10094 | AHC60146 | 24125 | 54629 | 85133, 115637, 146141, 176645, 207149 |
| 3912 | ADA86069 | 17943 | 48447 | 78951, 109455, 139959, 170463, 200967 | 10095 | AHC60158 | 24126 | 54630 | 85134, 115638, 146142, 176646, 207150 |
| 3913 | ADB27973 | 17944 | 48448 | 78952, 109456, 139960, 170464, 200968 | 10096 | AHC60182 | 24127 | 54631 | 85135, 115639, 146143, 176647, 207151 |
| 3914 | ADB27983 | 17945 | 48449 | 78953, 109457, 139961, 170465, 200969 | 10097 | AHC60206 | 24128 | 54632 | 85136, 115640, 146144, 176648, 207152 |
| 3915 | ADB66693 | 17946 | 48450 | 78954, 109458, 139962, 170466, 200970 | 10098 | AHC60218 | 24129 | 54633 | 85137, 115641, 146145, 176649, 207153 |
| 3916 | ADB66695 | 17947 | 48451 | 78955, 109459, 139963, 170467, 200971 | 10099 | AHC60230 | 24130 | 54634 | 85138, 115642, 146146, 176650, 207154 |
| 3917 | ADB66696 | 17948 | 48452 | 78956, 109460, 139964, 170468, 200972 | 10100 | AHC60242 | 24131 | 54635 | 85139, 115643, 146147, 176651, 207155 |

FIG. 3 continued

| | | | | | | | | | |
|---|---|---|---|---|---|---|---|---|---|
| 3918 | ADB66697 | 17949 | 48453 | 78957, 109461, 139965, 170469, 200973 | 10101 | AHC60254 | 24132 | 54636 | 85140, 115644, 146148, 176652, 207156 |
| 3919 | ADB81401 | 17950 | 48454 | 78958, 109462, 139966, 170470, 200974 | 10102 | AHC60266 | 24133 | 54637 | 85141, 115645, 146149, 176653, 207157 |
| 3920 | ADB81421 | 17951 | 48455 | 78959, 109463, 139967, 170471, 200975 | 10103 | AHC60278 | 24134 | 54638 | 85142, 115646, 146150, 176654, 207158 |
| 3921 | ADB81431 | 17952 | 48456 | 78960, 109464, 139968, 170472, 200976 | 10104 | AHC60290 | 24135 | 54639 | 85143, 115647, 146151, 176655, 207159 |
| 3922 | ADB81441 | 17953 | 48457 | 78961, 109465, 139969, 170473, 200977 | 10105 | AHC60302 | 24136 | 54640 | 85144, 115648, 146152, 176656, 207160 |
| 3923 | ADB81451 | 17954 | 48458 | 78962, 109466, 139970, 170474, 200978 | 10106 | AHC60314 | 24137 | 54641 | 85145, 115649, 146153, 176657, 207161 |
| 3924 | ADB81461 | 17955 | 48459 | 78963, 109467, 139971, 170475, 200979 | 10107 | AHC60326 | 24138 | 54642 | 85146, 115650, 146154, 176658, 207162 |
| 3925 | ADB82942 | 17956 | 48460 | 78964, 109468, 139972, 170476, 200980 | 10108 | AHC60338 | 24139 | 54643 | 85147, 115651, 146155, 176659, 207163 |
| 3926 | ADB82945 | 17957 | 48461 | 78965, 109469, 139973, 170477, 200981 | 10109 | AHC60350 | 24140 | 54644 | 85148, 115652, 146156, 176660, 207164 |
| 3927 | ADB89132 | 17958 | 48462 | 78966, 109470, 139974, 170478, 200982 | 10110 | AHC60362 | 24141 | 54645 | 85149, 115653, 146157, 176661, 207165 |
| 3928 | ADB89142 | 17959 | 48463 | 78967, 109471, 139975, 170479, 200983 | 10111 | AHC60374 | 24142 | 54646 | 85150, 115654, 146158, 176662, 207166 |
| 3929 | ADB89224 | 17960 | 48464 | 78968, 109472, 139976, 170480, 200984 | 10112 | AHC60386 | 24143 | 54647 | 85151, 115655, 146159, 176663, 207167 |
| 3930 | ADB89234 | 17961 | 48465 | 78969, 109473, 139977, 170481, 200985 | 10113 | AHC60398 | 24144 | 54648 | 85152, 115656, 146160, 176664, 207168 |
| 3931 | ADB89244 | 17962 | 48466 | 78970, 109474, 139978, 170482, 200986 | 10114 | AHC60410 | 24145 | 54649 | 85153, 115657, 146161, 176665, 207169 |
| 3932 | ADB89264 | 17963 | 48467 | 78971, 109475, 139979, 170483, 200987 | 10115 | AHC60422 | 24146 | 54650 | 85154, 115658, 146162, 176666, 207170 |
| 3933 | ADB89274 | 17964 | 48468 | 78972, 109476, 139980, 170484, 200988 | 10116 | AHC60434 | 24147 | 54651 | 85155, 115659, 146163, 176667, 207171 |
| 3934 | ADB89284 | 17965 | 48469 | 78973, 109477, 139981, 170485, 200989 | 10117 | AHC60446 | 24148 | 54652 | 85156, 115660, 146164, 176668, 207172 |
| 3935 | ADB89294 | 17966 | 48470 | 78974, 109478, 139982, 170486, 200990 | 10118 | AHC60458 | 24149 | 54653 | 85157, 115661, 146165, 176669, 207173 |

FIG. 3 continued

| | | | | | | | | | |
|---|---|---|---|---|---|---|---|---|---|
| 3936 | ADB89304 | 17967 | 48471 | 78975, 109479, 139983, 170487, 200991 | 10119 | AHC60470 | 24150 | 54654 | 85158, 115662, 146166, 176670, 207174 |
| 3937 | ADB89314 | 17968 | 48472 | 78976, 109480, 139984, 170488, 200992 | 10120 | AHC60482 | 24151 | 54655 | 85159, 115663, 146167, 176671, 207175 |
| 3938 | ADB89324 | 17969 | 48473 | 78977, 109481, 139985, 170489, 200993 | 10121 | AHC60494 | 24152 | 54656 | 85160, 115664, 146168, 176672, 207176 |
| 3939 | ADB89334 | 17970 | 48474 | 78978, 109482, 139986, 170490, 200994 | 10122 | AHC60506 | 24153 | 54657 | 85161, 115665, 146169, 176673, 207177 |
| 3940 | ADB89344 | 17971 | 48475 | 78979, 109483, 139987, 170491, 200995 | 10123 | AHC60518 | 24154 | 54658 | 85162, 115666, 146170, 176674, 207178 |
| 3941 | ADB89364 | 17972 | 48476 | 78980, 109484, 139988, 170492, 200996 | 10124 | AHC60542 | 24155 | 54659 | 85163, 115667, 146171, 176675, 207179 |
| 3942 | ADB89374 | 17973 | 48477 | 78981, 109485, 139989, 170493, 200997 | 10125 | AHC60554 | 24156 | 54660 | 85164, 115668, 146172, 176676, 207180 |
| 3943 | ADB89384 | 17974 | 48478 | 78982, 109486, 139990, 170494, 200998 | 10126 | AHC60566 | 24157 | 54661 | 85165, 115669, 146173, 176677, 207181 |
| 3944 | ADB89394 | 17975 | 48479 | 78983, 109487, 139991, 170495, 200999 | 10127 | AHC60578 | 24158 | 54662 | 85166, 115670, 146174, 176678, 207182 |
| 3945 | ADB89404 | 17976 | 48480 | 78984, 109488, 139992, 170496, 201000 | 10128 | AHC60590 | 24159 | 54663 | 85167, 115671, 146175, 176679, 207183 |
| 3946 | ADB89414 | 17977 | 48481 | 78985, 109489, 139993, 170497, 201001 | 10129 | AHC60602 | 24160 | 54664 | 85168, 115672, 146176, 176680, 207184 |
| 3947 | ADB89424 | 17978 | 48482 | 78986, 109490, 139994, 170498, 201002 | 10130 | AHC60614 | 24161 | 54665 | 85169, 115673, 146177, 176681, 207185 |
| 3948 | ADB89434 | 17979 | 48483 | 78987, 109491, 139995, 170499, 201003 | 10131 | AHC60626 | 24162 | 54666 | 85170, 115674, 146178, 176682, 207186 |
| 3949 | ADB89444 | 17980 | 48484 | 78988, 109492, 139996, 170500, 201004 | 10132 | AHC60650 | 24163 | 54667 | 85171, 115675, 146179, 176683, 207187 |
| 3950 | ADB89454 | 17981 | 48485 | 78989, 109493, 139997, 170501, 201005 | 10133 | AHC60662 | 24164 | 54668 | 85172, 115676, 146180, 176684, 207188 |
| 3951 | ADB89464 | 17982 | 48486 | 78990, 109494, 139998, 170502, 201006 | 10134 | AHC60674 | 24165 | 54669 | 85173, 115677, 146181, 176685, 207189 |
| 3952 | ADB89484 | 17983 | 48487 | 78991, 109495, 139999, 170503, 201007 | 10135 | AHC60686 | 24166 | 54670 | 85174, 115678, 146182, 176686, 207190 |
| 3953 | ADB89494 | 17984 | 48488 | 78992, 109496, 140000, 170504, 201008 | 10136 | AHC60698 | 24167 | 54671 | 85175, 115679, 146183, 176687, 207191 |

FIG. 3 continued

| | | | | | | | | | |
|---|---|---|---|---|---|---|---|---|---|
| 3954 | ADB89504 | 17985 | 48489 | 78993, 109497, 140001, 170505, 201009 | 10137 | AHC60710 | 24168 | 54672 | 85176, 115680, 146184, 176688, 207192 |
| 3955 | ADB89514 | 17986 | 48490 | 78994, 109498, 140002, 170506, 201010 | 10138 | AHC60722 | 24169 | 54673 | 85177, 115681, 146185, 176689, 207193 |
| 3956 | ADB89524 | 17987 | 48491 | 78995, 109499, 140003, 170507, 201011 | 10139 | AHC60734 | 24170 | 54674 | 85178, 115682, 146186, 176690, 207194 |
| 3957 | ADB89544 | 17988 | 48492 | 78996, 109500, 140004, 170508, 201012 | 10140 | AHC60746 | 24171 | 54675 | 85179, 115683, 146187, 176691, 207195 |
| 3958 | ADB89564 | 17989 | 48493 | 78997, 109501, 140005, 170509, 201013 | 10141 | AHC60770 | 24172 | 54676 | 85180, 115684, 146188, 176692, 207196 |
| 3959 | ADB89574 | 17990 | 48494 | 78998, 109502, 140006, 170510, 201014 | 10142 | AHC60782 | 24173 | 54677 | 85181, 115685, 146189, 176693, 207197 |
| 3960 | ADB89594 | 17991 | 48495 | 78999, 109503, 140007, 170511, 201015 | 10143 | AHC60794 | 24174 | 54678 | 85182, 115686, 146190, 176694, 207198 |
| 3961 | ADB89604 | 17992 | 48496 | 79000, 109504, 140008, 170512, 201016 | 10144 | AHC60806 | 24175 | 54679 | 85183, 115687, 146191, 176695, 207199 |
| 3962 | ADB89614 | 17993 | 48497 | 79001, 109505, 140009, 170513, 201017 | 10145 | AHC60818 | 24176 | 54680 | 85184, 115688, 146192, 176696, 207200 |
| 3963 | ADB89624 | 17994 | 48498 | 79002, 109506, 140010, 170514, 201018 | 10146 | AHC60830 | 24177 | 54681 | 85185, 115689, 146193, 176697, 207201 |
| 3964 | ADB89634 | 17995 | 48499 | 79003, 109507, 140011, 170515, 201019 | 10147 | AHC60842 | 24178 | 54682 | 85186, 115690, 146194, 176698, 207202 |
| 3965 | ADB89644 | 17996 | 48500 | 79004, 109508, 140012, 170516, 201020 | 10148 | AHC60854 | 24179 | 54683 | 85187, 115691, 146195, 176699, 207203 |
| 3966 | ADB89664 | 17997 | 48501 | 79005, 109509, 140013, 170517, 201021 | 10149 | AHC60866 | 24180 | 54684 | 85188, 115692, 146196, 176700, 207204 |
| 3967 | ADB89674 | 17998 | 48502 | 79006, 109510, 140014, 170518, 201022 | 10150 | AHC60878 | 24181 | 54685 | 85189, 115693, 146197, 176701, 207205 |
| 3968 | ADB89684 | 17999 | 48503 | 79007, 109511, 140015, 170519, 201023 | 10151 | AHC60890 | 24182 | 54686 | 85190, 115694, 146198, 176702, 207206 |
| 3969 | ADB89694 | 18000 | 48504 | 79008, 109512, 140016, 170520, 201024 | 10152 | AHC60902 | 24183 | 54687 | 85191, 115695, 146199, 176703, 207207 |
| 3970 | ADB89704 | 18001 | 48505 | 79009, 109513, 140017, 170521, 201025 | 10153 | AHC60914 | 24184 | 54688 | 85192, 115696, 146200, 176704, 207208 |
| 3971 | ADB89714 | 18002 | 48506 | 79010, 109514, 140018, 170522, 201026 | 10154 | AHC60926 | 24185 | 54689 | 85193, 115697, 146201, 176705, 207209 |

FIG. 3 continued

| | | | | | | | | | |
|---|---|---|---|---|---|---|---|---|---|
| 3972 | ADB89724 | 18003 | 48507 | 79011, 109515, 140019, 170523, 201027 | 10155 | AHC60938 | 24186 | 54690 | 85194, 115698, 146202, 176706, 207210 |
| 3973 | ADB89735 | 18004 | 48508 | 79012, 109516, 140020, 170524, 201028 | 10156 | AHC60950 | 24187 | 54691 | 85195, 115699, 146203, 176707, 207211 |
| 3974 | ADB90357 | 18005 | 48509 | 79013, 109517, 140021, 170525, 201029 | 10157 | AHC60962 | 24188 | 54692 | 85196, 115700, 146204, 176708, 207212 |
| 3975 | ADB90358 | 18006 | 48510 | 79014, 109518, 140022, 170526, 201030 | 10158 | AHC60974 | 24189 | 54693 | 85197, 115701, 146205, 176709, 207213 |
| 3976 | ADB90359 | 18007 | 48511 | 79015, 109519, 140023, 170527, 201031 | 10159 | AHC60986 | 24190 | 54694 | 85198, 115702, 146206, 176710, 207214 |
| 3977 | ADB90363 | 18008 | 48512 | 79016, 109520, 140024, 170528, 201032 | 10160 | AHC60998 | 24191 | 54695 | 85199, 115703, 146207, 176711, 207215 |
| 3978 | ADB90373 | 18009 | 48513 | 79017, 109521, 140025, 170529, 201033 | 10161 | AHC61010 | 24192 | 54696 | 85200, 115704, 146208, 176712, 207216 |
| 3979 | ADB98137 | 18010 | 48514 | 79018, 109522, 140026, 170530, 201034 | 10162 | AHC61022 | 24193 | 54697 | 85201, 115705, 146209, 176713, 207217 |
| 3980 | ADB98138 | 18011 | 48515 | 79019, 109523, 140027, 170531, 201035 | 10163 | AHC61034 | 24194 | 54698 | 85202, 115706, 146210, 176714, 207218 |
| 3981 | ADB98139 | 18012 | 48516 | 79020, 109524, 140028, 170532, 201036 | 10164 | AHC61046 | 24195 | 54699 | 85203, 115707, 146211, 176715, 207219 |
| 3982 | ADB98140 | 18013 | 48517 | 79021, 109525, 140029, 170533, 201037 | 10165 | AHC61058 | 24196 | 54700 | 85204, 115708, 146212, 176716, 207220 |
| 3983 | ADB98141 | 18014 | 48518 | 79022, 109526, 140030, 170534, 201038 | 10166 | AHC61070 | 24197 | 54701 | 85205, 115709, 146213, 176717, 207221 |
| 3984 | ADC32391 | 18015 | 48519 | 79023, 109527, 140031, 170535, 201039 | 10167 | AHC61082 | 24198 | 54702 | 85206, 115710, 146214, 176718, 207222 |
| 3985 | ADC32392 | 18016 | 48520 | 79024, 109528, 140032, 170536, 201040 | 10168 | AHC61094 | 24199 | 54703 | 85207, 115711, 146215, 176719, 207223 |
| 3986 | ADC32393 | 18017 | 48521 | 79025, 109529, 140033, 170537, 201041 | 10169 | AHC61106 | 24200 | 54704 | 85208, 115712, 146216, 176720, 207224 |
| 3987 | ADC32394 | 18018 | 48522 | 79026, 109530, 140034, 170538, 201042 | 10170 | AHC61118 | 24201 | 54705 | 85209, 115713, 146217, 176721, 207225 |
| 3988 | ADC32395 | 18019 | 48523 | 79027, 109531, 140035, 170539, 201043 | 10171 | AHC61130 | 24202 | 54706 | 85210, 115714, 146218, 176722, 207226 |
| 3989 | ADC32396 | 18020 | 48524 | 79028, 109532, 140036, 170540, 201044 | 10172 | AHC61142 | 24203 | 54707 | 85211, 115715, 146219, 176723, 207227 |

FIG. 3 continued

| | | | | | | | | | |
|---|---|---|---|---|---|---|---|---|---|
| 3990 | ADC32397 | 18021 | 48525 | 79029, 109533, 140037, 170541, 201045 | 10173 | AHC61154 | 24204 | 54708 | 85212, 115716, 146220, 176724, 207228 |
| 3991 | ADC32398 | 18022 | 48526 | 79030, 109534, 140038, 170542, 201046 | 10174 | AHC61166 | 24205 | 54709 | 85213, 115717, 146221, 176725, 207229 |
| 3992 | ADC32399 | 18023 | 48527 | 79031, 109535, 140039, 170543, 201047 | 10175 | AHC61178 | 24206 | 54710 | 85214, 115718, 146222, 176726, 207230 |
| 3993 | ADC32400 | 18024 | 48528 | 79032, 109536, 140040, 170544, 201048 | 10176 | AHC61190 | 24207 | 54711 | 85215, 115719, 146223, 176727, 207231 |
| 3994 | ADC32401 | 18025 | 48529 | 79033, 109537, 140041, 170545, 201049 | 10177 | AHC61202 | 24208 | 54712 | 85216, 115720, 146224, 176728, 207232 |
| 3995 | ADC32404 | 18026 | 48530 | 79034, 109538, 140042, 170546, 201050 | 10178 | AHC61214 | 24209 | 54713 | 85217, 115721, 146225, 176729, 207233 |
| 3996 | ADC32407 | 18027 | 48531 | 79035, 109539, 140043, 170547, 201051 | 10179 | AHC61226 | 24210 | 54714 | 85218, 115722, 146226, 176730, 207234 |
| 3997 | ADC34942 | 18028 | 48532 | 79036, 109540, 140044, 170548, 201052 | 10180 | AHC61238 | 24211 | 54715 | 85219, 115723, 146227, 176731, 207235 |
| 3998 | ADC39000 | 18029 | 48533 | 79037, 109541, 140045, 170549, 201053 | 10181 | AHC61250 | 24212 | 54716 | 85220, 115724, 146228, 176732, 207236 |
| 3999 | ADC39010 | 18030 | 48534 | 79038, 109542, 140046, 170550, 201054 | 10182 | AHC61262 | 24213 | 54717 | 85221, 115725, 146229, 176733, 207237 |
| 4000 | ADC45606 | 18031 | 48535 | 79039, 109543, 140047, 170551, 201055 | 10183 | AHC61274 | 24214 | 54718 | 85222, 115726, 146230, 176734, 207238 |
| 4001 | ADC45628 | 18032 | 48536 | 79040, 109544, 140048, 170552, 201056 | 10184 | AHC61286 | 24215 | 54719 | 85223, 115727, 146231, 176735, 207239 |
| 4002 | ADC45639 | 18033 | 48537 | 79041, 109545, 140049, 170553, 201057 | 10185 | AHC61298 | 24216 | 54720 | 85224, 115728, 146232, 176736, 207240 |
| 4003 | ADC45650 | 18034 | 48538 | 79042, 109546, 140050, 170554, 201058 | 10186 | AHC61310 | 24217 | 54721 | 85225, 115729, 146233, 176737, 207241 |
| 4004 | ADC45661 | 18035 | 48539 | 79043, 109547, 140051, 170555, 201059 | 10187 | AHC61322 | 24218 | 54722 | 85226, 115730, 146234, 176738, 207242 |
| 4005 | ADC45683 | 18036 | 48540 | 79044, 109548, 140052, 170556, 201060 | 10188 | AHC61334 | 24219 | 54723 | 85227, 115731, 146235, 176739, 207243 |
| 4006 | ADC45705 | 18037 | 48541 | 79045, 109549, 140053, 170557, 201061 | 10189 | AHC61346 | 24220 | 54724 | 85228, 115732, 146236, 176740, 207244 |
| 4007 | ADC45716 | 18038 | 48542 | 79046, 109550, 140054, 170558, 201062 | 10190 | AHC61358 | 24221 | 54725 | 85229, 115733, 146237, 176741, 207245 |

FIG. 3 continued

| | | | | | | | | | |
|---|---|---|---|---|---|---|---|---|---|
| 4008 | ADC45738 | 18039 | 48543 | 79047, 109551, 140055, 170559, 201063 | 10191 | AHC61370 | 24222 | 54726 | 85230, 115734, 146238, 176742, 207246 |
| 4009 | ADC45760 | 18040 | 48544 | 79048, 109552, 140056, 170560, 201064 | 10192 | AHC61382 | 24223 | 54727 | 85231, 115735, 146239, 176743, 207247 |
| 4010 | ADC45771 | 18041 | 48545 | 79049, 109553, 140057, 170561, 201065 | 10193 | AHC61394 | 24224 | 54728 | 85232, 115736, 146240, 176744, 207248 |
| 4011 | ADC45782 | 18042 | 48546 | 79050, 109554, 140058, 170562, 201066 | 10194 | AHC61406 | 24225 | 54729 | 85233, 115737, 146241, 176745, 207249 |
| 4012 | ADC45804 | 18043 | 48547 | 79051, 109555, 140059, 170563, 201067 | 10195 | AHC61418 | 24226 | 54730 | 85234, 115738, 146242, 176746, 207250 |
| 4013 | ADC45815 | 18044 | 48548 | 79052, 109556, 140060, 170564, 201068 | 10196 | AHC61430 | 24227 | 54731 | 85235, 115739, 146243, 176747, 207251 |
| 4014 | ADC45837 | 18045 | 48549 | 79053, 109557, 140061, 170565, 201069 | 10197 | AHC61442 | 24228 | 54732 | 85236, 115740, 146244, 176748, 207252 |
| 4015 | ADC45848 | 18046 | 48550 | 79054, 109558, 140062, 170566, 201070 | 10198 | AHC61454 | 24229 | 54733 | 85237, 115741, 146245, 176749, 207253 |
| 4016 | ADC53559 | 18047 | 48551 | 79055, 109559, 140063, 170567, 201071 | 10199 | AHC61466 | 24230 | 54734 | 85238, 115742, 146246, 176750, 207254 |
| 4017 | ADD14088 | 18048 | 48552 | 79056, 109560, 140064, 170568, 201072 | 10200 | AHC61478 | 24231 | 54735 | 85239, 115743, 146247, 176751, 207255 |
| 4018 | ADD14090 | 18049 | 48553 | 79057, 109561, 140065, 170569, 201073 | 10201 | AHC61490 | 24232 | 54736 | 85240, 115744, 146248, 176752, 207256 |
| 4019 | ADD14094 | 18050 | 48554 | 79058, 109562, 140066, 170570, 201074 | 10202 | AHC61502 | 24233 | 54737 | 85241, 115745, 146249, 176753, 207257 |
| 4020 | ADD14096 | 18051 | 48555 | 79059, 109563, 140067, 170571, 201075 | 10203 | AHC61514 | 24234 | 54738 | 85242, 115746, 146250, 176754, 207258 |
| 4021 | ADD14098 | 18052 | 48556 | 79060, 109564, 140068, 170572, 201076 | 10204 | AHC61526 | 24235 | 54739 | 85243, 115747, 146251, 176755, 207259 |
| 4022 | ADD14100 | 18053 | 48557 | 79061, 109565, 140069, 170573, 201077 | 10205 | AHC61538 | 24236 | 54740 | 85244, 115748, 146252, 176756, 207260 |
| 4023 | ADD14102 | 18054 | 48558 | 79062, 109566, 140070, 170574, 201078 | 10206 | AHC61550 | 24237 | 54741 | 85245, 115749, 146253, 176757, 207261 |
| 4024 | ADD14104 | 18055 | 48559 | 79063, 109567, 140071, 170575, 201079 | 10207 | AHC61562 | 24238 | 54742 | 85246, 115750, 146254, 176758, 207262 |
| 4025 | ADD14106 | 18056 | 48560 | 79064, 109568, 140072, 170576, 201080 | 10208 | AHC61574 | 24239 | 54743 | 85247, 115751, 146255, 176759, 207263 |

FIG. 3 continued

| | | | | | | | | | |
|---|---|---|---|---|---|---|---|---|---|
| 4026 | ADD14110 | 18057 | 48561 | 79065, 109569, 140073, 170577, 201081 | 10209 | AHC61586 | 24240 | 54744 | 85248, 115752, 146256, 176760, 207264 |
| 4027 | ADD14112 | 18058 | 48562 | 79066, 109570, 140074, 170578, 201082 | 10210 | AHC61598 | 24241 | 54745 | 85249, 115753, 146257, 176761, 207265 |
| 4028 | ADD14114 | 18059 | 48563 | 79067, 109571, 140075, 170579, 201083 | 10211 | AHC61610 | 24242 | 54746 | 85250, 115754, 146258, 176762, 207266 |
| 4029 | ADD14116 | 18060 | 48564 | 79068, 109572, 140076, 170580, 201084 | 10212 | AHC61622 | 24243 | 54747 | 85251, 115755, 146259, 176763, 207267 |
| 4030 | ADD14118 | 18061 | 48565 | 79069, 109573, 140077, 170581, 201085 | 10213 | AHC61634 | 24244 | 54748 | 85252, 115756, 146260, 176764, 207268 |
| 4031 | ADD14120 | 18062 | 48566 | 79070, 109574, 140078, 170582, 201086 | 10214 | AHC61646 | 24245 | 54749 | 85253, 115757, 146261, 176765, 207269 |
| 4032 | ADD14122 | 18063 | 48567 | 79071, 109575, 140079, 170583, 201087 | 10215 | AHC61658 | 24246 | 54750 | 85254, 115758, 146262, 176766, 207270 |
| 4033 | ADD14124 | 18064 | 48568 | 79072, 109576, 140080, 170584, 201088 | 10216 | AHC61670 | 24247 | 54751 | 85255, 115759, 146263, 176767, 207271 |
| 4034 | ADD14126 | 18065 | 48569 | 79073, 109577, 140081, 170585, 201089 | 10217 | AHC61682 | 24248 | 54752 | 85256, 115760, 146264, 176768, 207272 |
| 4035 | ADD14128 | 18066 | 48570 | 79074, 109578, 140082, 170586, 201090 | 10218 | AHC61694 | 24249 | 54753 | 85257, 115761, 146265, 176769, 207273 |
| 4036 | ADD14130 | 18067 | 48571 | 79075, 109579, 140083, 170587, 201091 | 10219 | AHC61706 | 24250 | 54754 | 85258, 115762, 146266, 176770, 207274 |
| 4037 | ADD14132 | 18068 | 48572 | 79076, 109580, 140084, 170588, 201092 | 10220 | AHC61718 | 24251 | 54755 | 85259, 115763, 146267, 176771, 207275 |
| 4038 | ADD14134 | 18069 | 48573 | 79077, 109581, 140085, 170589, 201093 | 10221 | AHC61730 | 24252 | 54756 | 85260, 115764, 146268, 176772, 207276 |
| 4039 | ADD14136 | 18070 | 48574 | 79078, 109582, 140086, 170590, 201094 | 10222 | AHC61742 | 24253 | 54757 | 85261, 115765, 146269, 176773, 207277 |
| 4040 | ADD14138 | 18071 | 48575 | 79079, 109583, 140087, 170591, 201095 | 10223 | AHC61754 | 24254 | 54758 | 85262, 115766, 146270, 176774, 207278 |
| 4041 | ADD14142 | 18072 | 48576 | 79080, 109584, 140088, 170592, 201096 | 10224 | AHC61766 | 24255 | 54759 | 85263, 115767, 146271, 176775, 207279 |
| 4042 | ADD14144 | 18073 | 48577 | 79081, 109585, 140089, 170593, 201097 | 10225 | AHC61778 | 24256 | 54760 | 85264, 115768, 146272, 176776, 207280 |
| 4043 | ADD14146 | 18074 | 48578 | 79082, 109586, 140090, 170594, 201098 | 10226 | AHC61790 | 24257 | 54761 | 85265, 115769, 146273, 176777, 207281 |

FIG. 3 continued

| | | | | | | | | | |
|---|---|---|---|---|---|---|---|---|---|
| 4044 | ADD14148 | 18075 | 48579 | 79083, 109587, 140091, 170595, 201099 | 10227 | AHC61802 | 24258 | 54762 | 85266, 115770, 146274, 176778, 207282 |
| 4045 | ADD14150 | 18076 | 48580 | 79084, 109588, 140092, 170596, 201100 | 10228 | AHC61814 | 24259 | 54763 | 85267, 115771, 146275, 176779, 207283 |
| 4046 | ADD14152 | 18077 | 48581 | 79085, 109589, 140093, 170597, 201101 | 10229 | AHC61826 | 24260 | 54764 | 85268, 115772, 146276, 176780, 207284 |
| 4047 | ADD14154 | 18078 | 48582 | 79086, 109590, 140094, 170598, 201102 | 10230 | AHC61838 | 24261 | 54765 | 85269, 115773, 146277, 176781, 207285 |
| 4048 | ADD14156 | 18079 | 48583 | 79087, 109591, 140095, 170599, 201103 | 10231 | AHC61850 | 24262 | 54766 | 85270, 115774, 146278, 176782, 207286 |
| 4049 | ADD14158 | 18080 | 48584 | 79088, 109592, 140096, 170600, 201104 | 10232 | AHC61862 | 24263 | 54767 | 85271, 115775, 146279, 176783, 207287 |
| 4050 | ADD14164 | 18081 | 48585 | 79089, 109593, 140097, 170601, 201105 | 10233 | AHC61874 | 24264 | 54768 | 85272, 115776, 146280, 176784, 207288 |
| 4051 | ADD14174 | 18082 | 48586 | 79090, 109594, 140098, 170602, 201106 | 10234 | AHC61886 | 24265 | 54769 | 85273, 115777, 146281, 176785, 207289 |
| 4052 | ADD14184 | 18083 | 48587 | 79091, 109595, 140099, 170603, 201107 | 10235 | AHC61898 | 24266 | 54770 | 85274, 115778, 146282, 176786, 207290 |
| 4053 | ADD14194 | 18084 | 48588 | 79092, 109596, 140100, 170604, 201108 | 10236 | AHC61910 | 24267 | 54771 | 85275, 115779, 146283, 176787, 207291 |
| 4054 | ADD14204 | 18085 | 48589 | 79093, 109597, 140101, 170605, 201109 | 10237 | AHC61934 | 24268 | 54772 | 85276, 115780, 146284, 176788, 207292 |
| 4055 | ADD21449 | 18086 | 48590 | 79094, 109598, 140102, 170606, 201110 | 10238 | AHC61946 | 24269 | 54773 | 85277, 115781, 146285, 176789, 207293 |
| 4056 | ADD21469 | 18087 | 48591 | 79095, 109599, 140103, 170607, 201111 | 10239 | AHC61958 | 24270 | 54774 | 85278, 115782, 146286, 176790, 207294 |
| 4057 | ADD21747 | 18088 | 48592 | 79096, 109600, 140104, 170608, 201112 | 10240 | AHC61970 | 24271 | 54775 | 85279, 115783, 146287, 176791, 207295 |
| 4058 | ADD21767 | 18089 | 48593 | 79097, 109601, 140105, 170609, 201113 | 10241 | AHC61982 | 24272 | 54776 | 85280, 115784, 146288, 176792, 207296 |
| 4059 | ADD21777 | 18090 | 48594 | 79098, 109602, 140106, 170610, 201114 | 10242 | AHC61994 | 24273 | 54777 | 85281, 115785, 146289, 176793, 207297 |
| 4060 | ADD21787 | 18091 | 48595 | 79099, 109603, 140107, 170611, 201115 | 10243 | AHC62006 | 24274 | 54778 | 85282, 115786, 146290, 176794, 207298 |
| 4061 | ADD21797 | 18092 | 48596 | 79100, 109604, 140108, 170612, 201116 | 10244 | AHC62018 | 24275 | 54779 | 85283, 115787, 146291, 176795, 207299 |

FIG. 3 continued

| | | | | | | | | | |
|---|---|---|---|---|---|---|---|---|---|
| 4062 | ADD21817 | 18093 | 48597 | 79101, 109605, 140109, 170613, 201117 | 10245 | AHC62030 | 24276 | 54780 | 85284, 115788, 146292, 176796, 207300 |
| 4063 | ADD21827 | 18094 | 48598 | 79102, 109606, 140110, 170614, 201118 | 10246 | AHC62042 | 24277 | 54781 | 85285, 115789, 146293, 176797, 207301 |
| 4064 | ADD21837 | 18095 | 48599 | 79103, 109607, 140111, 170615, 201119 | 10247 | AHC62053 | 24278 | 54782 | 85286, 115790, 146294, 176798, 207302 |
| 4065 | ADD21847 | 18096 | 48600 | 79104, 109608, 140112, 170616, 201120 | 10248 | AHC62065 | 24279 | 54783 | 85287, 115791, 146295, 176799, 207303 |
| 4066 | ADD21857 | 18097 | 48601 | 79105, 109609, 140113, 170617, 201121 | 10249 | AHC62077 | 24280 | 54784 | 85288, 115792, 146296, 176800, 207304 |
| 4067 | ADD21867 | 18098 | 48602 | 79106, 109610, 140114, 170618, 201122 | 10250 | AHC62089 | 24281 | 54785 | 85289, 115793, 146297, 176801, 207305 |
| 4068 | ADD21877 | 18099 | 48603 | 79107, 109611, 140115, 170619, 201123 | 10251 | AHC62101 | 24282 | 54786 | 85290, 115794, 146298, 176802, 207306 |
| 4069 | ADD21897 | 18100 | 48604 | 79108, 109612, 140116, 170620, 201124 | 10252 | AHC62113 | 24283 | 54787 | 85291, 115795, 146299, 176803, 207307 |
| 4070 | ADD22494 | 18101 | 48605 | 79109, 109613, 140117, 170621, 201125 | 10253 | AHC62125 | 24284 | 54788 | 85292, 115796, 146300, 176804, 207308 |
| 4071 | ADD22504 | 18102 | 48606 | 79110, 109614, 140118, 170622, 201126 | 10254 | AHC62137 | 24285 | 54789 | 85293, 115797, 146301, 176805, 207309 |
| 4072 | ADD22514 | 18103 | 48607 | 79111, 109615, 140119, 170623, 201127 | 10255 | AHC62149 | 24286 | 54790 | 85294, 115798, 146302, 176806, 207310 |
| 4073 | ADD22524 | 18104 | 48608 | 79112, 109616, 140120, 170624, 201128 | 10256 | AHC62161 | 24287 | 54791 | 85295, 115799, 146303, 176807, 207311 |
| 4074 | ADD22534 | 18105 | 48609 | 79113, 109617, 140121, 170625, 201129 | 10257 | AHC62173 | 24288 | 54792 | 85296, 115800, 146304, 176808, 207312 |
| 4075 | ADD22544 | 18106 | 48610 | 79114, 109618, 140122, 170626, 201130 | 10258 | AHC62185 | 24289 | 54793 | 85297, 115801, 146305, 176809, 207313 |
| 4076 | ADD22557 | 18107 | 48611 | 79115, 109619, 140123, 170627, 201131 | 10259 | AHC62197 | 24290 | 54794 | 85298, 115802, 146306, 176810, 207314 |
| 4077 | ADD22567 | 18108 | 48612 | 79116, 109620, 140124, 170628, 201132 | 10260 | AHC62209 | 24291 | 54795 | 85299, 115803, 146307, 176811, 207315 |
| 4078 | ADD22577 | 18109 | 48613 | 79117, 109621, 140125, 170629, 201133 | 10261 | AHC62221 | 24292 | 54796 | 85300, 115804, 146308, 176812, 207316 |
| 4079 | ADD22587 | 18110 | 48614 | 79118, 109622, 140126, 170630, 201134 | 10262 | AHC62233 | 24293 | 54797 | 85301, 115805, 146309, 176813, 207317 |

FIG. 3 continued

| | | | | | | | | | |
|---|---|---|---|---|---|---|---|---|---|
| 4080 | ADD22597 | 18111 | 48615 | 79119, 109623, 140127, 170631, 201135 | 10263 | AHC62245 | 24294 | 54798 | 85302, 115806, 146310, 176814, 207318 |
| 4081 | ADD22617 | 18112 | 48616 | 79120, 109624, 140128, 170632, 201136 | 10264 | AHC62257 | 24295 | 54799 | 85303, 115807, 146311, 176815, 207319 |
| 4082 | ADD22627 | 18113 | 48617 | 79121, 109625, 140129, 170633, 201137 | 10265 | AHC62269 | 24296 | 54800 | 85304, 115808, 146312, 176816, 207320 |
| 4083 | ADD22637 | 18114 | 48618 | 79122, 109626, 140130, 170634, 201138 | 10266 | AHC62281 | 24297 | 54801 | 85305, 115809, 146313, 176817, 207321 |
| 4084 | ADD22648 | 18115 | 48619 | 79123, 109627, 140131, 170635, 201139 | 10267 | AHC62293 | 24298 | 54802 | 85306, 115810, 146314, 176818, 207322 |
| 4085 | ADD22658 | 18116 | 48620 | 79124, 109628, 140132, 170636, 201140 | 10268 | AHC62305 | 24299 | 54803 | 85307, 115811, 146315, 176819, 207323 |
| 4086 | ADD22668 | 18117 | 48621 | 79125, 109629, 140133, 170637, 201141 | 10269 | AHC62317 | 24300 | 54804 | 85308, 115812, 146316, 176820, 207324 |
| 4087 | ADD22688 | 18118 | 48622 | 79126, 109630, 140134, 170638, 201142 | 10270 | AHC62329 | 24301 | 54805 | 85309, 115813, 146317, 176821, 207325 |
| 4088 | ADD22698 | 18119 | 48623 | 79127, 109631, 140135, 170639, 201143 | 10271 | AHC62341 | 24302 | 54806 | 85310, 115814, 146318, 176822, 207326 |
| 4089 | ADD22725 | 18120 | 48624 | 79128, 109632, 140136, 170640, 201144 | 10272 | AHC62353 | 24303 | 54807 | 85311, 115815, 146319, 176823, 207327 |
| 4090 | ADD22735 | 18121 | 48625 | 79129, 109633, 140137, 170641, 201145 | 10273 | AHC62365 | 24304 | 54808 | 85312, 115816, 146320, 176824, 207328 |
| 4091 | ADD22745 | 18122 | 48626 | 79130, 109634, 140138, 170642, 201146 | 10274 | AHC62377 | 24305 | 54809 | 85313, 115817, 146321, 176825, 207329 |
| 4092 | ADD22755 | 18123 | 48627 | 79131, 109635, 140139, 170643, 201147 | 10275 | AHC62389 | 24306 | 54810 | 85314, 115818, 146322, 176826, 207330 |
| 4093 | ADD22765 | 18124 | 48628 | 79132, 109636, 140140, 170644, 201148 | 10276 | AHC62401 | 24307 | 54811 | 85315, 115819, 146323, 176827, 207331 |
| 4094 | ADD22775 | 18125 | 48629 | 79133, 109637, 140141, 170645, 201149 | 10277 | AHC62413 | 24308 | 54812 | 85316, 115820, 146324, 176828, 207332 |
| 4095 | ADD22785 | 18126 | 48630 | 79134, 109638, 140142, 170646, 201150 | 10278 | AHC62425 | 24309 | 54813 | 85317, 115821, 146325, 176829, 207333 |
| 4096 | ADD22795 | 18127 | 48631 | 79135, 109639, 140143, 170647, 201151 | 10279 | AHC62437 | 24310 | 54814 | 85318, 115822, 146326, 176830, 207334 |
| 4097 | ADD22805 | 18128 | 48632 | 79136, 109640, 140144, 170648, 201152 | 10280 | AHC62449 | 24311 | 54815 | 85319, 115823, 146327, 176831, 207335 |

FIG. 3 continued

| | | | | | | | | | |
|---|---|---|---|---|---|---|---|---|---|
| 4098 | ADD22815 | 18129 | 48633 | 79137, 109641, 140145, 170649, 201153 | 10281 | AHC62461 | 24312 | 54816 | 85320, 115824, 146328, 176832, 207336 |
| 4099 | ADD22825 | 18130 | 48634 | 79138, 109642, 140146, 170650, 201154 | 10282 | AHC62473 | 24313 | 54817 | 85321, 115825, 146329, 176833, 207337 |
| 4100 | ADD22835 | 18131 | 48635 | 79139, 109643, 140147, 170651, 201155 | 10283 | AHC62485 | 24314 | 54818 | 85322, 115826, 146330, 176834, 207338 |
| 4101 | ADD22845 | 18132 | 48636 | 79140, 109644, 140148, 170652, 201156 | 10284 | AHC62509 | 24315 | 54819 | 85323, 115827, 146331, 176835, 207339 |
| 4102 | ADD22855 | 18133 | 48637 | 79141, 109645, 140149, 170653, 201157 | 10285 | AHC62521 | 24316 | 54820 | 85324, 115828, 146332, 176836, 207340 |
| 4103 | ADD22924 | 18134 | 48638 | 79142, 109646, 140150, 170654, 201158 | 10286 | AHC62533 | 24317 | 54821 | 85325, 115829, 146333, 176837, 207341 |
| 4104 | ADD22934 | 18135 | 48639 | 79143, 109647, 140151, 170655, 201159 | 10287 | AHC62545 | 24318 | 54822 | 85326, 115830, 146334, 176838, 207342 |
| 4105 | ADD22944 | 18136 | 48640 | 79144, 109648, 140152, 170656, 201160 | 10288 | AHC62557 | 24319 | 54823 | 85327, 115831, 146335, 176839, 207343 |
| 4106 | ADD22954 | 18137 | 48641 | 79145, 109649, 140153, 170657, 201161 | 10289 | AHC62569 | 24320 | 54824 | 85328, 115832, 146336, 176840, 207344 |
| 4107 | ADD22974 | 18138 | 48642 | 79146, 109650, 140154, 170658, 201162 | 10290 | AHC62581 | 24321 | 54825 | 85329, 115833, 146337, 176841, 207345 |
| 4108 | ADD23075 | 18139 | 48643 | 79147, 109651, 140155, 170659, 201163 | 10291 | AHC62593 | 24322 | 54826 | 85330, 115834, 146338, 176842, 207346 |
| 4109 | ADD23085 | 18140 | 48644 | 79148, 109652, 140156, 170660, 201164 | 10292 | AHC62605 | 24323 | 54827 | 85331, 115835, 146339, 176843, 207347 |
| 4110 | ADD23095 | 18141 | 48645 | 79149, 109653, 140157, 170661, 201165 | 10293 | AHC62617 | 24324 | 54828 | 85332, 115836, 146340, 176844, 207348 |
| 4111 | ADD23105 | 18142 | 48646 | 79150, 109654, 140158, 170662, 201166 | 10294 | AHC62629 | 24325 | 54829 | 85333, 115837, 146341, 176845, 207349 |
| 4112 | ADD23115 | 18143 | 48647 | 79151, 109655, 140159, 170663, 201167 | 10295 | AHC62641 | 24326 | 54830 | 85334, 115838, 146342, 176846, 207350 |
| 4113 | ADD23125 | 18144 | 48648 | 79152, 109656, 140160, 170664, 201168 | 10296 | AHC62653 | 24327 | 54831 | 85335, 115839, 146343, 176847, 207351 |
| 4114 | ADD23135 | 18145 | 48649 | 79153, 109657, 140161, 170665, 201169 | 10297 | AHC62665 | 24328 | 54832 | 85336, 115840, 146344, 176848, 207352 |
| 4115 | ADD23145 | 18146 | 48650 | 79154, 109658, 140162, 170666, 201170 | 10298 | AHC62677 | 24329 | 54833 | 85337, 115841, 146345, 176849, 207353 |

FIG. 3 continued

| | | | | | | | | | |
|---|---|---|---|---|---|---|---|---|---|
| 4116 | ADD23155 | 18147 | 48651 | 79155, 109659, 140163, 170667, 201171 | 10299 | AHF20560 | 24330 | 54834 | 85338, 115842, 146346, 176850, 207354 |
| 4117 | ADD23165 | 18148 | 48652 | 79156, 109660, 140164, 170668, 201172 | 10300 | AHF20570 | 24331 | 54835 | 85339, 115843, 146347, 176851, 207355 |
| 4118 | ADD23175 | 18149 | 48653 | 79157, 109661, 140165, 170669, 201173 | 10301 | AHG96111 | 24332 | 54836 | 85340, 115844, 146348, 176852, 207356 |
| 4119 | ADD23185 | 18150 | 48654 | 79158, 109662, 140166, 170670, 201174 | 10302 | AHG96123 | 24333 | 54837 | 85341, 115845, 146349, 176853, 207357 |
| 4120 | ADD23195 | 18151 | 48655 | 79159, 109663, 140167, 170671, 201175 | 10303 | AHG96135 | 24334 | 54838 | 85342, 115846, 146350, 176854, 207358 |
| 4121 | ADD23223 | 18152 | 48656 | 79160, 109664, 140168, 170672, 201176 | 10304 | AHG96147 | 24335 | 54839 | 85343, 115847, 146351, 176855, 207359 |
| 4122 | ADD23233 | 18153 | 48657 | 79161, 109665, 140169, 170673, 201177 | 10305 | AHG96159 | 24336 | 54840 | 85344, 115848, 146352, 176856, 207360 |
| 4123 | ADD23243 | 18154 | 48658 | 79162, 109666, 140170, 170674, 201178 | 10306 | AHG96171 | 24337 | 54841 | 85345, 115849, 146353, 176857, 207361 |
| 4124 | ADD23253 | 18155 | 48659 | 79163, 109667, 140171, 170675, 201179 | 10307 | AHG96183 | 24338 | 54842 | 85346, 115850, 146354, 176858, 207362 |
| 4125 | ADD23273 | 18156 | 48660 | 79164, 109668, 140172, 170676, 201180 | 10308 | AHG96195 | 24339 | 54843 | 85347, 115851, 146355, 176859, 207363 |
| 4126 | ADD23283 | 18157 | 48661 | 79165, 109669, 140173, 170677, 201181 | 10309 | AHG96207 | 24340 | 54844 | 85348, 115852, 146356, 176860, 207364 |
| 4127 | ADD23293 | 18158 | 48662 | 79166, 109670, 140174, 170678, 201182 | 10310 | AHG96219 | 24341 | 54845 | 85349, 115853, 146357, 176861, 207365 |
| 4128 | ADD23303 | 18159 | 48663 | 79167, 109671, 140175, 170679, 201183 | 10311 | AHG96231 | 24342 | 54846 | 85350, 115854, 146358, 176862, 207366 |
| 4129 | ADD23313 | 18160 | 48664 | 79168, 109672, 140176, 170680, 201184 | 10312 | AHG96243 | 24343 | 54847 | 85351, 115855, 146359, 176863, 207367 |
| 4130 | ADD23323 | 18161 | 48665 | 79169, 109673, 140177, 170681, 201185 | 10313 | AHG96255 | 24344 | 54848 | 85352, 115856, 146360, 176864, 207368 |
| 4131 | ADD23333 | 18162 | 48666 | 79170, 109674, 140178, 170682, 201186 | 10314 | AHG96267 | 24345 | 54849 | 85353, 115857, 146361, 176865, 207369 |
| 4132 | ADD23358 | 18163 | 48667 | 79171, 109675, 140179, 170683, 201187 | 10315 | AHG96279 | 24346 | 54850 | 85354, 115858, 146362, 176866, 207370 |
| 4133 | ADD23368 | 18164 | 48668 | 79172, 109676, 140180, 170684, 201188 | 10316 | AHG96291 | 24347 | 54851 | 85355, 115859, 146363, 176867, 207371 |

FIG. 3 continued

| | | | | | | | | | |
|---|---|---|---|---|---|---|---|---|---|
| 4134 | ADD23378 | 18165 | 48669 | 79173, 109677, 140181, 170685, 201189 | 10317 | AHG96303 | 24348 | 54852 | 85356, 115860, 146364, 176868, 207372 |
| 4135 | ADD23388 | 18166 | 48670 | 79174, 109678, 140182, 170686, 201190 | 10318 | AHG96362 | 24349 | 54853 | 85357, 115861, 146365, 176869, 207373 |
| 4136 | ADD23398 | 18167 | 48671 | 79175, 109679, 140183, 170687, 201191 | 10319 | AHG96374 | 24350 | 54854 | 85358, 115862, 146366, 176870, 207374 |
| 4137 | ADD23408 | 18168 | 48672 | 79176, 109680, 140184, 170688, 201192 | 10320 | AHG96386 | 24351 | 54855 | 85359, 115863, 146367, 176871, 207375 |
| 4138 | ADD23438 | 18169 | 48673 | 79177, 109681, 140185, 170689, 201193 | 10321 | AHG96398 | 24352 | 54856 | 85360, 115864, 146368, 176872, 207376 |
| 4139 | ADD23448 | 18170 | 48674 | 79178, 109682, 140186, 170690, 201194 | 10322 | AHG96410 | 24353 | 54857 | 85361, 115865, 146369, 176873, 207377 |
| 4140 | ADD23458 | 18171 | 48675 | 79179, 109683, 140187, 170691, 201195 | 10323 | AHG96422 | 24354 | 54858 | 85362, 115866, 146370, 176874, 207378 |
| 4141 | ADD23468 | 18172 | 48676 | 79180, 109684, 140188, 170692, 201196 | 10324 | AHG96434 | 24355 | 54859 | 85363, 115867, 146371, 176875, 207379 |
| 4142 | ADD23478 | 18173 | 48677 | 79181, 109685, 140189, 170693, 201197 | 10325 | AHG96446 | 24356 | 54860 | 85364, 115868, 146372, 176876, 207380 |
| 4143 | ADD23488 | 18174 | 48678 | 79182, 109686, 140190, 170694, 201198 | 10326 | AHG96458 | 24357 | 54861 | 85365, 115869, 146373, 176877, 207381 |
| 4144 | ADD23498 | 18175 | 48679 | 79183, 109687, 140191, 170695, 201199 | 10327 | AHG96470 | 24358 | 54862 | 85366, 115870, 146374, 176878, 207382 |
| 4145 | ADD23508 | 18176 | 48680 | 79184, 109688, 140192, 170696, 201200 | 10328 | AHG96482 | 24359 | 54863 | 85367, 115871, 146375, 176879, 207383 |
| 4146 | ADD23518 | 18177 | 48681 | 79185, 109689, 140193, 170697, 201201 | 10329 | AHG96494 | 24360 | 54864 | 85368, 115872, 146376, 176880, 207384 |
| 4147 | ADD23997 | 18178 | 48682 | 79186, 109690, 140194, 170698, 201202 | 10330 | AHG96506 | 24361 | 54865 | 85369, 115873, 146377, 176881, 207385 |
| 4148 | ADD24007 | 18179 | 48683 | 79187, 109691, 140195, 170699, 201203 | 10331 | AHG96518 | 24362 | 54866 | 85370, 115874, 146378, 176882, 207386 |
| 4149 | ADD24017 | 18180 | 48684 | 79188, 109692, 140196, 170700, 201204 | 10332 | AHG96530 | 24363 | 54867 | 85371, 115875, 146379, 176883, 207387 |
| 4150 | ADD24024 | 18181 | 48685 | 79189, 109693, 140197, 170701, 201205 | 10333 | AHG96542 | 24364 | 54868 | 85372, 115876, 146380, 176884, 207388 |
| 4151 | ADD24025 | 18182 | 48686 | 79190, 109694, 140198, 170702, 201206 | 10334 | AHG96554 | 24365 | 54869 | 85373, 115877, 146381, 176885, 207389 |

FIG. 3 continued

| | | | | | | | | | |
|---|---|---|---|---|---|---|---|---|---|
| 4152 | ADD24026 | 18183 | 48687 | 79191, 109695, 140199, 170703, 201207 | 10335 | AHG96566 | 24366 | 54870 | 85374, 115878, 146382, 176886, 207390 |
| 4153 | ADD24027 | 18184 | 48688 | 79192, 109696, 140200, 170704, 201208 | 10336 | AHG96578 | 24367 | 54871 | 85375, 115879, 146383, 176887, 207391 |
| 4154 | ADD24028 | 18185 | 48689 | 79193, 109697, 140201, 170705, 201209 | 10337 | AHG96590 | 24368 | 54872 | 85376, 115880, 146384, 176888, 207392 |
| 4155 | ADD24029 | 18186 | 48690 | 79194, 109698, 140202, 170706, 201210 | 10338 | AHG96602 | 24369 | 54873 | 85377, 115881, 146385, 176889, 207393 |
| 4156 | ADD24030 | 18187 | 48691 | 79195, 109699, 140203, 170707, 201211 | 10339 | AHG96614 | 24370 | 54874 | 85378, 115882, 146386, 176890, 207394 |
| 4157 | ADD24031 | 18188 | 48692 | 79196, 109700, 140204, 170708, 201212 | 10340 | AHG96626 | 24371 | 54875 | 85379, 115883, 146387, 176891, 207395 |
| 4158 | ADD24032 | 18189 | 48693 | 79197, 109701, 140205, 170709, 201213 | 10341 | AHG96638 | 24372 | 54876 | 85380, 115884, 146388, 176892, 207396 |
| 4159 | ADD25231 | 18190 | 48694 | 79198, 109702, 140206, 170710, 201214 | 10342 | AHG96650 | 24373 | 54877 | 85381, 115885, 146389, 176893, 207397 |
| 4160 | ADD25233 | 18191 | 48695 | 79199, 109703, 140207, 170711, 201215 | 10343 | AHG96662 | 24374 | 54878 | 85382, 115886, 146390, 176894, 207398 |
| 4161 | ADD25235 | 18192 | 48696 | 79200, 109704, 140208, 170712, 201216 | 10344 | AHG96674 | 24375 | 54879 | 85383, 115887, 146391, 176895, 207399 |
| 4162 | ADD25244 | 18193 | 48697 | 79201, 109705, 140209, 170713, 201217 | 10345 | AHG96686 | 24376 | 54880 | 85384, 115888, 146392, 176896, 207400 |
| 4163 | ADD25246 | 18194 | 48698 | 79202, 109706, 140210, 170714, 201218 | 10346 | AHG96698 | 24377 | 54881 | 85385, 115889, 146393, 176897, 207401 |
| 4164 | ADD25248 | 18195 | 48699 | 79203, 109707, 140211, 170715, 201219 | 10347 | AHG96710 | 24378 | 54882 | 85386, 115890, 146394, 176898, 207402 |
| 4165 | ADD25250 | 18196 | 48700 | 79204, 109708, 140212, 170716, 201220 | 10348 | AHG96722 | 24379 | 54883 | 85387, 115891, 146395, 176899, 207403 |
| 4166 | ADD25255 | 18197 | 48701 | 79205, 109709, 140213, 170717, 201221 | 10349 | AHG96734 | 24380 | 54884 | 85388, 115892, 146396, 176900, 207404 |
| 4167 | ADD25259 | 18198 | 48702 | 79206, 109710, 140214, 170718, 201222 | 10350 | AHG96746 | 24381 | 54885 | 85389, 115893, 146397, 176901, 207405 |
| 4168 | ADD25262 | 18199 | 48703 | 79207, 109711, 140215, 170719, 201223 | 10351 | AHG96758 | 24382 | 54886 | 85390, 115894, 146398, 176902, 207406 |
| 4169 | ADD25266 | 18200 | 48704 | 79208, 109712, 140216, 170720, 201224 | 10352 | AHG96770 | 24383 | 54887 | 85391, 115895, 146399, 176903, 207407 |

FIG. 3 continued

| | | | | | | | | | |
|---|---|---|---|---|---|---|---|---|---|
| 4170 | ADD25268 | 18201 | 48705 | 79209, 109713, 140217, 170721, 201225 | 10353 | AHG96782 | 24384 | 54888 | 85392, 115896, 146400, 176904, 207408 |
| 4171 | ADD25271 | 18202 | 48706 | 79210, 109714, 140218, 170722, 201226 | 10354 | AHG96794 | 24385 | 54889 | 85393, 115897, 146401, 176905, 207409 |
| 4172 | ADD25274 | 18203 | 48707 | 79211, 109715, 140219, 170723, 201227 | 10355 | AHG96806 | 24386 | 54890 | 85394, 115898, 146402, 176906, 207410 |
| 4173 | ADD25276 | 18204 | 48708 | 79212, 109716, 140220, 170724, 201228 | 10356 | AHG96818 | 24387 | 54891 | 85395, 115899, 146403, 176907, 207411 |
| 4174 | ADD25278 | 18205 | 48709 | 79213, 109717, 140221, 170725, 201229 | 10357 | AHG96830 | 24388 | 54892 | 85396, 115900, 146404, 176908, 207412 |
| 4175 | ADD25280 | 18206 | 48710 | 79214, 109718, 140222, 170726, 201230 | 10358 | AHG96842 | 24389 | 54893 | 85397, 115901, 146405, 176909, 207413 |
| 4176 | ADD25282 | 18207 | 48711 | 79215, 109719, 140223, 170727, 201231 | 10359 | AHG96854 | 24390 | 54894 | 85398, 115902, 146406, 176910, 207414 |
| 4177 | ADD25284 | 18208 | 48712 | 79216, 109720, 140224, 170728, 201232 | 10360 | AHG96866 | 24391 | 54895 | 85399, 115903, 146407, 176911, 207415 |
| 4178 | ADD25287 | 18209 | 48713 | 79217, 109721, 140225, 170729, 201233 | 10361 | AHG96878 | 24392 | 54896 | 85400, 115904, 146408, 176912, 207416 |
| 4179 | ADD25291 | 18210 | 48714 | 79218, 109722, 140226, 170730, 201234 | 10362 | AHG96890 | 24393 | 54897 | 85401, 115905, 146409, 176913, 207417 |
| 4180 | ADD25293 | 18211 | 48715 | 79219, 109723, 140227, 170731, 201235 | 10363 | AHG96902 | 24394 | 54898 | 85402, 115906, 146410, 176914, 207418 |
| 4181 | ADD25300 | 18212 | 48716 | 79220, 109724, 140228, 170732, 201236 | 10364 | AHG96914 | 24395 | 54899 | 85403, 115907, 146411, 176915, 207419 |
| 4182 | ADD25304 | 18213 | 48717 | 79221, 109725, 140229, 170733, 201237 | 10365 | AHG96926 | 24396 | 54900 | 85404, 115908, 146412, 176916, 207420 |
| 4183 | ADD25306 | 18214 | 48718 | 79222, 109726, 140230, 170734, 201238 | 10366 | AHG96938 | 24397 | 54901 | 85405, 115909, 146413, 176917, 207421 |
| 4184 | ADD25308 | 18215 | 48719 | 79223, 109727, 140231, 170735, 201239 | 10367 | AHG96950 | 24398 | 54902 | 85406, 115910, 146414, 176918, 207422 |
| 4185 | ADD25310 | 18216 | 48720 | 79224, 109728, 140232, 170736, 201240 | 10368 | AHG96962 | 24399 | 54903 | 85407, 115911, 146415, 176919, 207423 |
| 4186 | ADD25312 | 18217 | 48721 | 79225, 109729, 140233, 170737, 201241 | 10369 | AHG96974 | 24400 | 54904 | 85408, 115912, 146416, 176920, 207424 |
| 4187 | ADD25314 | 18218 | 48722 | 79226, 109730, 140234, 170738, 201242 | 10370 | AHG96986 | 24401 | 54905 | 85409, 115913, 146417, 176921, 207425 |

FIG. 3 continued

| | | | | | | | | | |
|---|---|---|---|---|---|---|---|---|---|
| 4188 | ADD25316 | 18219 | 48723 | 79227, 109731, 140235, 170739, 201243 | 10371 | AHG96998 | 24402 | 54906 | 85410, 115914, 146418, 176922, 207426 |
| 4189 | ADD29799 | 18220 | 48724 | 79228, 109732, 140236, 170740, 201244 | 10372 | AHG97010 | 24403 | 54907 | 85411, 115915, 146419, 176923, 207427 |
| 4190 | ADD29800 | 18221 | 48725 | 79229, 109733, 140237, 170741, 201245 | 10373 | AHG97022 | 24404 | 54908 | 85412, 115916, 146420, 176924, 207428 |
| 4191 | ADD29801 | 18222 | 48726 | 79230, 109734, 140238, 170742, 201246 | 10374 | AHG97034 | 24405 | 54909 | 85413, 115917, 146421, 176925, 207429 |
| 4192 | ADD29802 | 18223 | 48727 | 79231, 109735, 140239, 170743, 201247 | 10375 | AHG97046 | 24406 | 54910 | 85414, 115918, 146422, 176926, 207430 |
| 4193 | ADD29803 | 18224 | 48728 | 79232, 109736, 140240, 170744, 201248 | 10376 | AHH00872 | 24407 | 54911 | 85415, 115919, 146423, 176927, 207431 |
| 4194 | ADD29804 | 18225 | 48729 | 79233, 109737, 140241, 170745, 201249 | 10377 | AHI43497 | 24408 | 54912 | 85416, 115920, 146424, 176928, 207432 |
| 4195 | ADD29805 | 18226 | 48730 | 79234, 109738, 140242, 170746, 201250 | 10378 | AHJ57439 | 24409 | 54913 | 85417, 115921, 146425, 176929, 207433 |
| 4196 | ADD29806 | 18227 | 48731 | 79235, 109739, 140243, 170747, 201251 | 10379 | AHJ57440 | 24410 | 54914 | 85418, 115922, 146426, 176930, 207434 |
| 4197 | ADD29807 | 18228 | 48732 | 79236, 109740, 140244, 170748, 201252 | 10380 | AHJ57441 | 24411 | 54915 | 85419, 115923, 146427, 176931, 207435 |
| 4198 | ADD29808 | 18229 | 48733 | 79237, 109741, 140245, 170749, 201253 | 10381 | AHJ57654 | 24412 | 54916 | 85420, 115924, 146428, 176932, 207436 |
| 4199 | ADD52538 | 18230 | 48734 | 79238, 109742, 140246, 170750, 201254 | 10382 | AHJ57666 | 24413 | 54917 | 85421, 115925, 146429, 176933, 207437 |
| 4200 | ADD74353 | 18231 | 48735 | 79239, 109743, 140247, 170751, 201255 | 10383 | AHJ57677 | 24414 | 54918 | 85422, 115926, 146430, 176934, 207438 |
| 4201 | ADD74373 | 18232 | 48736 | 79240, 109744, 140248, 170752, 201256 | 10384 | AHJ57689 | 24415 | 54919 | 85423, 115927, 146431, 176935, 207439 |
| 4202 | ADD74383 | 18233 | 48737 | 79241, 109745, 140249, 170753, 201257 | 10385 | AHJ57700 | 24416 | 54920 | 85424, 115928, 146432, 176936, 207440 |
| 4203 | ADD74401 | 18234 | 48738 | 79242, 109746, 140250, 170754, 201258 | 10386 | AHJ57710 | 24417 | 54921 | 85425, 115929, 146433, 176937, 207441 |
| 4204 | ADD74411 | 18235 | 48739 | 79243, 109747, 140251, 170755, 201259 | 10387 | AHJ57734 | 24418 | 54922 | 85426, 115930, 146434, 176938, 207442 |
| 4205 | ADD74421 | 18236 | 48740 | 79244, 109748, 140252, 170756, 201260 | 10388 | AHJ57746 | 24419 | 54923 | 85427, 115931, 146435, 176939, 207443 |

FIG. 3 continued

| | | | | | | | | | |
|---|---|---|---|---|---|---|---|---|---|
| 4206 | ADD74431 | 18237 | 48741 | 79245, 109749, 140253, 170757, 201261 | 10389 | AHJ57758 | 24420 | 54924 | 85428, 115932, 146436, 176940, 207444 |
| 4207 | ADD74441 | 18238 | 48742 | 79246, 109750, 140254, 170758, 201262 | 10390 | AHJ57770 | 24421 | 54925 | 85429, 115933, 146437, 176941, 207445 |
| 4208 | ADD74451 | 18239 | 48743 | 79247, 109751, 140255, 170759, 201263 | 10391 | AHJ57782 | 24422 | 54926 | 85430, 115934, 146438, 176942, 207446 |
| 4209 | ADD74461 | 18240 | 48744 | 79248, 109752, 140256, 170760, 201264 | 10392 | AHJ57794 | 24423 | 54927 | 85431, 115935, 146439, 176943, 207447 |
| 4210 | ADD74471 | 18241 | 48745 | 79249, 109753, 140257, 170761, 201265 | 10393 | AHJ57806 | 24424 | 54928 | 85432, 115936, 146440, 176944, 207448 |
| 4211 | ADD74481 | 18242 | 48746 | 79250, 109754, 140258, 170762, 201266 | 10394 | AHJ57818 | 24425 | 54929 | 85433, 115937, 146441, 176945, 207449 |
| 4212 | ADD74491 | 18243 | 48747 | 79251, 109755, 140259, 170763, 201267 | 10395 | AHJ57830 | 24426 | 54930 | 85434, 115938, 146442, 176946, 207450 |
| 4213 | ADD74501 | 18244 | 48748 | 79252, 109756, 140260, 170764, 201268 | 10396 | AHJ57842 | 24427 | 54931 | 85435, 115939, 146443, 176947, 207451 |
| 4214 | ADD74511 | 18245 | 48749 | 79253, 109757, 140261, 170765, 201269 | 10397 | AHJ57853 | 24428 | 54932 | 85436, 115940, 146444, 176948, 207452 |
| 4215 | ADD74521 | 18246 | 48750 | 79254, 109758, 140262, 170766, 201270 | 10398 | AHJ57865 | 24429 | 54933 | 85437, 115941, 146445, 176949, 207453 |
| 4216 | ADD74531 | 18247 | 48751 | 79255, 109759, 140263, 170767, 201271 | 10399 | AHJ57876 | 24430 | 54934 | 85438, 115942, 146446, 176950, 207454 |
| 4217 | ADD74551 | 18248 | 48752 | 79256, 109760, 140264, 170768, 201272 | 10400 | AHJ57888 | 24431 | 54935 | 85439, 115943, 146447, 176951, 207455 |
| 4218 | ADD74561 | 18249 | 48753 | 79257, 109761, 140265, 170769, 201273 | 10401 | AHJ57900 | 24432 | 54936 | 85440, 115944, 146448, 176952, 207456 |
| 4219 | ADD74571 | 18250 | 48754 | 79258, 109762, 140266, 170770, 201274 | 10402 | AHJ57911 | 24433 | 54937 | 85441, 115945, 146449, 176953, 207457 |
| 4220 | ADD74581 | 18251 | 48755 | 79259, 109763, 140267, 170771, 201275 | 10403 | AHJ57923 | 24434 | 54938 | 85442, 115946, 146450, 176954, 207458 |
| 4221 | ADD74591 | 18252 | 48756 | 79260, 109764, 140268, 170772, 201276 | 10404 | AHJ57935 | 24435 | 54939 | 85443, 115947, 146451, 176955, 207459 |
| 4222 | ADD74601 | 18253 | 48757 | 79261, 109765, 140269, 170773, 201277 | 10405 | AHJ57946 | 24436 | 54940 | 85444, 115948, 146452, 176956, 207460 |
| 4223 | ADD74611 | 18254 | 48758 | 79262, 109766, 140270, 170774, 201278 | 10406 | AHJ57957 | 24437 | 54941 | 85445, 115949, 146453, 176957, 207461 |

FIG. 3 continued

| | | | | | | | | | |
|---|---|---|---|---|---|---|---|---|---|
| 4224 | ADD74621 | 18255 | 48759 | 79263, 109767, 140271, 170775, 201279 | 10407 | AHJ57968 | 24438 | 54942 | 85446, 115950, 146454, 176958, 207462 |
| 4225 | ADD74631 | 18256 | 48760 | 79264, 109768, 140272, 170776, 201280 | 10408 | AHJ57980 | 24439 | 54943 | 85447, 115951, 146455, 176959, 207463 |
| 4226 | ADD74641 | 18257 | 48761 | 79265, 109769, 140273, 170777, 201281 | 10409 | AHJ57992 | 24440 | 54944 | 85448, 115952, 146456, 176960, 207464 |
| 4227 | ADD74651 | 18258 | 48762 | 79266, 109770, 140274, 170778, 201282 | 10410 | AHJ58004 | 24441 | 54945 | 85449, 115953, 146457, 176961, 207465 |
| 4228 | ADD74661 | 18259 | 48763 | 79267, 109771, 140275, 170779, 201283 | 10411 | AHJ58016 | 24442 | 54946 | 85450, 115954, 146458, 176962, 207466 |
| 4229 | ADD74671 | 18260 | 48764 | 79268, 109772, 140276, 170780, 201284 | 10412 | AHJ58028 | 24443 | 54947 | 85451, 115955, 146459, 176963, 207467 |
| 4230 | ADD74681 | 18261 | 48765 | 79269, 109773, 140277, 170781, 201285 | 10413 | AHJ58040 | 24444 | 54948 | 85452, 115956, 146460, 176964, 207468 |
| 4231 | ADD74691 | 18262 | 48766 | 79270, 109774, 140278, 170782, 201286 | 10414 | AHJ58052 | 24445 | 54949 | 85453, 115957, 146461, 176965, 207469 |
| 4232 | ADD74701 | 18263 | 48767 | 79271, 109775, 140279, 170783, 201287 | 10415 | AHJ58064 | 24446 | 54950 | 85454, 115958, 146462, 176966, 207470 |
| 4233 | ADD74711 | 18264 | 48768 | 79272, 109776, 140280, 170784, 201288 | 10416 | AHJ58075 | 24447 | 54951 | 85455, 115959, 146463, 176967, 207471 |
| 4234 | ADD74721 | 18265 | 48769 | 79273, 109777, 140281, 170785, 201289 | 10417 | AHJ58087 | 24448 | 54952 | 85456, 115960, 146464, 176968, 207472 |
| 4235 | ADD74731 | 18266 | 48770 | 79274, 109778, 140282, 170786, 201290 | 10418 | AHL80721 | 24449 | 54953 | 85457, 115961, 146465, 176969, 207473 |
| 4236 | ADD74741 | 18267 | 48771 | 79275, 109779, 140283, 170787, 201291 | 10419 | AHL80732 | 24450 | 54954 | 85458, 115962, 146466, 176970, 207474 |
| 4237 | ADD74751 | 18268 | 48772 | 79276, 109780, 140284, 170788, 201292 | 10420 | AHL80743 | 24451 | 54955 | 85459, 115963, 146467, 176971, 207475 |
| 4238 | ADD74761 | 18269 | 48773 | 79277, 109781, 140285, 170789, 201293 | 10421 | AHL80754 | 24452 | 54956 | 85460, 115964, 146468, 176972, 207476 |
| 4239 | ADD74791 | 18270 | 48774 | 79278, 109782, 140286, 170790, 201294 | 10422 | AHL80765 | 24453 | 54957 | 85461, 115965, 146469, 176973, 207477 |
| 4240 | ADD74811 | 18271 | 48775 | 79279, 109783, 140287, 170791, 201295 | 10423 | AHL80776 | 24454 | 54958 | 85462, 115966, 146470, 176974, 207478 |
| 4241 | ADD74821 | 18272 | 48776 | 79280, 109784, 140288, 170792, 201296 | 10424 | AHL80787 | 24455 | 54959 | 85463, 115967, 146471, 176975, 207479 |

FIG. 3 continued

| | | | | | | | | | |
|---|---|---|---|---|---|---|---|---|---|
| 4242 | ADD74831 | 18273 | 48777 | 79281, 109785, 140289, 170793, 201297 | 10425 | AHL80798 | 24456 | 54960 | 85464, 115968, 146472, 176976, 207480 |
| 4243 | ADD74841 | 18274 | 48778 | 79282, 109786, 140290, 170794, 201298 | 10426 | AHL80809 | 24457 | 54961 | 85465, 115969, 146473, 176977, 207481 |
| 4244 | ADD74851 | 18275 | 48779 | 79283, 109787, 140291, 170795, 201299 | 10427 | AHL80820 | 24458 | 54962 | 85466, 115970, 146474, 176978, 207482 |
| 4245 | ADD74861 | 18276 | 48780 | 79284, 109788, 140292, 170796, 201300 | 10428 | AHL80831 | 24459 | 54963 | 85467, 115971, 146475, 176979, 207483 |
| 4246 | ADD74871 | 18277 | 48781 | 79285, 109789, 140293, 170797, 201301 | 10429 | AHL80842 | 24460 | 54964 | 85468, 115972, 146476, 176980, 207484 |
| 4247 | ADD74881 | 18278 | 48782 | 79286, 109790, 140294, 170798, 201302 | 10430 | AHL80853 | 24461 | 54965 | 85469, 115973, 146477, 176981, 207485 |
| 4248 | ADD74891 | 18279 | 48783 | 79287, 109791, 140295, 170799, 201303 | 10431 | AHL80864 | 24462 | 54966 | 85470, 115974, 146478, 176982, 207486 |
| 4249 | ADD74901 | 18280 | 48784 | 79288, 109792, 140296, 170800, 201304 | 10432 | AHL80875 | 24463 | 54967 | 85471, 115975, 146479, 176983, 207487 |
| 4250 | ADD74911 | 18281 | 48785 | 79289, 109793, 140297, 170801, 201305 | 10433 | AHL80886 | 24464 | 54968 | 85472, 115976, 146480, 176984, 207488 |
| 4251 | ADD74921 | 18282 | 48786 | 79290, 109794, 140298, 170802, 201306 | 10434 | AHL80897 | 24465 | 54969 | 85473, 115977, 146481, 176985, 207489 |
| 4252 | ADD74941 | 18283 | 48787 | 79291, 109795, 140299, 170803, 201307 | 10435 | AHL80908 | 24466 | 54970 | 85474, 115978, 146482, 176986, 207490 |
| 4253 | ADD74961 | 18284 | 48788 | 79292, 109796, 140300, 170804, 201308 | 10436 | AHL80919 | 24467 | 54971 | 85475, 115979, 146483, 176987, 207491 |
| 4254 | ADD74971 | 18285 | 48789 | 79293, 109797, 140301, 170805, 201309 | 10437 | AHL80930 | 24468 | 54972 | 85476, 115980, 146484, 176988, 207492 |
| 4255 | ADD74981 | 18286 | 48790 | 79294, 109798, 140302, 170806, 201310 | 10438 | AHL80949 | 24469 | 54973 | 85477, 115981, 146485, 176989, 207493 |
| 4256 | ADD74991 | 18287 | 48791 | 79295, 109799, 140303, 170807, 201311 | 10439 | AHL80961 | 24470 | 54974 | 85478, 115982, 146486, 176990, 207494 |
| 4257 | ADD75001 | 18288 | 48792 | 79296, 109800, 140304, 170808, 201312 | 10440 | AHL80972 | 24471 | 54975 | 85479, 115983, 146487, 176991, 207495 |
| 4258 | ADD75011 | 18289 | 48793 | 79297, 109801, 140305, 170809, 201313 | 10441 | AHL80983 | 24472 | 54976 | 85480, 115984, 146488, 176992, 207496 |
| 4259 | ADD75031 | 18290 | 48794 | 79298, 109802, 140306, 170810, 201314 | 10442 | AHL80992 | 24473 | 54977 | 85481, 115985, 146489, 176993, 207497 |

FIG. 3 continued

| | | | | | | | | | |
|---|---|---|---|---|---|---|---|---|---|
| 4260 | ADD75041 | 18291 | 48795 | 79299, 109803, 140307, 170811, 201315 | 10443 | AHL81004 | 24474 | 54978 | 85482, 115986, 146490, 176994, 207498 |
| 4261 | ADD75051 | 18292 | 48796 | 79300, 109804, 140308, 170812, 201316 | 10444 | AHL81016 | 24475 | 54979 | 85483, 115987, 146491, 176995, 207499 |
| 4262 | ADD75061 | 18293 | 48797 | 79301, 109805, 140309, 170813, 201317 | 10445 | AHL81028 | 24476 | 54980 | 85484, 115988, 146492, 176996, 207500 |
| 4263 | ADD75071 | 18294 | 48798 | 79302, 109806, 140310, 170814, 201318 | 10446 | AHL81040 | 24477 | 54981 | 85485, 115989, 146493, 176997, 207501 |
| 4264 | ADD75081 | 18295 | 48799 | 79303, 109807, 140311, 170815, 201319 | 10447 | AHL81052 | 24478 | 54982 | 85486, 115990, 146494, 176998, 207502 |
| 4265 | ADD75091 | 18296 | 48800 | 79304, 109808, 140312, 170816, 201320 | 10448 | AHL81064 | 24479 | 54983 | 85487, 115991, 146495, 176999, 207503 |
| 4266 | ADD75101 | 18297 | 48801 | 79305, 109809, 140313, 170817, 201321 | 10449 | AHL81075 | 24480 | 54984 | 85488, 115992, 146496, 177000, 207504 |
| 4267 | ADD75111 | 18298 | 48802 | 79306, 109810, 140314, 170818, 201322 | 10450 | AHL81086 | 24481 | 54985 | 85489, 115993, 146497, 177001, 207505 |
| 4268 | ADD75121 | 18299 | 48803 | 79307, 109811, 140315, 170819, 201323 | 10451 | AHL81098 | 24482 | 54986 | 85490, 115994, 146498, 177002, 207506 |
| 4269 | ADD75131 | 18300 | 48804 | 79308, 109812, 140316, 170820, 201324 | 10452 | AHL81110 | 24483 | 54987 | 85491, 115995, 146499, 177003, 207507 |
| 4270 | ADD75141 | 18301 | 48805 | 79309, 109813, 140317, 170821, 201325 | 10453 | AHL81121 | 24484 | 54988 | 85492, 115996, 146500, 177004, 207508 |
| 4271 | ADD75161 | 18302 | 48806 | 79310, 109814, 140318, 170822, 201326 | 10454 | AHL81132 | 24485 | 54989 | 85493, 115997, 146501, 177005, 207509 |
| 4272 | ADD84500 | 18303 | 48807 | 79311, 109815, 140319, 170823, 201327 | 10455 | AHL81144 | 24486 | 54990 | 85494, 115998, 146502, 177006, 207510 |
| 4273 | ADD84502 | 18304 | 48808 | 79312, 109816, 140320, 170824, 201328 | 10456 | AHL81156 | 24487 | 54991 | 85495, 115999, 146503, 177007, 207511 |
| 4274 | ADD84503 | 18305 | 48809 | 79313, 109817, 140321, 170825, 201329 | 10457 | AHL81168 | 24488 | 54992 | 85496, 116000, 146504, 177008, 207512 |
| 4275 | ADD84504 | 18306 | 48810 | 79314, 109818, 140322, 170826, 201330 | 10458 | AHL81180 | 24489 | 54993 | 85497, 116001, 146505, 177009, 207513 |
| 4276 | ADD84505 | 18307 | 48811 | 79315, 109819, 140323, 170827, 201331 | 10459 | AHL81192 | 24490 | 54994 | 85498, 116002, 146506, 177010, 207514 |
| 4277 | ADD84506 | 18308 | 48812 | 79316, 109820, 140324, 170828, 201332 | 10460 | AHL81215 | 24491 | 54995 | 85499, 116003, 146507, 177011, 207515 |

FIG. 3 continued

| | | | | | | | | | |
|---|---|---|---|---|---|---|---|---|---|
| 4278 | ADD92528 | 18309 | 48813 | 79317, 109821, 140325, 170829, 201333 | 10461 | AHL81227 | 24492 | 54996 | 85500, 116004, 146508, 177012, 207516 |
| 4279 | ADD96769 | 18310 | 48814 | 79318, 109822, 140326, 170830, 201334 | 10462 | AHL81238 | 24493 | 54997 | 85501, 116005, 146509, 177013, 207517 |
| 4280 | ADD96779 | 18311 | 48815 | 79319, 109823, 140327, 170831, 201335 | 10463 | AHL81250 | 24494 | 54998 | 85502, 116006, 146510, 177014, 207518 |
| 4281 | ADD96789 | 18312 | 48816 | 79320, 109824, 140328, 170832, 201336 | 10464 | AHL81262 | 24495 | 54999 | 85503, 116007, 146511, 177015, 207519 |
| 4282 | ADD96799 | 18313 | 48817 | 79321, 109825, 140329, 170833, 201337 | 10465 | AHL81274 | 24496 | 55000 | 85504, 116008, 146512, 177016, 207520 |
| 4283 | ADD96809 | 18314 | 48818 | 79322, 109826, 140330, 170834, 201338 | 10466 | AHL81286 | 24497 | 55001 | 85505, 116009, 146513, 177017, 207521 |
| 4284 | ADD96819 | 18315 | 48819 | 79323, 109827, 140331, 170835, 201339 | 10467 | AHL81298 | 24498 | 55002 | 85506, 116010, 146514, 177018, 207522 |
| 4285 | ADD96829 | 18316 | 48820 | 79324, 109828, 140332, 170836, 201340 | 10468 | AHL81310 | 24499 | 55003 | 85507, 116011, 146515, 177019, 207523 |
| 4286 | ADD96839 | 18317 | 48821 | 79325, 109829, 140333, 170837, 201341 | 10469 | AHL81332 | 24500 | 55004 | 85508, 116012, 146516, 177020, 207524 |
| 4287 | ADD96849 | 18318 | 48822 | 79326, 109830, 140334, 170838, 201342 | 10470 | AHL81343 | 24501 | 55005 | 85509, 116013, 146517, 177021, 207525 |
| 4288 | ADD96859 | 18319 | 48823 | 79327, 109831, 140335, 170839, 201343 | 10471 | AHL81355 | 24502 | 55006 | 85510, 116014, 146518, 177022, 207526 |
| 4289 | ADD96869 | 18320 | 48824 | 79328, 109832, 140336, 170840, 201344 | 10472 | AHL81367 | 24503 | 55007 | 85511, 116015, 146519, 177023, 207527 |
| 4290 | ADD96879 | 18321 | 48825 | 79329, 109833, 140337, 170841, 201345 | 10473 | AHL81378 | 24504 | 55008 | 85512, 116016, 146520, 177024, 207528 |
| 4291 | ADD96889 | 18322 | 48826 | 79330, 109834, 140338, 170842, 201346 | 10474 | AHL81389 | 24505 | 55009 | 85513, 116017, 146521, 177025, 207529 |
| 4292 | ADD96899 | 18323 | 48827 | 79331, 109835, 140339, 170843, 201347 | 10475 | AHL81400 | 24506 | 55010 | 85514, 116018, 146522, 177026, 207530 |
| 4293 | ADD96909 | 18324 | 48828 | 79332, 109836, 140340, 170844, 201348 | 10476 | AHL81412 | 24507 | 55011 | 85515, 116019, 146523, 177027, 207531 |
| 4294 | ADD96919 | 18325 | 48829 | 79333, 109837, 140341, 170845, 201349 | 10477 | AHL81422 | 24508 | 55012 | 85516, 116020, 146524, 177028, 207532 |
| 4295 | ADD96929 | 18326 | 48830 | 79334, 109838, 140342, 170846, 201350 | 10478 | AHL81433 | 24509 | 55013 | 85517, 116021, 146525, 177029, 207533 |

FIG. 3 continued

| | | | | | | | | | |
|---|---|---|---|---|---|---|---|---|---|
| 4296 | ADD96939 | 18327 | 48831 | 79335, 109839, 140343, 170847, 201351 | 10479 | AHL88954 | 24510 | 55014 | 85518, 116022, 146526, 177030, 207534 |
| 4297 | ADD96959 | 18328 | 48832 | 79336, 109840, 140344, 170848, 201352 | 10480 | AHL89033 | 24511 | 55015 | 85519, 116023, 146527, 177031, 207535 |
| 4298 | ADD96969 | 18329 | 48833 | 79337, 109841, 140345, 170849, 201353 | 10481 | AHL89045 | 24512 | 55016 | 85520, 116024, 146528, 177032, 207536 |
| 4299 | ADD96989 | 18330 | 48834 | 79338, 109842, 140346, 170850, 201354 | 10482 | AHL89057 | 24513 | 55017 | 85521, 116025, 146529, 177033, 207537 |
| 4300 | ADD97038 | 18331 | 48835 | 79339, 109843, 140347, 170851, 201355 | 10483 | AHL89069 | 24514 | 55018 | 85522, 116026, 146530, 177034, 207538 |
| 4301 | ADD97048 | 18332 | 48836 | 79340, 109844, 140348, 170852, 201356 | 10484 | AHL89081 | 24515 | 55019 | 85523, 116027, 146531, 177035, 207539 |
| 4302 | ADD97058 | 18333 | 48837 | 79341, 109845, 140349, 170853, 201357 | 10485 | AHL89093 | 24516 | 55020 | 85524, 116028, 146532, 177036, 207540 |
| 4303 | ADD97069 | 18334 | 48838 | 79342, 109846, 140350, 170854, 201358 | 10486 | AHL89117 | 24517 | 55021 | 85525, 116029, 146533, 177037, 207541 |
| 4304 | ADD97126 | 18335 | 48839 | 79343, 109847, 140351, 170855, 201359 | 10487 | AHL89129 | 24518 | 55022 | 85526, 116030, 146534, 177038, 207542 |
| 4305 | ADD97164 | 18336 | 48840 | 79344, 109848, 140352, 170856, 201360 | 10488 | AHL89141 | 24519 | 55023 | 85527, 116031, 146535, 177039, 207543 |
| 4306 | ADD97174 | 18337 | 48841 | 79345, 109849, 140353, 170857, 201361 | 10489 | AHL89153 | 24520 | 55024 | 85528, 116032, 146536, 177040, 207544 |
| 4307 | ADD97184 | 18338 | 48842 | 79346, 109850, 140354, 170858, 201362 | 10490 | AHL89165 | 24521 | 55025 | 85529, 116033, 146537, 177041, 207545 |
| 4308 | ADD97194 | 18339 | 48843 | 79347, 109851, 140355, 170859, 201363 | 10491 | AHL89177 | 24522 | 55026 | 85530, 116034, 146538, 177042, 207546 |
| 4309 | ADD97204 | 18340 | 48844 | 79348, 109852, 140356, 170860, 201364 | 10492 | AHL89189 | 24523 | 55027 | 85531, 116035, 146539, 177043, 207547 |
| 4310 | ADD97214 | 18341 | 48845 | 79349, 109853, 140357, 170861, 201365 | 10493 | AHL89201 | 24524 | 55028 | 85532, 116036, 146540, 177044, 207548 |
| 4311 | ADD97224 | 18342 | 48846 | 79350, 109854, 140358, 170862, 201366 | 10494 | AHL89213 | 24525 | 55029 | 85533, 116037, 146541, 177045, 207549 |
| 4312 | ADD97234 | 18343 | 48847 | 79351, 109855, 140359, 170863, 201367 | 10495 | AHL89225 | 24526 | 55030 | 85534, 116038, 146542, 177046, 207550 |
| 4313 | ADD97244 | 18344 | 48848 | 79352, 109856, 140360, 170864, 201368 | 10496 | AHL89237 | 24527 | 55031 | 85535, 116039, 146543, 177047, 207551 |

FIG. 3 continued

| | | | | | | | | | |
|---|---|---|---|---|---|---|---|---|---|
| 4314 | ADD97254 | 18345 | 48849 | 79353, 109857, 140361, 170865, 201369 | 10497 | AHL89261 | 24528 | 55032 | 85536, 116040, 146544, 177048, 207552 |
| 4315 | ADD97264 | 18346 | 48850 | 79354, 109858, 140362, 170866, 201370 | 10498 | AHL89273 | 24529 | 55033 | 85537, 116041, 146545, 177049, 207553 |
| 4316 | ADD97274 | 18347 | 48851 | 79355, 109859, 140363, 170867, 201371 | 10499 | AHL89285 | 24530 | 55034 | 85538, 116042, 146546, 177050, 207554 |
| 4317 | ADD97284 | 18348 | 48852 | 79356, 109860, 140364, 170868, 201372 | 10500 | AHL89297 | 24531 | 55035 | 85539, 116043, 146547, 177051, 207555 |
| 4318 | ADD97294 | 18349 | 48853 | 79357, 109861, 140365, 170869, 201373 | 10501 | AHL89309 | 24532 | 55036 | 85540, 116044, 146548, 177052, 207556 |
| 4319 | ADD97314 | 18350 | 48854 | 79358, 109862, 140366, 170870, 201374 | 10502 | AHL89321 | 24533 | 55037 | 85541, 116045, 146549, 177053, 207557 |
| 4320 | ADD97334 | 18351 | 48855 | 79359, 109863, 140367, 170871, 201375 | 10503 | AHL89333 | 24534 | 55038 | 85542, 116046, 146550, 177054, 207558 |
| 4321 | ADD97344 | 18352 | 48856 | 79360, 109864, 140368, 170872, 201376 | 10504 | AHL89345 | 24535 | 55039 | 85543, 116047, 146551, 177055, 207559 |
| 4322 | ADD97354 | 18353 | 48857 | 79361, 109865, 140369, 170873, 201377 | 10505 | AHL89357 | 24536 | 55040 | 85544, 116048, 146552, 177056, 207560 |
| 4323 | ADD97384 | 18354 | 48858 | 79362, 109866, 140370, 170874, 201378 | 10506 | AHL89369 | 24537 | 55041 | 85545, 116049, 146553, 177057, 207561 |
| 4324 | ADD97394 | 18355 | 48859 | 79363, 109867, 140371, 170875, 201379 | 10507 | AHL89381 | 24538 | 55042 | 85546, 116050, 146554, 177058, 207562 |
| 4325 | ADD97404 | 18356 | 48860 | 79364, 109868, 140372, 170876, 201380 | 10508 | AHL89405 | 24539 | 55043 | 85547, 116051, 146555, 177059, 207563 |
| 4326 | ADD97424 | 18357 | 48861 | 79365, 109869, 140373, 170877, 201381 | 10509 | AHL89417 | 24540 | 55044 | 85548, 116052, 146556, 177060, 207564 |
| 4327 | ADD97434 | 18358 | 48862 | 79366, 109870, 140374, 170878, 201382 | 10510 | AHL89429 | 24541 | 55045 | 85549, 116053, 146557, 177061, 207565 |
| 4328 | ADD97444 | 18359 | 48863 | 79367, 109871, 140375, 170879, 201383 | 10511 | AHL89441 | 24542 | 55046 | 85550, 116054, 146558, 177062, 207566 |
| 4329 | ADD97454 | 18360 | 48864 | 79368, 109872, 140376, 170880, 201384 | 10512 | AHL89453 | 24543 | 55047 | 85551, 116055, 146559, 177063, 207567 |
| 4330 | ADD97464 | 18361 | 48865 | 79369, 109873, 140377, 170881, 201385 | 10513 | AHL89465 | 24544 | 55048 | 85552, 116056, 146560, 177064, 207568 |
| 4331 | ADD97474 | 18362 | 48866 | 79370, 109874, 140378, 170882, 201386 | 10514 | AHL89477 | 24545 | 55049 | 85553, 116057, 146561, 177065, 207569 |

FIG. 3 continued

| | | | | | | | | | |
|---|---|---|---|---|---|---|---|---|---|
| 4332 | ADD97484 | 18363 | 48867 | 79371, 109875, 140379, 170883, 201387 | 10515 | AHL89489 | 24546 | 55050 | 85554, 116058, 146562, 177066, 207570 |
| 4333 | ADD97494 | 18364 | 48868 | 79372, 109876, 140380, 170884, 201388 | 10516 | AHL89501 | 24547 | 55051 | 85555, 116059, 146563, 177067, 207571 |
| 4334 | ADD97504 | 18365 | 48869 | 79373, 109877, 140381, 170885, 201389 | 10517 | AHL89513 | 24548 | 55052 | 85556, 116060, 146564, 177068, 207572 |
| 4335 | ADD97514 | 18366 | 48870 | 79374, 109878, 140382, 170886, 201390 | 10518 | AHL89525 | 24549 | 55053 | 85557, 116061, 146565, 177069, 207573 |
| 4336 | ADD97534 | 18367 | 48871 | 79375, 109879, 140383, 170887, 201391 | 10519 | AHL89537 | 24550 | 55054 | 85558, 116062, 146566, 177070, 207574 |
| 4337 | ADD97544 | 18368 | 48872 | 79376, 109880, 140384, 170888, 201392 | 10520 | AHL89549 | 24551 | 55055 | 85559, 116063, 146567, 177071, 207575 |
| 4338 | ADD97554 | 18369 | 48873 | 79377, 109881, 140385, 170889, 201393 | 10521 | AHL89561 | 24552 | 55056 | 85560, 116064, 146568, 177072, 207576 |
| 4339 | ADD97564 | 18370 | 48874 | 79378, 109882, 140386, 170890, 201394 | 10522 | AHL89573 | 24553 | 55057 | 85561, 116065, 146569, 177073, 207577 |
| 4340 | ADD97574 | 18371 | 48875 | 79379, 109883, 140387, 170891, 201395 | 10523 | AHL89585 | 24554 | 55058 | 85562, 116066, 146570, 177074, 207578 |
| 4341 | ADD97584 | 18372 | 48876 | 79380, 109884, 140388, 170892, 201396 | 10524 | AHL89597 | 24555 | 55059 | 85563, 116067, 146571, 177075, 207579 |
| 4342 | ADD97681 | 18373 | 48877 | 79381, 109885, 140389, 170893, 201397 | 10525 | AHL89609 | 24556 | 55060 | 85564, 116068, 146572, 177076, 207580 |
| 4343 | ADD97691 | 18374 | 48878 | 79382, 109886, 140390, 170894, 201398 | 10526 | AHL89621 | 24557 | 55061 | 85565, 116069, 146573, 177077, 207581 |
| 4344 | ADD97701 | 18375 | 48879 | 79383, 109887, 140391, 170895, 201399 | 10527 | AHL89633 | 24558 | 55062 | 85566, 116070, 146574, 177078, 207582 |
| 4345 | ADD97891 | 18376 | 48880 | 79384, 109888, 140392, 170896, 201400 | 10528 | AHL89645 | 24559 | 55063 | 85567, 116071, 146575, 177079, 207583 |
| 4346 | ADD97901 | 18377 | 48881 | 79385, 109889, 140393, 170897, 201401 | 10529 | AHL89657 | 24560 | 55064 | 85568, 116072, 146576, 177080, 207584 |
| 4347 | ADD97911 | 18378 | 48882 | 79386, 109890, 140394, 170898, 201402 | 10530 | AHL89669 | 24561 | 55065 | 85569, 116073, 146577, 177081, 207585 |
| 4348 | ADD97921 | 18379 | 48883 | 79387, 109891, 140395, 170899, 201403 | 10531 | AHL89681 | 24562 | 55066 | 85570, 116074, 146578, 177082, 207586 |
| 4349 | ADD97931 | 18380 | 48884 | 79388, 109892, 140396, 170900, 201404 | 10532 | AHL89693 | 24563 | 55067 | 85571, 116075, 146579, 177083, 207587 |

FIG. 3 continued

| | | | | | | | | | |
|---|---|---|---|---|---|---|---|---|---|
| 4350 | ADD97941 | 18381 | 48885 | 79389, 109893, 140397, 170901, 201405 | 10533 | AHL89705 | 24564 | 55068 | 85572, 116076, 146580, 177084, 207588 |
| 4351 | ADD97951 | 18382 | 48886 | 79390, 109894, 140398, 170902, 201406 | 10534 | AHL89717 | 24565 | 55069 | 85573, 116077, 146581, 177085, 207589 |
| 4352 | ADD97961 | 18383 | 48887 | 79391, 109895, 140399, 170903, 201407 | 10535 | AHL89729 | 24566 | 55070 | 85574, 116078, 146582, 177086, 207590 |
| 4353 | ADD97971 | 18384 | 48888 | 79392, 109896, 140400, 170904, 201408 | 10536 | AHL89753 | 24567 | 55071 | 85575, 116079, 146583, 177087, 207591 |
| 4354 | ADD97981 | 18385 | 48889 | 79393, 109897, 140401, 170905, 201409 | 10537 | AHL89765 | 24568 | 55072 | 85576, 116080, 146584, 177088, 207592 |
| 4355 | ADD97991 | 18386 | 48890 | 79394, 109898, 140402, 170906, 201410 | 10538 | AHL89777 | 24569 | 55073 | 85577, 116081, 146585, 177089, 207593 |
| 4356 | ADD98001 | 18387 | 48891 | 79395, 109899, 140403, 170907, 201411 | 10539 | AHL89789 | 24570 | 55074 | 85578, 116082, 146586, 177090, 207594 |
| 4357 | ADD98011 | 18388 | 48892 | 79396, 109900, 140404, 170908, 201412 | 10540 | AHL89801 | 24571 | 55075 | 85579, 116083, 146587, 177091, 207595 |
| 4358 | ADD98031 | 18389 | 48893 | 79397, 109901, 140405, 170909, 201413 | 10541 | AHL89813 | 24572 | 55076 | 85580, 116084, 146588, 177092, 207596 |
| 4359 | ADD98041 | 18390 | 48894 | 79398, 109902, 140406, 170910, 201414 | 10542 | AHL89825 | 24573 | 55077 | 85581, 116085, 146589, 177093, 207597 |
| 4360 | ADD98051 | 18391 | 48895 | 79399, 109903, 140407, 170911, 201415 | 10543 | AHL89837 | 24574 | 55078 | 85582, 116086, 146590, 177094, 207598 |
| 4361 | ADD98061 | 18392 | 48896 | 79400, 109904, 140408, 170912, 201416 | 10544 | AHL89849 | 24575 | 55079 | 85583, 116087, 146591, 177095, 207599 |
| 4362 | ADD98071 | 18393 | 48897 | 79401, 109905, 140409, 170913, 201417 | 10545 | AHL89861 | 24576 | 55080 | 85584, 116088, 146592, 177096, 207600 |
| 4363 | ADD98081 | 18394 | 48898 | 79402, 109906, 140410, 170914, 201418 | 10546 | AHL89873 | 24577 | 55081 | 85585, 116089, 146593, 177097, 207601 |
| 4364 | ADD98091 | 18395 | 48899 | 79403, 109907, 140411, 170915, 201419 | 10547 | AHL89885 | 24578 | 55082 | 85586, 116090, 146594, 177098, 207602 |
| 4365 | ADD98101 | 18396 | 48900 | 79404, 109908, 140412, 170916, 201420 | 10548 | AHL89897 | 24579 | 55083 | 85587, 116091, 146595, 177099, 207603 |
| 4366 | ADD98111 | 18397 | 48901 | 79405, 109909, 140413, 170917, 201421 | 10549 | AHL89909 | 24580 | 55084 | 85588, 116092, 146596, 177100, 207604 |
| 4367 | ADD98121 | 18398 | 48902 | 79406, 109910, 140414, 170918, 201422 | 10550 | AHL89921 | 24581 | 55085 | 85589, 116093, 146597, 177101, 207605 |

FIG. 3 continued

| | | | | | | | | | |
|---|---|---|---|---|---|---|---|---|---|
| 4368 | ADD98131 | 18399 | 48903 | 79407, 109911, 140415, 170919, 201423 | 10551 | AHL89933 | 24582 | 55086 | 85590, 116094, 146598, 177102, 207606 |
| 4369 | ADD98141 | 18400 | 48904 | 79408, 109912, 140416, 170920, 201424 | 10552 | AHL89945 | 24583 | 55087 | 85591, 116095, 146599, 177103, 207607 |
| 4370 | ADD98151 | 18401 | 48905 | 79409, 109913, 140417, 170921, 201425 | 10553 | AHL89957 | 24584 | 55088 | 85592, 116096, 146600, 177104, 207608 |
| 4371 | ADD98161 | 18402 | 48906 | 79410, 109914, 140418, 170922, 201426 | 10554 | AHL89969 | 24585 | 55089 | 85593, 116097, 146601, 177105, 207609 |
| 4372 | ADD98171 | 18403 | 48907 | 79411, 109915, 140419, 170923, 201427 | 10555 | AHL89981 | 24586 | 55090 | 85594, 116098, 146602, 177106, 207610 |
| 4373 | ADD98181 | 18404 | 48908 | 79412, 109916, 140420, 170924, 201428 | 10556 | AHL89993 | 24587 | 55091 | 85595, 116099, 146603, 177107, 207611 |
| 4374 | ADD98201 | 18405 | 48909 | 79413, 109917, 140421, 170925, 201429 | 10557 | AHL90005 | 24588 | 55092 | 85596, 116100, 146604, 177108, 207612 |
| 4375 | ADD98211 | 18406 | 48910 | 79414, 109918, 140422, 170926, 201430 | 10558 | AHL90017 | 24589 | 55093 | 85597, 116101, 146605, 177109, 207613 |
| 4376 | ADE20324 | 18407 | 48911 | 79415, 109919, 140423, 170927, 201431 | 10559 | AHL90029 | 24590 | 55094 | 85598, 116102, 146606, 177110, 207614 |
| 4377 | ADE20334 | 18408 | 48912 | 79416, 109920, 140424, 170928, 201432 | 10560 | AHL90041 | 24591 | 55095 | 85599, 116103, 146607, 177111, 207615 |
| 4378 | ADE20344 | 18409 | 48913 | 79417, 109921, 140425, 170929, 201433 | 10561 | AHL90053 | 24592 | 55096 | 85600, 116104, 146608, 177112, 207616 |
| 4379 | ADE20354 | 18410 | 48914 | 79418, 109922, 140426, 170930, 201434 | 10562 | AHL90065 | 24593 | 55097 | 85601, 116105, 146609, 177113, 207617 |
| 4380 | ADE20378 | 18411 | 48915 | 79419, 109923, 140427, 170931, 201435 | 10563 | AHL90077 | 24594 | 55098 | 85602, 116106, 146610, 177114, 207618 |
| 4381 | ADE20391 | 18412 | 48916 | 79420, 109924, 140428, 170932, 201436 | 10564 | AHL90089 | 24595 | 55099 | 85603, 116107, 146611, 177115, 207619 |
| 4382 | ADE20631 | 18413 | 48917 | 79421, 109925, 140429, 170933, 201437 | 10565 | AHL90101 | 24596 | 55100 | 85604, 116108, 146612, 177116, 207620 |
| 4383 | ADE20641 | 18414 | 48918 | 79422, 109926, 140430, 170934, 201438 | 10566 | AHL90113 | 24597 | 55101 | 85605, 116109, 146613, 177117, 207621 |
| 4384 | ADE20651 | 18415 | 48919 | 79423, 109927, 140431, 170935, 201439 | 10567 | AHL90125 | 24598 | 55102 | 85606, 116110, 146614, 177118, 207622 |
| 4385 | ADE20661 | 18416 | 48920 | 79424, 109928, 140432, 170936, 201440 | 10568 | AHL90136 | 24599 | 55103 | 85607, 116111, 146615, 177119, 207623 |

FIG. 3 continued

| | | | | | | | | | |
|---|---|---|---|---|---|---|---|---|---|
| 4386 | ADE20671 | 18417 | 48921 | 79425, 109929, 140433, 170937, 201441 | 10569 | AHL90160 | 24600 | 55104 | 85608, 116112, 146616, 177120, 207624 |
| 4387 | ADE20681 | 18418 | 48922 | 79426, 109930, 140434, 170938, 201442 | 10570 | AHL90172 | 24601 | 55105 | 85609, 116113, 146617, 177121, 207625 |
| 4388 | ADE20701 | 18419 | 48923 | 79427, 109931, 140435, 170939, 201443 | 10571 | AHL90184 | 24602 | 55106 | 85610, 116114, 146618, 177122, 207626 |
| 4389 | ADE20711 | 18420 | 48924 | 79428, 109932, 140436, 170940, 201444 | 10572 | AHL90196 | 24603 | 55107 | 85611, 116115, 146619, 177123, 207627 |
| 4390 | ADE20721 | 18421 | 48925 | 79429, 109933, 140437, 170941, 201445 | 10573 | AHL90220 | 24604 | 55108 | 85612, 116116, 146620, 177124, 207628 |
| 4391 | ADE20731 | 18422 | 48926 | 79430, 109934, 140438, 170942, 201446 | 10574 | AHL90232 | 24605 | 55109 | 85613, 116117, 146621, 177125, 207629 |
| 4392 | ADE20741 | 18423 | 48927 | 79431, 109935, 140439, 170943, 201447 | 10575 | AHL90244 | 24606 | 55110 | 85614, 116118, 146622, 177126, 207630 |
| 4393 | ADE20751 | 18424 | 48928 | 79432, 109936, 140440, 170944, 201448 | 10576 | AHL90256 | 24607 | 55111 | 85615, 116119, 146623, 177127, 207631 |
| 4394 | ADE20761 | 18425 | 48929 | 79433, 109937, 140441, 170945, 201449 | 10577 | AHL90268 | 24608 | 55112 | 85616, 116120, 146624, 177128, 207632 |
| 4395 | ADE20781 | 18426 | 48930 | 79434, 109938, 140442, 170946, 201450 | 10578 | AHL90280 | 24609 | 55113 | 85617, 116121, 146625, 177129, 207633 |
| 4396 | ADE20791 | 18427 | 48931 | 79435, 109939, 140443, 170947, 201451 | 10579 | AHL90304 | 24610 | 55114 | 85618, 116122, 146626, 177130, 207634 |
| 4397 | ADE20801 | 18428 | 48932 | 79436, 109940, 140444, 170948, 201452 | 10580 | AHL90316 | 24611 | 55115 | 85619, 116123, 146627, 177131, 207635 |
| 4398 | ADE20811 | 18429 | 48933 | 79437, 109941, 140445, 170949, 201453 | 10581 | AHL90328 | 24612 | 55116 | 85620, 116124, 146628, 177132, 207636 |
| 4399 | ADE20821 | 18430 | 48934 | 79438, 109942, 140446, 170950, 201454 | 10582 | AHL90340 | 24613 | 55117 | 85621, 116125, 146629, 177133, 207637 |
| 4400 | ADE20831 | 18431 | 48935 | 79439, 109943, 140447, 170951, 201455 | 10583 | AHL90352 | 24614 | 55118 | 85622, 116126, 146630, 177134, 207638 |
| 4401 | ADE20841 | 18432 | 48936 | 79440, 109944, 140448, 170952, 201456 | 10584 | AHL90364 | 24615 | 55119 | 85623, 116127, 146631, 177135, 207639 |
| 4402 | ADE20851 | 18433 | 48937 | 79441, 109945, 140449, 170953, 201457 | 10585 | AHL90376 | 24616 | 55120 | 85624, 116128, 146632, 177136, 207640 |
| 4403 | ADE20861 | 18434 | 48938 | 79442, 109946, 140450, 170954, 201458 | 10586 | AHL90388 | 24617 | 55121 | 85625, 116129, 146633, 177137, 207641 |

FIG. 3 continued

| | | | | | | | | | |
|---|---|---|---|---|---|---|---|---|---|
| 4404 | ADE20871 | 18435 | 48939 | 79443, 109947, 140451, 170955, 201459 | 10587 | AHL90400 | 24618 | 55122 | 85626, 116130, 146634, 177138, 207642 |
| 4405 | ADE20881 | 18436 | 48940 | 79444, 109948, 140452, 170956, 201460 | 10588 | AHL90413 | 24619 | 55123 | 85627, 116131, 146635, 177139, 207643 |
| 4406 | ADE20891 | 18437 | 48941 | 79445, 109949, 140453, 170957, 201461 | 10589 | AHL90425 | 24620 | 55124 | 85628, 116132, 146636, 177140, 207644 |
| 4407 | ADE20901 | 18438 | 48942 | 79446, 109950, 140454, 170958, 201462 | 10590 | AHL90437 | 24621 | 55125 | 85629, 116133, 146637, 177141, 207645 |
| 4408 | ADE20911 | 18439 | 48943 | 79447, 109951, 140455, 170959, 201463 | 10591 | AHL90449 | 24622 | 55126 | 85630, 116134, 146638, 177142, 207646 |
| 4409 | ADE20921 | 18440 | 48944 | 79448, 109952, 140456, 170960, 201464 | 10592 | AHL90461 | 24623 | 55127 | 85631, 116135, 146639, 177143, 207647 |
| 4410 | ADE20931 | 18441 | 48945 | 79449, 109953, 140457, 170961, 201465 | 10593 | AHL90473 | 24624 | 55128 | 85632, 116136, 146640, 177144, 207648 |
| 4411 | ADE20941 | 18442 | 48946 | 79450, 109954, 140458, 170962, 201466 | 10594 | AHL90485 | 24625 | 55129 | 85633, 116137, 146641, 177145, 207649 |
| 4412 | ADE20951 | 18443 | 48947 | 79451, 109955, 140459, 170963, 201467 | 10595 | AHL90497 | 24626 | 55130 | 85634, 116138, 146642, 177146, 207650 |
| 4413 | ADE20961 | 18444 | 48948 | 79452, 109956, 140460, 170964, 201468 | 10596 | AHL90509 | 24627 | 55131 | 85635, 116139, 146643, 177147, 207651 |
| 4414 | ADE20971 | 18445 | 48949 | 79453, 109957, 140461, 170965, 201469 | 10597 | AHL90521 | 24628 | 55132 | 85636, 116140, 146644, 177148, 207652 |
| 4415 | ADE20981 | 18446 | 48950 | 79454, 109958, 140462, 170966, 201470 | 10598 | AHL90533 | 24629 | 55133 | 85637, 116141, 146645, 177149, 207653 |
| 4416 | ADE20991 | 18447 | 48951 | 79455, 109959, 140463, 170967, 201471 | 10599 | AHL90545 | 24630 | 55134 | 85638, 116142, 146646, 177150, 207654 |
| 4417 | ADE21001 | 18448 | 48952 | 79456, 109960, 140464, 170968, 201472 | 10600 | AHL90557 | 24631 | 55135 | 85639, 116143, 146647, 177151, 207655 |
| 4418 | ADE21011 | 18449 | 48953 | 79457, 109961, 140465, 170969, 201473 | 10601 | AHL90569 | 24632 | 55136 | 85640, 116144, 146648, 177152, 207656 |
| 4419 | ADE21021 | 18450 | 48954 | 79458, 109962, 140466, 170970, 201474 | 10602 | AHL90581 | 24633 | 55137 | 85641, 116145, 146649, 177153, 207657 |
| 4420 | ADE21031 | 18451 | 48955 | 79459, 109963, 140467, 170971, 201475 | 10603 | AHL90593 | 24634 | 55138 | 85642, 116146, 146650, 177154, 207658 |
| 4421 | ADE21041 | 18452 | 48956 | 79460, 109964, 140468, 170972, 201476 | 10604 | AHL90605 | 24635 | 55139 | 85643, 116147, 146651, 177155, 207659 |

FIG. 3 continued

| | | | | | | | | | |
|---|---|---|---|---|---|---|---|---|---|
| 4422 | ADE21051 | 18453 | 48957 | 79461, 109965, 140469, 170973, 201477 | 10605 | AHL90629 | 24636 | 55140 | 85644, 116148, 146652, 177156, 207660 |
| 4423 | ADE21071 | 18454 | 48958 | 79462, 109966, 140470, 170974, 201478 | 10606 | AHL90641 | 24637 | 55141 | 85645, 116149, 146653, 177157, 207661 |
| 4424 | ADE28752 | 18455 | 48959 | 79463, 109967, 140471, 170975, 201479 | 10607 | AHL90653 | 24638 | 55142 | 85646, 116150, 146654, 177158, 207662 |
| 4425 | ADE28763 | 18456 | 48960 | 79464, 109968, 140472, 170976, 201480 | 10608 | AHL90665 | 24639 | 55143 | 85647, 116151, 146655, 177159, 207663 |
| 4426 | ADE28773 | 18457 | 48961 | 79465, 109969, 140473, 170977, 201481 | 10609 | AHL90677 | 24640 | 55144 | 85648, 116152, 146656, 177160, 207664 |
| 4427 | ADE28783 | 18458 | 48962 | 79466, 109970, 140474, 170978, 201482 | 10610 | AHL90689 | 24641 | 55145 | 85649, 116153, 146657, 177161, 207665 |
| 4428 | ADE28803 | 18459 | 48963 | 79467, 109971, 140475, 170979, 201483 | 10611 | AHL90701 | 24642 | 55146 | 85650, 116154, 146658, 177162, 207666 |
| 4429 | ADE28813 | 18460 | 48964 | 79468, 109972, 140476, 170980, 201484 | 10612 | AHL90713 | 24643 | 55147 | 85651, 116155, 146659, 177163, 207667 |
| 4430 | ADE28823 | 18461 | 48965 | 79469, 109973, 140477, 170981, 201485 | 10613 | AHL90725 | 24644 | 55148 | 85652, 116156, 146660, 177164, 207668 |
| 4431 | ADE28843 | 18462 | 48966 | 79470, 109974, 140478, 170982, 201486 | 10614 | AHL90749 | 24645 | 55149 | 85653, 116157, 146661, 177165, 207669 |
| 4432 | ADE28853 | 18463 | 48967 | 79471, 109975, 140479, 170983, 201487 | 10615 | AHL90761 | 24646 | 55150 | 85654, 116158, 146662, 177166, 207670 |
| 4433 | ADE28884 | 18464 | 48968 | 79472, 109976, 140480, 170984, 201488 | 10616 | AHL90773 | 24647 | 55151 | 85655, 116159, 146663, 177167, 207671 |
| 4434 | ADE28894 | 18465 | 48969 | 79473, 109977, 140481, 170985, 201489 | 10617 | AHL90785 | 24648 | 55152 | 85656, 116160, 146664, 177168, 207672 |
| 4435 | ADE28904 | 18466 | 48970 | 79474, 109978, 140482, 170986, 201490 | 10618 | AHL90797 | 24649 | 55153 | 85657, 116161, 146665, 177169, 207673 |
| 4436 | ADE28914 | 18467 | 48971 | 79475, 109979, 140483, 170987, 201491 | 10619 | AHL90809 | 24650 | 55154 | 85658, 116162, 146666, 177170, 207674 |
| 4437 | ADE28924 | 18468 | 48972 | 79476, 109980, 140484, 170988, 201492 | 10620 | AHL90821 | 24651 | 55155 | 85659, 116163, 146667, 177171, 207675 |
| 4438 | ADE28934 | 18469 | 48973 | 79477, 109981, 140485, 170989, 201493 | 10621 | AHL90833 | 24652 | 55156 | 85660, 116164, 146668, 177172, 207676 |
| 4439 | ADE28954 | 18470 | 48974 | 79478, 109982, 140486, 170990, 201494 | 10622 | AHL90845 | 24653 | 55157 | 85661, 116165, 146669, 177173, 207677 |

FIG. 3 continued

| | | | | | | | | | |
|---|---|---|---|---|---|---|---|---|---|
| 4440 | ADE28964 | 18471 | 48975 | 79479, 109983, 140487, 170991, 201495 | 10623 | AHL90857 | 24654 | 55158 | 85662, 116166, 146670, 177174, 207678 |
| 4441 | ADE28974 | 18472 | 48976 | 79480, 109984, 140488, 170992, 201496 | 10624 | AHL90869 | 24655 | 55159 | 85663, 116167, 146671, 177175, 207679 |
| 4442 | ADE29004 | 18473 | 48977 | 79481, 109985, 140489, 170993, 201497 | 10625 | AHL90881 | 24656 | 55160 | 85664, 116168, 146672, 177176, 207680 |
| 4443 | ADE29014 | 18474 | 48978 | 79482, 109986, 140490, 170994, 201498 | 10626 | AHL90893 | 24657 | 55161 | 85665, 116169, 146673, 177177, 207681 |
| 4444 | ADE29024 | 18475 | 48979 | 79483, 109987, 140491, 170995, 201499 | 10627 | AHL90905 | 24658 | 55162 | 85666, 116170, 146674, 177178, 207682 |
| 4445 | ADE29034 | 18476 | 48980 | 79484, 109988, 140492, 170996, 201500 | 10628 | AHL90917 | 24659 | 55163 | 85667, 116171, 146675, 177179, 207683 |
| 4446 | ADE29044 | 18477 | 48981 | 79485, 109989, 140493, 170997, 201501 | 10629 | AHL90929 | 24660 | 55164 | 85668, 116172, 146676, 177180, 207684 |
| 4447 | ADE29054 | 18478 | 48982 | 79486, 109990, 140494, 170998, 201502 | 10630 | AHL90941 | 24661 | 55165 | 85669, 116173, 146677, 177181, 207685 |
| 4448 | ADE29064 | 18479 | 48983 | 79487, 109991, 140495, 170999, 201503 | 10631 | AHL90953 | 24662 | 55166 | 85670, 116174, 146678, 177182, 207686 |
| 4449 | ADE29087 | 18480 | 48984 | 79488, 109992, 140496, 171000, 201504 | 10632 | AHL90965 | 24663 | 55167 | 85671, 116175, 146679, 177183, 207687 |
| 4450 | ADE29097 | 18481 | 48985 | 79489, 109993, 140497, 171001, 201505 | 10633 | AHL90977 | 24664 | 55168 | 85672, 116176, 146680, 177184, 207688 |
| 4451 | ADE34194 | 18482 | 48986 | 79490, 109994, 140498, 171002, 201506 | 10634 | AHL90989 | 24665 | 55169 | 85673, 116177, 146681, 177185, 207689 |
| 4452 | ADE34205 | 18483 | 48987 | 79491, 109995, 140499, 171003, 201507 | 10635 | AHL91001 | 24666 | 55170 | 85674, 116178, 146682, 177186, 207690 |
| 4453 | ADE34216 | 18484 | 48988 | 79492, 109996, 140500, 171004, 201508 | 10636 | AHL91013 | 24667 | 55171 | 85675, 116179, 146683, 177187, 207691 |
| 4454 | ADE34227 | 18485 | 48989 | 79493, 109997, 140501, 171005, 201509 | 10637 | AHL91025 | 24668 | 55172 | 85676, 116180, 146684, 177188, 207692 |
| 4455 | ADE34238 | 18486 | 48990 | 79494, 109998, 140502, 171006, 201510 | 10638 | AHL91037 | 24669 | 55173 | 85677, 116181, 146685, 177189, 207693 |
| 4456 | ADE34260 | 18487 | 48991 | 79495, 109999, 140503, 171007, 201511 | 10639 | AHL91049 | 24670 | 55174 | 85678, 116182, 146686, 177190, 207694 |
| 4457 | ADE34271 | 18488 | 48992 | 79496, 110000, 140504, 171008, 201512 | 10640 | AHL91061 | 24671 | 55175 | 85679, 116183, 146687, 177191, 207695 |

FIG. 3 continued

| | | | | | | | | | |
|---|---|---|---|---|---|---|---|---|---|
| 4458 | ADE45502 | 18489 | 48993 | 79497, 110001, 140505, 171009, 201513 | 10641 | AHL91073 | 24672 | 55176 | 85680, 116184, 146688, 177192, 207696 |
| 4459 | ADE45504 | 18490 | 48994 | 79498, 110002, 140506, 171010, 201514 | 10642 | AHL91085 | 24673 | 55177 | 85681, 116185, 146689, 177193, 207697 |
| 4460 | ADE45506 | 18491 | 48995 | 79499, 110003, 140507, 171011, 201515 | 10643 | AHL91097 | 24674 | 55178 | 85682, 116186, 146690, 177194, 207698 |
| 4461 | ADE45508 | 18492 | 48996 | 79500, 110004, 140508, 171012, 201516 | 10644 | AHL91109 | 24675 | 55179 | 85683, 116187, 146691, 177195, 207699 |
| 4462 | ADE45510 | 18493 | 48997 | 79501, 110005, 140509, 171013, 201517 | 10645 | AHL91121 | 24676 | 55180 | 85684, 116188, 146692, 177196, 207700 |
| 4463 | ADE45512 | 18494 | 48998 | 79502, 110006, 140510, 171014, 201518 | 10646 | AHL91133 | 24677 | 55181 | 85685, 116189, 146693, 177197, 207701 |
| 4464 | ADE45514 | 18495 | 48999 | 79503, 110007, 140511, 171015, 201519 | 10647 | AHL91145 | 24678 | 55182 | 85686, 116190, 146694, 177198, 207702 |
| 4465 | ADE45516 | 18496 | 49000 | 79504, 110008, 140512, 171016, 201520 | 10648 | AHL91157 | 24679 | 55183 | 85687, 116191, 146695, 177199, 207703 |
| 4466 | ADF10069 | 18497 | 49001 | 79505, 110009, 140513, 171017, 201521 | 10649 | AHL91169 | 24680 | 55184 | 85688, 116192, 146696, 177200, 207704 |
| 4467 | ADF10079 | 18498 | 49002 | 79506, 110010, 140514, 171018, 201522 | 10650 | AHL94987 | 24681 | 55185 | 85689, 116193, 146697, 177201, 207705 |
| 4468 | ADF10089 | 18499 | 49003 | 79507, 110011, 140515, 171019, 201523 | 10651 | AHL94999 | 24682 | 55186 | 85690, 116194, 146698, 177202, 207706 |
| 4469 | ADF10099 | 18500 | 49004 | 79508, 110012, 140516, 171020, 201524 | 10652 | AHL95011 | 24683 | 55187 | 85691, 116195, 146699, 177203, 207707 |
| 4470 | ADF10109 | 18501 | 49005 | 79509, 110013, 140517, 171021, 201525 | 10653 | AHL95023 | 24684 | 55188 | 85692, 116196, 146700, 177204, 207708 |
| 4471 | ADF10129 | 18502 | 49006 | 79510, 110014, 140518, 171022, 201526 | 10654 | AHL95035 | 24685 | 55189 | 85693, 116197, 146701, 177205, 207709 |
| 4472 | ADF10146 | 18503 | 49007 | 79511, 110015, 140519, 171023, 201527 | 10655 | AHL95047 | 24686 | 55190 | 85694, 116198, 146702, 177206, 207710 |
| 4473 | ADF10166 | 18504 | 49008 | 79512, 110016, 140520, 171024, 201528 | 10656 | AHL95059 | 24687 | 55191 | 85695, 116199, 146703, 177207, 207711 |
| 4474 | ADF10176 | 18505 | 49009 | 79513, 110017, 140521, 171025, 201529 | 10657 | AHL95071 | 24688 | 55192 | 85696, 116200, 146704, 177208, 207712 |
| 4475 | ADF10192 | 18506 | 49010 | 79514, 110018, 140522, 171026, 201530 | 10658 | AHL95083 | 24689 | 55193 | 85697, 116201, 146705, 177209, 207713 |

FIG. 3 continued

| | | | | | | | | | |
|---|---|---|---|---|---|---|---|---|---|
| 4476 | ADF10247 | 18507 | 49011 | 79515, 110019, 140523, 171027, 201531 | 10659 | AHL95095 | 24690 | 55194 | 85698, 116202, 146706, 177210, 207714 |
| 4477 | ADF10290 | 18508 | 49012 | 79516, 110020, 140524, 171028, 201532 | 10660 | AHL95107 | 24691 | 55195 | 85699, 116203, 146707, 177211, 207715 |
| 4478 | ADF10304 | 18509 | 49013 | 79517, 110021, 140525, 171029, 201533 | 10661 | AHL95119 | 24692 | 55196 | 85700, 116204, 146708, 177212, 207716 |
| 4479 | ADF10340 | 18510 | 49014 | 79518, 110022, 140526, 171030, 201534 | 10662 | AHL95131 | 24693 | 55197 | 85701, 116205, 146709, 177213, 207717 |
| 4480 | ADF10361 | 18511 | 49015 | 79519, 110023, 140527, 171031, 201535 | 10663 | AHL95143 | 24694 | 55198 | 85702, 116206, 146710, 177214, 207718 |
| 4481 | ADF10371 | 18512 | 49016 | 79520, 110024, 140528, 171032, 201536 | 10664 | AHL95155 | 24695 | 55199 | 85703, 116207, 146711, 177215, 207719 |
| 4482 | ADF10407 | 18513 | 49017 | 79521, 110025, 140529, 171033, 201537 | 10665 | AHL95167 | 24696 | 55200 | 85704, 116208, 146712, 177216, 207720 |
| 4483 | ADF10472 | 18514 | 49018 | 79522, 110026, 140530, 171034, 201538 | 10666 | AHL95179 | 24697 | 55201 | 85705, 116209, 146713, 177217, 207721 |
| 4484 | ADF10616 | 18515 | 49019 | 79523, 110027, 140531, 171035, 201539 | 10667 | AHL95191 | 24698 | 55202 | 85706, 116210, 146714, 177218, 207722 |
| 4485 | ADF10688 | 18516 | 49020 | 79524, 110028, 140532, 171036, 201540 | 10668 | AHL95203 | 24699 | 55203 | 85707, 116211, 146715, 177219, 207723 |
| 4486 | ADF10726 | 18517 | 49021 | 79525, 110029, 140533, 171037, 201541 | 10669 | AHL95215 | 24700 | 55204 | 85708, 116212, 146716, 177220, 207724 |
| 4487 | ADF10773 | 18518 | 49022 | 79526, 110030, 140534, 171038, 201542 | 10670 | AHL95227 | 24701 | 55205 | 85709, 116213, 146717, 177221, 207725 |
| 4488 | ADF10837 | 18519 | 49023 | 79527, 110031, 140535, 171039, 201543 | 10671 | AHL95239 | 24702 | 55206 | 85710, 116214, 146718, 177222, 207726 |
| 4489 | ADF10889 | 18520 | 49024 | 79528, 110032, 140536, 171040, 201544 | 10672 | AHL95251 | 24703 | 55207 | 85711, 116215, 146719, 177223, 207727 |
| 4490 | ADF10947 | 18521 | 49025 | 79529, 110033, 140537, 171041, 201545 | 10673 | AHL95263 | 24704 | 55208 | 85712, 116216, 146720, 177224, 207728 |
| 4491 | ADF11010 | 18522 | 49026 | 79530, 110034, 140538, 171042, 201546 | 10674 | AHL95275 | 24705 | 55209 | 85713, 116217, 146721, 177225, 207729 |
| 4492 | ADF27355 | 18523 | 49027 | 79531, 110035, 140539, 171043, 201547 | 10675 | AHL95299 | 24706 | 55210 | 85714, 116218, 146722, 177226, 207730 |
| 4493 | ADF27356 | 18524 | 49028 | 79532, 110036, 140540, 171044, 201548 | 10676 | AHL95310 | 24707 | 55211 | 85715, 116219, 146723, 177227, 207731 |

FIG. 3 continued

| | | | | | | | | | |
|---|---|---|---|---|---|---|---|---|---|
| 4494 | ADF27357 | 18525 | 49029 | 79533, 110037, 140541, 171045, 201549 | 10677 | AHL95322 | 24708 | 55212 | 85716, 116220, 146724, 177228, 207732 |
| 4495 | ADF27358 | 18526 | 49030 | 79534, 110038, 140542, 171046, 201550 | 10678 | AHL95334 | 24709 | 55213 | 85717, 116221, 146725, 177229, 207733 |
| 4496 | ADF27360 | 18527 | 49031 | 79535, 110039, 140543, 171047, 201551 | 10679 | AHL95423 | 24710 | 55214 | 85718, 116222, 146726, 177230, 207734 |
| 4497 | ADF27361 | 18528 | 49032 | 79536, 110040, 140544, 171048, 201552 | 10680 | AHL95435 | 24711 | 55215 | 85719, 116223, 146727, 177231, 207735 |
| 4498 | ADF27362 | 18529 | 49033 | 79537, 110041, 140545, 171049, 201553 | 10681 | AHL95447 | 24712 | 55216 | 85720, 116224, 146728, 177232, 207736 |
| 4499 | ADF27363 | 18530 | 49034 | 79538, 110042, 140546, 171050, 201554 | 10682 | AHL95461 | 24713 | 55217 | 85721, 116225, 146729, 177233, 207737 |
| 4500 | ADF27364 | 18531 | 49035 | 79539, 110043, 140547, 171051, 201555 | 10683 | AHL95473 | 24714 | 55218 | 85722, 116226, 146730, 177234, 207738 |
| 4501 | ADF27365 | 18532 | 49036 | 79540, 110044, 140548, 171052, 201556 | 10684 | AHL95485 | 24715 | 55219 | 85723, 116227, 146731, 177235, 207739 |
| 4502 | ADF27366 | 18533 | 49037 | 79541, 110045, 140549, 171053, 201557 | 10685 | AHL95497 | 24716 | 55220 | 85724, 116228, 146732, 177236, 207740 |
| 4503 | ADF27382 | 18534 | 49038 | 79542, 110046, 140550, 171054, 201558 | 10686 | AHL95509 | 24717 | 55221 | 85725, 116229, 146733, 177237, 207741 |
| 4504 | ADF27392 | 18535 | 49039 | 79543, 110047, 140551, 171055, 201559 | 10687 | AHL95521 | 24718 | 55222 | 85726, 116230, 146734, 177238, 207742 |
| 4505 | ADF27402 | 18536 | 49040 | 79544, 110048, 140552, 171056, 201560 | 10688 | AHL95533 | 24719 | 55223 | 85727, 116231, 146735, 177239, 207743 |
| 4506 | ADF27422 | 18537 | 49041 | 79545, 110049, 140553, 171057, 201561 | 10689 | AHL95545 | 24720 | 55224 | 85728, 116232, 146736, 177240, 207744 |
| 4507 | ADF27432 | 18538 | 49042 | 79546, 110050, 140554, 171058, 201562 | 10690 | AHL95557 | 24721 | 55225 | 85729, 116233, 146737, 177241, 207745 |
| 4508 | ADF27442 | 18539 | 49043 | 79547, 110051, 140555, 171059, 201563 | 10691 | AHL95569 | 24722 | 55226 | 85730, 116234, 146738, 177242, 207746 |
| 4509 | ADF27462 | 18540 | 49044 | 79548, 110052, 140556, 171060, 201564 | 10692 | AHL95581 | 24723 | 55227 | 85731, 116235, 146739, 177243, 207747 |
| 4510 | ADF27472 | 18541 | 49045 | 79549, 110053, 140557, 171061, 201565 | 10693 | AHL95605 | 24724 | 55228 | 85732, 116236, 146740, 177244, 207748 |
| 4511 | ADF27482 | 18542 | 49046 | 79550, 110054, 140558, 171062, 201566 | 10694 | AHL95617 | 24725 | 55229 | 85733, 116237, 146741, 177245, 207749 |

FIG. 3 continued

| | | | | | | | | | |
|---|---|---|---|---|---|---|---|---|---|
| 4512 | ADF27492 | 18543 | 49047 | 79551, 110055, 140559, 171063, 201567 | 10695 | AHL95629 | 24726 | 55230 | 85734, 116238, 146742, 177246, 207750 |
| 4513 | ADF27502 | 18544 | 49048 | 79552, 110056, 140560, 171064, 201568 | 10696 | AHL95641 | 24727 | 55231 | 85735, 116239, 146743, 177247, 207751 |
| 4514 | ADF27512 | 18545 | 49049 | 79553, 110057, 140561, 171065, 201569 | 10697 | AHL95653 | 24728 | 55232 | 85736, 116240, 146744, 177248, 207752 |
| 4515 | ADF27522 | 18546 | 49050 | 79554, 110058, 140562, 171066, 201570 | 10698 | AHL95665 | 24729 | 55233 | 85737, 116241, 146745, 177249, 207753 |
| 4516 | ADF27532 | 18547 | 49051 | 79555, 110059, 140563, 171067, 201571 | 10699 | AHL95677 | 24730 | 55234 | 85738, 116242, 146746, 177250, 207754 |
| 4517 | ADF27542 | 18548 | 49052 | 79556, 110060, 140564, 171068, 201572 | 10700 | AHL95689 | 24731 | 55235 | 85739, 116243, 146747, 177251, 207755 |
| 4518 | ADF27552 | 18549 | 49053 | 79557, 110061, 140565, 171069, 201573 | 10701 | AHL95701 | 24732 | 55236 | 85740, 116244, 146748, 177252, 207756 |
| 4519 | ADF27562 | 18550 | 49054 | 79558, 110062, 140566, 171070, 201574 | 10702 | AHL95713 | 24733 | 55237 | 85741, 116245, 146749, 177253, 207757 |
| 4520 | ADF27572 | 18551 | 49055 | 79559, 110063, 140567, 171071, 201575 | 10703 | AHL95725 | 24734 | 55238 | 85742, 116246, 146750, 177254, 207758 |
| 4521 | ADF27582 | 18552 | 49056 | 79560, 110064, 140568, 171072, 201576 | 10704 | AHL95737 | 24735 | 55239 | 85743, 116247, 146751, 177255, 207759 |
| 4522 | ADF27592 | 18553 | 49057 | 79561, 110065, 140569, 171073, 201577 | 10705 | AHL95749 | 24736 | 55240 | 85744, 116248, 146752, 177256, 207760 |
| 4523 | ADF27602 | 18554 | 49058 | 79562, 110066, 140570, 171074, 201578 | 10706 | AHL95761 | 24737 | 55241 | 85745, 116249, 146753, 177257, 207761 |
| 4524 | ADF27612 | 18555 | 49059 | 79563, 110067, 140571, 171075, 201579 | 10707 | AHL95773 | 24738 | 55242 | 85746, 116250, 146754, 177258, 207762 |
| 4525 | ADF27622 | 18556 | 49060 | 79564, 110068, 140572, 171076, 201580 | 10708 | AHL95785 | 24739 | 55243 | 85747, 116251, 146755, 177259, 207763 |
| 4526 | ADF27632 | 18557 | 49061 | 79565, 110069, 140573, 171077, 201581 | 10709 | AHL95797 | 24740 | 55244 | 85748, 116252, 146756, 177260, 207764 |
| 4527 | ADF27642 | 18558 | 49062 | 79566, 110070, 140574, 171078, 201582 | 10710 | AHL95833 | 24741 | 55245 | 85749, 116253, 146757, 177261, 207765 |
| 4528 | ADF27652 | 18559 | 49063 | 79567, 110071, 140575, 171079, 201583 | 10711 | AHL95845 | 24742 | 55246 | 85750, 116254, 146758, 177262, 207766 |
| 4529 | ADF27662 | 18560 | 49064 | 79568, 110072, 140576, 171080, 201584 | 10712 | AHL95857 | 24743 | 55247 | 85751, 116255, 146759, 177263, 207767 |

FIG. 3 continued

| | | | | | | | | | |
|---|---|---|---|---|---|---|---|---|---|
| 4530 | ADF27672 | 18561 | 49065 | 79569, 110073, 140577, 171081, 201585 | 10713 | AHL95869 | 24744 | 55248 | 85752, 116256, 146760, 177264, 207768 |
| 4531 | ADF27682 | 18562 | 49066 | 79570, 110074, 140578, 171082, 201586 | 10714 | AHL95881 | 24745 | 55249 | 85753, 116257, 146761, 177265, 207769 |
| 4532 | ADF27692 | 18563 | 49067 | 79571, 110075, 140579, 171083, 201587 | 10715 | AHL95892 | 24746 | 55250 | 85754, 116258, 146762, 177266, 207770 |
| 4533 | ADF27702 | 18564 | 49068 | 79572, 110076, 140580, 171084, 201588 | 10716 | AHL95904 | 24747 | 55251 | 85755, 116259, 146763, 177267, 207771 |
| 4534 | ADF27712 | 18565 | 49069 | 79573, 110077, 140581, 171085, 201589 | 10717 | AHL95916 | 24748 | 55252 | 85756, 116260, 146764, 177268, 207772 |
| 4535 | ADF27788 | 18566 | 49070 | 79574, 110078, 140582, 171086, 201590 | 10718 | AHL95928 | 24749 | 55253 | 85757, 116261, 146765, 177269, 207773 |
| 4536 | ADF27798 | 18567 | 49071 | 79575, 110079, 140583, 171087, 201591 | 10719 | AHL95940 | 24750 | 55254 | 85758, 116262, 146766, 177270, 207774 |
| 4537 | ADF27808 | 18568 | 49072 | 79576, 110080, 140584, 171088, 201592 | 10720 | AHL95952 | 24751 | 55255 | 85759, 116263, 146767, 177271, 207775 |
| 4538 | ADF27818 | 18569 | 49073 | 79577, 110081, 140585, 171089, 201593 | 10721 | AHL95964 | 24752 | 55256 | 85760, 116264, 146768, 177272, 207776 |
| 4539 | ADF27838 | 18570 | 49074 | 79578, 110082, 140586, 171090, 201594 | 10722 | AHL95976 | 24753 | 55257 | 85761, 116265, 146769, 177273, 207777 |
| 4540 | ADF27848 | 18571 | 49075 | 79579, 110083, 140587, 171091, 201595 | 10723 | AHL95988 | 24754 | 55258 | 85762, 116266, 146770, 177274, 207778 |
| 4541 | ADF27858 | 18572 | 49076 | 79580, 110084, 140588, 171092, 201596 | 10724 | AHL96000 | 24755 | 55259 | 85763, 116267, 146771, 177275, 207779 |
| 4542 | ADF27878 | 18573 | 49077 | 79581, 110085, 140589, 171093, 201597 | 10725 | AHL96012 | 24756 | 55260 | 85764, 116268, 146772, 177276, 207780 |
| 4543 | ADF27888 | 18574 | 49078 | 79582, 110086, 140590, 171094, 201598 | 10726 | AHL96024 | 24757 | 55261 | 85765, 116269, 146773, 177277, 207781 |
| 4544 | ADF27898 | 18575 | 49079 | 79583, 110087, 140591, 171095, 201599 | 10727 | AHL96036 | 24758 | 55262 | 85766, 116270, 146774, 177278, 207782 |
| 4545 | ADF27908 | 18576 | 49080 | 79584, 110088, 140592, 171096, 201600 | 10728 | AHL96048 | 24759 | 55263 | 85767, 116271, 146775, 177279, 207783 |
| 4546 | ADF27918 | 18577 | 49081 | 79585, 110089, 140593, 171097, 201601 | 10729 | AHL96059 | 24760 | 55264 | 85768, 116272, 146776, 177280, 207784 |
| 4547 | ADF27938 | 18578 | 49082 | 79586, 110090, 140594, 171098, 201602 | 10730 | AHL96071 | 24761 | 55265 | 85769, 116273, 146777, 177281, 207785 |

FIG. 3 continued

| | | | | | | | | | |
|---|---|---|---|---|---|---|---|---|---|
| 4548 | ADF27948 | 18579 | 49083 | 79587, 110091, 140595, 171099, 201603 | 10731 | AHL96083 | 24762 | 55266 | 85770, 116274, 146778, 177282, 207786 |
| 4549 | ADF27958 | 18580 | 49084 | 79588, 110092, 140596, 171100, 201604 | 10732 | AHL96095 | 24763 | 55267 | 85771, 116275, 146779, 177283, 207787 |
| 4550 | ADF27968 | 18581 | 49085 | 79589, 110093, 140597, 171101, 201605 | 10733 | AHL96107 | 24764 | 55268 | 85772, 116276, 146780, 177284, 207788 |
| 4551 | ADF27978 | 18582 | 49086 | 79590, 110094, 140598, 171102, 201606 | 10734 | AHL96119 | 24765 | 55269 | 85773, 116277, 146781, 177285, 207789 |
| 4552 | ADF27988 | 18583 | 49087 | 79591, 110095, 140599, 171103, 201607 | 10735 | AHL96131 | 24766 | 55270 | 85774, 116278, 146782, 177286, 207790 |
| 4553 | ADF27998 | 18584 | 49088 | 79592, 110096, 140600, 171104, 201608 | 10736 | AHL96143 | 24767 | 55271 | 85775, 116279, 146783, 177287, 207791 |
| 4554 | ADF28008 | 18585 | 49089 | 79593, 110097, 140601, 171105, 201609 | 10737 | AHL96167 | 24768 | 55272 | 85776, 116280, 146784, 177288, 207792 |
| 4555 | ADF28018 | 18586 | 49090 | 79594, 110098, 140602, 171106, 201610 | 10738 | AHL96179 | 24769 | 55273 | 85777, 116281, 146785, 177289, 207793 |
| 4556 | ADF28028 | 18587 | 49091 | 79595, 110099, 140603, 171107, 201611 | 10739 | AHL96191 | 24770 | 55274 | 85778, 116282, 146786, 177290, 207794 |
| 4557 | ADF28038 | 18588 | 49092 | 79596, 110100, 140604, 171108, 201612 | 10740 | AHL96203 | 24771 | 55275 | 85779, 116283, 146787, 177291, 207795 |
| 4558 | ADF28048 | 18589 | 49093 | 79597, 110101, 140605, 171109, 201613 | 10741 | AHL96215 | 24772 | 55276 | 85780, 116284, 146788, 177292, 207796 |
| 4559 | ADF28058 | 18590 | 49094 | 79598, 110102, 140606, 171110, 201614 | 10742 | AHL96227 | 24773 | 55277 | 85781, 116285, 146789, 177293, 207797 |
| 4560 | ADF28068 | 18591 | 49095 | 79599, 110103, 140607, 171111, 201615 | 10743 | AHL96239 | 24774 | 55278 | 85782, 116286, 146790, 177294, 207798 |
| 4561 | ADF28078 | 18592 | 49096 | 79600, 110104, 140608, 171112, 201616 | 10744 | AHL96251 | 24775 | 55279 | 85783, 116287, 146791, 177295, 207799 |
| 4562 | ADF28088 | 18593 | 49097 | 79601, 110105, 140609, 171113, 201617 | 10745 | AHL96263 | 24776 | 55280 | 85784, 116288, 146792, 177296, 207800 |
| 4563 | ADF28110 | 18594 | 49098 | 79602, 110106, 140610, 171114, 201618 | 10746 | AHL96277 | 24777 | 55281 | 85785, 116289, 146793, 177297, 207801 |
| 4564 | ADF28120 | 18595 | 49099 | 79603, 110107, 140611, 171115, 201619 | 10747 | AHL96308 | 24778 | 55282 | 85786, 116290, 146794, 177298, 207802 |
| 4565 | ADF29919 | 18596 | 49100 | 79604, 110108, 140612, 171116, 201620 | 10748 | AHL96321 | 24779 | 55283 | 85787, 116291, 146795, 177299, 207803 |

FIG. 3 continued

| | | | | | | | | | |
|---|---|---|---|---|---|---|---|---|---|
| 4566 | ADF42692 | 18597 | 49101 | 79605, 110109, 140613, 171117, 201621 | 10749 | AHL96333 | 24780 | 55284 | 85788, 116292, 146796, 177300, 207804 |
| 4567 | ADF42702 | 18598 | 49102 | 79606, 110110, 140614, 171118, 201622 | 10750 | AHL96345 | 24781 | 55285 | 85789, 116293, 146797, 177301, 207805 |
| 4568 | ADF42712 | 18599 | 49103 | 79607, 110111, 140615, 171119, 201623 | 10751 | AHL96357 | 24782 | 55286 | 85790, 116294, 146798, 177302, 207806 |
| 4569 | ADF42722 | 18600 | 49104 | 79608, 110112, 140616, 171120, 201624 | 10752 | AHL96369 | 24783 | 55287 | 85791, 116295, 146799, 177303, 207807 |
| 4570 | ADF42732 | 18601 | 49105 | 79609, 110113, 140617, 171121, 201625 | 10753 | AHL96381 | 24784 | 55288 | 85792, 116296, 146800, 177304, 207808 |
| 4571 | ADF42742 | 18602 | 49106 | 79610, 110114, 140618, 171122, 201626 | 10754 | AHL96393 | 24785 | 55289 | 85793, 116297, 146801, 177305, 207809 |
| 4572 | ADF58339 | 18603 | 49107 | 79611, 110115, 140619, 171123, 201627 | 10755 | AHL96405 | 24786 | 55290 | 85794, 116298, 146802, 177306, 207810 |
| 4573 | ADF58348 | 18604 | 49108 | 79612, 110116, 140620, 171124, 201628 | 10756 | AHL96417 | 24787 | 55291 | 85795, 116299, 146803, 177307, 207811 |
| 4574 | ADF58350 | 18605 | 49109 | 79613, 110117, 140621, 171125, 201629 | 10757 | AHL96429 | 24788 | 55292 | 85796, 116300, 146804, 177308, 207812 |
| 4575 | ADF58352 | 18606 | 49110 | 79614, 110118, 140622, 171126, 201630 | 10758 | AHL96441 | 24789 | 55293 | 85797, 116301, 146805, 177309, 207813 |
| 4576 | ADF80459 | 18607 | 49111 | 79615, 110119, 140623, 171127, 201631 | 10759 | AHL96453 | 24790 | 55294 | 85798, 116302, 146806, 177310, 207814 |
| 4577 | ADF80503 | 18608 | 49112 | 79616, 110120, 140624, 171128, 201632 | 10760 | AHL96465 | 24791 | 55295 | 85799, 116303, 146807, 177311, 207815 |
| 4578 | ADF83744 | 18609 | 49113 | 79617, 110121, 140625, 171129, 201633 | 10761 | AHL96477 | 24792 | 55296 | 85800, 116304, 146808, 177312, 207816 |
| 4579 | ADF83755 | 18610 | 49114 | 79618, 110122, 140626, 171130, 201634 | 10762 | AHL96488 | 24793 | 55297 | 85801, 116305, 146809, 177313, 207817 |
| 4580 | ADF83766 | 18611 | 49115 | 79619, 110123, 140627, 171131, 201635 | 10763 | AHL96500 | 24794 | 55298 | 85802, 116306, 146810, 177314, 207818 |
| 4581 | ADF83776 | 18612 | 49116 | 79620, 110124, 140628, 171132, 201636 | 10764 | AHL96512 | 24795 | 55299 | 85803, 116307, 146811, 177315, 207819 |
| 4582 | ADF83786 | 18613 | 49117 | 79621, 110125, 140629, 171133, 201637 | 10765 | AHL96524 | 24796 | 55300 | 85804, 116308, 146812, 177316, 207820 |
| 4583 | ADF83796 | 18614 | 49118 | 79622, 110126, 140630, 171134, 201638 | 10766 | AHL96536 | 24797 | 55301 | 85805, 116309, 146813, 177317, 207821 |

FIG. 3 continued

| | | | | | | | | | |
|---|---|---|---|---|---|---|---|---|---|
| 4584 | ADF83806 | 18615 | 49119 | 79623, 110127, 140631, 171135, 201639 | 10767 | AHL96548 | 24798 | 55302 | 85806, 116310, 146814, 177318, 207822 |
| 4585 | ADF83816 | 18616 | 49120 | 79624, 110128, 140632, 171136, 201640 | 10768 | AHL96560 | 24799 | 55303 | 85807, 116311, 146815, 177319, 207823 |
| 4586 | ADF83826 | 18617 | 49121 | 79625, 110129, 140633, 171137, 201641 | 10769 | AHL96572 | 24800 | 55304 | 85808, 116312, 146816, 177320, 207824 |
| 4587 | ADF83836 | 18618 | 49122 | 79626, 110130, 140634, 171138, 201642 | 10770 | AHL96584 | 24801 | 55305 | 85809, 116313, 146817, 177321, 207825 |
| 4588 | ADF83846 | 18619 | 49123 | 79627, 110131, 140635, 171139, 201643 | 10771 | AHL96595 | 24802 | 55306 | 85810, 116314, 146818, 177322, 207826 |
| 4589 | ADF83856 | 18620 | 49124 | 79628, 110132, 140636, 171140, 201644 | 10772 | AHL96607 | 24803 | 55307 | 85811, 116315, 146819, 177323, 207827 |
| 4590 | ADF83866 | 18621 | 49125 | 79629, 110133, 140637, 171141, 201645 | 10773 | AHL96631 | 24804 | 55308 | 85812, 116316, 146820, 177324, 207828 |
| 4591 | ADF83876 | 18622 | 49126 | 79630, 110134, 140638, 171142, 201646 | 10774 | AHL96643 | 24805 | 55309 | 85813, 116317, 146821, 177325, 207829 |
| 4592 | ADF83888 | 18623 | 49127 | 79631, 110135, 140639, 171143, 201647 | 10775 | AHL96655 | 24806 | 55310 | 85814, 116318, 146822, 177326, 207830 |
| 4593 | ADF83898 | 18624 | 49128 | 79632, 110136, 140640, 171144, 201648 | 10776 | AHL96667 | 24807 | 55311 | 85815, 116319, 146823, 177327, 207831 |
| 4594 | ADF83908 | 18625 | 49129 | 79633, 110137, 140641, 171145, 201649 | 10777 | AHL96679 | 24808 | 55312 | 85816, 116320, 146824, 177328, 207832 |
| 4595 | ADF83918 | 18626 | 49130 | 79634, 110138, 140642, 171146, 201650 | 10778 | AHL96691 | 24809 | 55313 | 85817, 116321, 146825, 177329, 207833 |
| 4596 | ADF84444 | 18627 | 49131 | 79635, 110139, 140643, 171147, 201651 | 10779 | AHL96703 | 24810 | 55314 | 85818, 116322, 146826, 177330, 207834 |
| 4597 | ADF84462 | 18628 | 49132 | 79636, 110140, 140644, 171148, 201652 | 10780 | AHL96763 | 24811 | 55315 | 85819, 116323, 146827, 177331, 207835 |
| 4598 | ADF84472 | 18629 | 49133 | 79637, 110141, 140645, 171149, 201653 | 10781 | AHL96787 | 24812 | 55316 | 85820, 116324, 146828, 177332, 207836 |
| 4599 | ADF84482 | 18630 | 49134 | 79638, 110142, 140646, 171150, 201654 | 10782 | AHL96799 | 24813 | 55317 | 85821, 116325, 146829, 177333, 207837 |
| 4600 | ADF84492 | 18631 | 49135 | 79639, 110143, 140647, 171151, 201655 | 10783 | AHL96811 | 24814 | 55318 | 85822, 116326, 146830, 177334, 207838 |
| 4601 | ADF85020 | 18632 | 49136 | 79640, 110144, 140648, 171152, 201656 | 10784 | AHL96823 | 24815 | 55319 | 85823, 116327, 146831, 177335, 207839 |

FIG. 3 continued

| | | | | | | | | | |
|---|---|---|---|---|---|---|---|---|---|
| 4602 | ADF87155 | 18633 | 49137 | 79641, 110145, 140649, 171153, 201657 | 10785 | AHL96847 | 24816 | 55320 | 85824, 116328, 146832, 177336, 207840 |
| 4603 | ADF87165 | 18634 | 49138 | 79642, 110146, 140650, 171154, 201658 | 10786 | AHL96859 | 24817 | 55321 | 85825, 116329, 146833, 177337, 207841 |
| 4604 | ADF87175 | 18635 | 49139 | 79643, 110147, 140651, 171155, 201659 | 10787 | AHL96871 | 24818 | 55322 | 85826, 116330, 146834, 177338, 207842 |
| 4605 | ADF87185 | 18636 | 49140 | 79644, 110148, 140652, 171156, 201660 | 10788 | AHL96883 | 24819 | 55323 | 85827, 116331, 146835, 177339, 207843 |
| 4606 | ADF87195 | 18637 | 49141 | 79645, 110149, 140653, 171157, 201661 | 10789 | AHL96895 | 24820 | 55324 | 85828, 116332, 146836, 177340, 207844 |
| 4607 | ADF87205 | 18638 | 49142 | 79646, 110150, 140654, 171158, 201662 | 10790 | AHL96907 | 24821 | 55325 | 85829, 116333, 146837, 177341, 207845 |
| 4608 | ADF87215 | 18639 | 49143 | 79647, 110151, 140655, 171159, 201663 | 10791 | AHL96919 | 24822 | 55326 | 85830, 116334, 146838, 177342, 207846 |
| 4609 | ADF87235 | 18640 | 49144 | 79648, 110152, 140656, 171160, 201664 | 10792 | AHL96931 | 24823 | 55327 | 85831, 116335, 146839, 177343, 207847 |
| 4610 | ADF87245 | 18641 | 49145 | 79649, 110153, 140657, 171161, 201665 | 10793 | AHL96943 | 24824 | 55328 | 85832, 116336, 146840, 177344, 207848 |
| 4611 | ADF87265 | 18642 | 49146 | 79650, 110154, 140658, 171162, 201666 | 10794 | AHL96955 | 24825 | 55329 | 85833, 116337, 146841, 177345, 207849 |
| 4612 | ADF87285 | 18643 | 49147 | 79651, 110155, 140659, 171163, 201667 | 10795 | AHL96967 | 24826 | 55330 | 85834, 116338, 146842, 177346, 207850 |
| 4613 | ADF87295 | 18644 | 49148 | 79652, 110156, 140660, 171164, 201668 | 10796 | AHL96979 | 24827 | 55331 | 85835, 116339, 146843, 177347, 207851 |
| 4614 | ADF87305 | 18645 | 49149 | 79653, 110157, 140661, 171165, 201669 | 10797 | AHL96991 | 24828 | 55332 | 85836, 116340, 146844, 177348, 207852 |
| 4615 | ADF87334 | 18646 | 49150 | 79654, 110158, 140662, 171166, 201670 | 10798 | AHL97003 | 24829 | 55333 | 85837, 116341, 146845, 177349, 207853 |
| 4616 | ADF87344 | 18647 | 49151 | 79655, 110159, 140663, 171167, 201671 | 10799 | AHL97015 | 24830 | 55334 | 85838, 116342, 146846, 177350, 207854 |
| 4617 | ADF87354 | 18648 | 49152 | 79656, 110160, 140664, 171168, 201672 | 10800 | AHL97027 | 24831 | 55335 | 85839, 116343, 146847, 177351, 207855 |
| 4618 | ADF87364 | 18649 | 49153 | 79657, 110161, 140665, 171169, 201673 | 10801 | AHL97039 | 24832 | 55336 | 85840, 116344, 146848, 177352, 207856 |
| 4619 | ADF87374 | 18650 | 49154 | 79658, 110162, 140666, 171170, 201674 | 10802 | AHL97051 | 24833 | 55337 | 85841, 116345, 146849, 177353, 207857 |

FIG. 3 continued

| | | | | | | | | | |
|---|---|---|---|---|---|---|---|---|---|
| 4620 | ADF87384 | 18651 | 49155 | 79659, 110163, 140667, 171171, 201675 | 10803 | AHL97063 | 24834 | 55338 | 85842, 116346, 146850, 177354, 207858 |
| 4621 | ADF97251 | 18652 | 49156 | 79660, 110164, 140668, 171172, 201676 | 10804 | AHL97075 | 24835 | 55339 | 85843, 116347, 146851, 177355, 207859 |
| 4622 | ADF97252 | 18653 | 49157 | 79661, 110165, 140669, 171173, 201677 | 10805 | AHL97087 | 24836 | 55340 | 85844, 116348, 146852, 177356, 207860 |
| 4623 | ADF97253 | 18654 | 49158 | 79662, 110166, 140670, 171174, 201678 | 10806 | AHL97099 | 24837 | 55341 | 85845, 116349, 146853, 177357, 207861 |
| 4624 | ADF97254 | 18655 | 49159 | 79663, 110167, 140671, 171175, 201679 | 10807 | AHL97111 | 24838 | 55342 | 85846, 116350, 146854, 177358, 207862 |
| 4625 | ADF97255 | 18656 | 49160 | 79664, 110168, 140672, 171176, 201680 | 10808 | AHL97123 | 24839 | 55343 | 85847, 116351, 146855, 177359, 207863 |
| 4626 | ADF97256 | 18657 | 49161 | 79665, 110169, 140673, 171177, 201681 | 10809 | AHL97135 | 24840 | 55344 | 85848, 116352, 146856, 177360, 207864 |
| 4627 | ADF97257 | 18658 | 49162 | 79666, 110170, 140674, 171178, 201682 | 10810 | AHL97147 | 24841 | 55345 | 85849, 116353, 146857, 177361, 207865 |
| 4628 | ADF97837 | 18659 | 49163 | 79667, 110171, 140675, 171179, 201683 | 10811 | AHL97159 | 24842 | 55346 | 85850, 116354, 146858, 177362, 207866 |
| 4629 | ADG08120 | 18660 | 49164 | 79668, 110172, 140676, 171180, 201684 | 10812 | AHL97171 | 24843 | 55347 | 85851, 116355, 146859, 177363, 207867 |
| 4630 | ADG21408 | 18661 | 49165 | 79669, 110173, 140677, 171181, 201685 | 10813 | AHL97183 | 24844 | 55348 | 85852, 116356, 146860, 177364, 207868 |
| 4631 | ADG21409 | 18662 | 49166 | 79670, 110174, 140678, 171182, 201686 | 10814 | AHL97195 | 24845 | 55349 | 85853, 116357, 146861, 177365, 207869 |
| 4632 | ADG21415 | 18663 | 49167 | 79671, 110175, 140679, 171183, 201687 | 10815 | AHL97207 | 24846 | 55350 | 85854, 116358, 146862, 177366, 207870 |
| 4633 | ADG21417 | 18664 | 49168 | 79672, 110176, 140680, 171184, 201688 | 10816 | AHL97219 | 24847 | 55351 | 85855, 116359, 146863, 177367, 207871 |
| 4634 | ADG21419 | 18665 | 49169 | 79673, 110177, 140681, 171185, 201689 | 10817 | AHL97231 | 24848 | 55352 | 85856, 116360, 146864, 177368, 207872 |
| 4635 | ADG21423 | 18666 | 49170 | 79674, 110178, 140682, 171186, 201690 | 10818 | AHL97243 | 24849 | 55353 | 85857, 116361, 146865, 177369, 207873 |
| 4636 | ADG21424 | 18667 | 49171 | 79675, 110179, 140683, 171187, 201691 | 10819 | AHL97255 | 24850 | 55354 | 85858, 116362, 146866, 177370, 207874 |
| 4637 | ADG21426 | 18668 | 49172 | 79676, 110180, 140684, 171188, 201692 | 10820 | AHL97267 | 24851 | 55355 | 85859, 116363, 146867, 177371, 207875 |

FIG. 3 continued

| | | | | | | | | | |
|---|---|---|---|---|---|---|---|---|---|
| 4638 | ADG21428 | 18669 | 49173 | 79677, 110181, 140685, 171189, 201693 | 10821 | AHL97279 | 24852 | 55356 | 85860, 116364, 146868, 177372, 207876 |
| 4639 | ADG21430 | 18670 | 49174 | 79678, 110182, 140686, 171190, 201694 | 10822 | AHL97291 | 24853 | 55357 | 85861, 116365, 146869, 177373, 207877 |
| 4640 | ADG21432 | 18671 | 49175 | 79679, 110183, 140687, 171191, 201695 | 10823 | AHL97303 | 24854 | 55358 | 85862, 116366, 146870, 177374, 207878 |
| 4641 | ADG21438 | 18672 | 49176 | 79680, 110184, 140688, 171192, 201696 | 10824 | AHL97339 | 24855 | 55359 | 85863, 116367, 146871, 177375, 207879 |
| 4642 | ADG21440 | 18673 | 49177 | 79681, 110185, 140689, 171193, 201697 | 10825 | AHL97351 | 24856 | 55360 | 85864, 116368, 146872, 177376, 207880 |
| 4643 | ADG21442 | 18674 | 49178 | 79682, 110186, 140690, 171194, 201698 | 10826 | AHL97363 | 24857 | 55361 | 85865, 116369, 146873, 177377, 207881 |
| 4644 | ADG21444 | 18675 | 49179 | 79683, 110187, 140691, 171195, 201699 | 10827 | AHL97387 | 24858 | 55362 | 85866, 116370, 146874, 177378, 207882 |
| 4645 | ADG21446 | 18676 | 49180 | 79684, 110188, 140692, 171196, 201700 | 10828 | AHL97399 | 24859 | 55363 | 85867, 116371, 146875, 177379, 207883 |
| 4646 | ADG21448 | 18677 | 49181 | 79685, 110189, 140693, 171197, 201701 | 10829 | AHL97411 | 24860 | 55364 | 85868, 116372, 146876, 177380, 207884 |
| 4647 | ADG21450 | 18678 | 49182 | 79686, 110190, 140694, 171198, 201702 | 10830 | AHL97423 | 24861 | 55365 | 85869, 116373, 146877, 177381, 207885 |
| 4648 | ADG27797 | 18679 | 49183 | 79687, 110191, 140695, 171199, 201703 | 10831 | AHL97447 | 24862 | 55366 | 85870, 116374, 146878, 177382, 207886 |
| 4649 | ADG27983 | 18680 | 49184 | 79688, 110192, 140696, 171200, 201704 | 10832 | AHL97459 | 24863 | 55367 | 85871, 116375, 146879, 177383, 207887 |
| 4650 | ADG27989 | 18681 | 49185 | 79689, 110193, 140697, 171201, 201705 | 10833 | AHL97471 | 24864 | 55368 | 85872, 116376, 146880, 177384, 207888 |
| 4651 | ADG27998 | 18682 | 49186 | 79690, 110194, 140698, 171202, 201706 | 10834 | AHL97483 | 24865 | 55369 | 85873, 116377, 146881, 177385, 207889 |
| 4652 | ADG28013 | 18683 | 49187 | 79691, 110195, 140699, 171203, 201707 | 10835 | AHL97496 | 24866 | 55370 | 85874, 116378, 146882, 177386, 207890 |
| 4653 | ADG42086 | 18684 | 49188 | 79692, 110196, 140700, 171204, 201708 | 10836 | AHL97508 | 24867 | 55371 | 85875, 116379, 146883, 177387, 207891 |
| 4654 | ADG42096 | 18685 | 49189 | 79693, 110197, 140701, 171205, 201709 | 10837 | AHL97520 | 24868 | 55372 | 85876, 116380, 146884, 177388, 207892 |
| 4655 | ADG42106 | 18686 | 49190 | 79694, 110198, 140702, 171206, 201710 | 10838 | AHL97532 | 24869 | 55373 | 85877, 116381, 146885, 177389, 207893 |

FIG. 3 continued

| | | | | | | | | | |
|---|---|---|---|---|---|---|---|---|---|
| 4656 | ADG42116 | 18687 | 49191 | 79695, 110199, 140703, 171207, 201711 | 10839 | AHL97544 | 24870 | 55374 | 85878, 116382, 146886, 177390, 207894 |
| 4657 | ADG42126 | 18688 | 49192 | 79696, 110200, 140704, 171208, 201712 | 10840 | AHL97556 | 24871 | 55375 | 85879, 116383, 146887, 177391, 207895 |
| 4658 | ADG42136 | 18689 | 49193 | 79697, 110201, 140705, 171209, 201713 | 10841 | AHL97568 | 24872 | 55376 | 85880, 116384, 146888, 177392, 207896 |
| 4659 | ADG42146 | 18690 | 49194 | 79698, 110202, 140706, 171210, 201714 | 10842 | AHL97580 | 24873 | 55377 | 85881, 116385, 146889, 177393, 207897 |
| 4660 | ADG42156 | 18691 | 49195 | 79699, 110203, 140707, 171211, 201715 | 10843 | AHL97592 | 24874 | 55378 | 85882, 116386, 146890, 177394, 207898 |
| 4661 | ADG42166 | 18692 | 49196 | 79700, 110204, 140708, 171212, 201716 | 10844 | AHL97604 | 24875 | 55379 | 85883, 116387, 146891, 177395, 207899 |
| 4662 | ADG42186 | 18693 | 49197 | 79701, 110205, 140709, 171213, 201717 | 10845 | AHL97616 | 24876 | 55380 | 85884, 116388, 146892, 177396, 207900 |
| 4663 | ADG42196 | 18694 | 49198 | 79702, 110206, 140710, 171214, 201718 | 10846 | AHL97628 | 24877 | 55381 | 85885, 116389, 146893, 177397, 207901 |
| 4664 | ADG42206 | 18695 | 49199 | 79703, 110207, 140711, 171215, 201719 | 10847 | AHL97640 | 24878 | 55382 | 85886, 116390, 146894, 177398, 207902 |
| 4665 | ADG42216 | 18696 | 49200 | 79704, 110208, 140712, 171216, 201720 | 10848 | AHL97652 | 24879 | 55383 | 85887, 116391, 146895, 177399, 207903 |
| 4666 | ADG42226 | 18697 | 49201 | 79705, 110209, 140713, 171217, 201721 | 10849 | AHL97664 | 24880 | 55384 | 85888, 116392, 146896, 177400, 207904 |
| 4667 | ADG42236 | 18698 | 49202 | 79706, 110210, 140714, 171218, 201722 | 10850 | AHL97676 | 24881 | 55385 | 85889, 116393, 146897, 177401, 207905 |
| 4668 | ADG42246 | 18699 | 49203 | 79707, 110211, 140715, 171219, 201723 | 10851 | AHL97688 | 24882 | 55386 | 85890, 116394, 146898, 177402, 207906 |
| 4669 | ADG42256 | 18700 | 49204 | 79708, 110212, 140716, 171220, 201724 | 10852 | AHL97700 | 24883 | 55387 | 85891, 116395, 146899, 177403, 207907 |
| 4670 | ADG42276 | 18701 | 49205 | 79709, 110213, 140717, 171221, 201725 | 10853 | AHL97712 | 24884 | 55388 | 85892, 116396, 146900, 177404, 207908 |
| 4671 | ADG42296 | 18702 | 49206 | 79710, 110214, 140718, 171222, 201726 | 10854 | AHL97724 | 24885 | 55389 | 85893, 116397, 146901, 177405, 207909 |
| 4672 | ADG42306 | 18703 | 49207 | 79711, 110215, 140719, 171223, 201727 | 10855 | AHL97736 | 24886 | 55390 | 85894, 116398, 146902, 177406, 207910 |
| 4673 | ADG42316 | 18704 | 49208 | 79712, 110216, 140720, 171224, 201728 | 10856 | AHL97760 | 24887 | 55391 | 85895, 116399, 146903, 177407, 207911 |

FIG. 3 continued

| | | | | | | | | | |
|---|---|---|---|---|---|---|---|---|---|
| 4674 | ADG42326 | 18705 | 49209 | 79713, 110217, 140721, 171225, 201729 | 10857 | AHL97772 | 24888 | 55392 | 85896, 116400, 146904, 177408, 207912 |
| 4675 | ADG42336 | 18706 | 49210 | 79714, 110218, 140722, 171226, 201730 | 10858 | AHL97784 | 24889 | 55393 | 85897, 116401, 146905, 177409, 207913 |
| 4676 | ADG42346 | 18707 | 49211 | 79715, 110219, 140723, 171227, 201731 | 10859 | AHL97796 | 24890 | 55394 | 85898, 116402, 146906, 177410, 207914 |
| 4677 | ADG42356 | 18708 | 49212 | 79716, 110220, 140724, 171228, 201732 | 10860 | AHL97808 | 24891 | 55395 | 85899, 116403, 146907, 177411, 207915 |
| 4678 | ADG42366 | 18709 | 49213 | 79717, 110221, 140725, 171229, 201733 | 10861 | AHL97820 | 24892 | 55396 | 85900, 116404, 146908, 177412, 207916 |
| 4679 | ADG42376 | 18710 | 49214 | 79718, 110222, 140726, 171230, 201734 | 10862 | AHL97832 | 24893 | 55397 | 85901, 116405, 146909, 177413, 207917 |
| 4680 | ADG42386 | 18711 | 49215 | 79719, 110223, 140727, 171231, 201735 | 10863 | AHL97844 | 24894 | 55398 | 85902, 116406, 146910, 177414, 207918 |
| 4681 | ADG42396 | 18712 | 49216 | 79720, 110224, 140728, 171232, 201736 | 10864 | AHL97856 | 24895 | 55399 | 85903, 116407, 146911, 177415, 207919 |
| 4682 | ADG42406 | 18713 | 49217 | 79721, 110225, 140729, 171233, 201737 | 10865 | AHL97868 | 24896 | 55400 | 85904, 116408, 146912, 177416, 207920 |
| 4683 | ADG42426 | 18714 | 49218 | 79722, 110226, 140730, 171234, 201738 | 10866 | AHL97880 | 24897 | 55401 | 85905, 116409, 146913, 177417, 207921 |
| 4684 | ADG42436 | 18715 | 49219 | 79723, 110227, 140731, 171235, 201739 | 10867 | AHL97892 | 24898 | 55402 | 85906, 116410, 146914, 177418, 207922 |
| 4685 | ADG42446 | 18716 | 49220 | 79724, 110228, 140732, 171236, 201740 | 10868 | AHL97904 | 24899 | 55403 | 85907, 116411, 146915, 177419, 207923 |
| 4686 | ADG42456 | 18717 | 49221 | 79725, 110229, 140733, 171237, 201741 | 10869 | AHL97916 | 24900 | 55404 | 85908, 116412, 146916, 177420, 207924 |
| 4687 | ADG42466 | 18718 | 49222 | 79726, 110230, 140734, 171238, 201742 | 10870 | AHL97928 | 24901 | 55405 | 85909, 116413, 146917, 177421, 207925 |
| 4688 | ADG42476 | 18719 | 49223 | 79727, 110231, 140735, 171239, 201743 | 10871 | AHL97952 | 24902 | 55406 | 85910, 116414, 146918, 177422, 207926 |
| 4689 | ADG42486 | 18720 | 49224 | 79728, 110232, 140736, 171240, 201744 | 10872 | AHL97964 | 24903 | 55407 | 85911, 116415, 146919, 177423, 207927 |
| 4690 | ADG42496 | 18721 | 49225 | 79729, 110233, 140737, 171241, 201745 | 10873 | AHL97976 | 24904 | 55408 | 85912, 116416, 146920, 177424, 207928 |
| 4691 | ADG42506 | 18722 | 49226 | 79730, 110234, 140738, 171242, 201746 | 10874 | AHL97988 | 24905 | 55409 | 85913, 116417, 146921, 177425, 207929 |

FIG. 3 continued

| | | | | | | | | | |
|---|---|---|---|---|---|---|---|---|---|
| 4692 | ADG42516 | 18723 | 49227 | 79731, 110235, 140739, 171243, 201747 | 10875 | AHL98000 | 24906 | 55410 | 85914, 116418, 146922, 177426, 207930 |
| 4693 | ADG42526 | 18724 | 49228 | 79732, 110236, 140740, 171244, 201748 | 10876 | AHL98012 | 24907 | 55411 | 85915, 116419, 146923, 177427, 207931 |
| 4694 | ADG42536 | 18725 | 49229 | 79733, 110237, 140741, 171245, 201749 | 10877 | AHL98048 | 24908 | 55412 | 85916, 116420, 146924, 177428, 207932 |
| 4695 | ADG42546 | 18726 | 49230 | 79734, 110238, 140742, 171246, 201750 | 10878 | AHL98060 | 24909 | 55413 | 85917, 116421, 146925, 177429, 207933 |
| 4696 | ADG42556 | 18727 | 49231 | 79735, 110239, 140743, 171247, 201751 | 10879 | AHL98072 | 24910 | 55414 | 85918, 116422, 146926, 177430, 207934 |
| 4697 | ADG42566 | 18728 | 49232 | 79736, 110240, 140744, 171248, 201752 | 10880 | AHL98084 | 24911 | 55415 | 85919, 116423, 146927, 177431, 207935 |
| 4698 | ADG42576 | 18729 | 49233 | 79737, 110241, 140745, 171249, 201753 | 10881 | AHL98096 | 24912 | 55416 | 85920, 116424, 146928, 177432, 207936 |
| 4699 | ADG42586 | 18730 | 49234 | 79738, 110242, 140746, 171250, 201754 | 10882 | AHL98119 | 24913 | 55417 | 85921, 116425, 146929, 177433, 207937 |
| 4700 | ADG42606 | 18731 | 49235 | 79739, 110243, 140747, 171251, 201755 | 10883 | AHL98131 | 24914 | 55418 | 85922, 116426, 146930, 177434, 207938 |
| 4701 | ADG42616 | 18732 | 49236 | 79740, 110244, 140748, 171252, 201756 | 10884 | AHL98143 | 24915 | 55419 | 85923, 116427, 146931, 177435, 207939 |
| 4702 | ADG42626 | 18733 | 49237 | 79741, 110245, 140749, 171253, 201757 | 10885 | AHL98155 | 24916 | 55420 | 85924, 116428, 146932, 177436, 207940 |
| 4703 | ADG42636 | 18734 | 49238 | 79742, 110246, 140750, 171254, 201758 | 10886 | AHL98167 | 24917 | 55421 | 85925, 116429, 146933, 177437, 207941 |
| 4704 | ADG42646 | 18735 | 49239 | 79743, 110247, 140751, 171255, 201759 | 10887 | AHL98179 | 24918 | 55422 | 85926, 116430, 146934, 177438, 207942 |
| 4705 | ADG42656 | 18736 | 49240 | 79744, 110248, 140752, 171256, 201760 | 10888 | AHL98191 | 24919 | 55423 | 85927, 116431, 146935, 177439, 207943 |
| 4706 | ADG42666 | 18737 | 49241 | 79745, 110249, 140753, 171257, 201761 | 10889 | AHL98215 | 24920 | 55424 | 85928, 116432, 146936, 177440, 207944 |
| 4707 | ADG42676 | 18738 | 49242 | 79746, 110250, 140754, 171258, 201762 | 10890 | AHL98227 | 24921 | 55425 | 85929, 116433, 146937, 177441, 207945 |
| 4708 | ADG42686 | 18739 | 49243 | 79747, 110251, 140755, 171259, 201763 | 10891 | AHL98239 | 24922 | 55426 | 85930, 116434, 146938, 177442, 207946 |
| 4709 | ADG42696 | 18740 | 49244 | 79748, 110252, 140756, 171260, 201764 | 10892 | AHL98251 | 24923 | 55427 | 85931, 116435, 146939, 177443, 207947 |

FIG. 3 continued

| | | | | | | | | | |
|---|---|---|---|---|---|---|---|---|---|
| 4710 | ADG42706 | 18741 | 49245 | 79749, 110253, 140757, 171261, 201765 | 10893 | AHL98263 | 24924 | 55428 | 85932, 116436, 146940, 177444, 207948 |
| 4711 | ADG42716 | 18742 | 49246 | 79750, 110254, 140758, 171262, 201766 | 10894 | AHL98275 | 24925 | 55429 | 85933, 116437, 146941, 177445, 207949 |
| 4712 | ADG42726 | 18743 | 49247 | 79751, 110255, 140759, 171263, 201767 | 10895 | AHL98287 | 24926 | 55430 | 85934, 116438, 146942, 177446, 207950 |
| 4713 | ADG42746 | 18744 | 49248 | 79752, 110256, 140760, 171264, 201768 | 10896 | AHL98298 | 24927 | 55431 | 85935, 116439, 146943, 177447, 207951 |
| 4714 | ADG42756 | 18745 | 49249 | 79753, 110257, 140761, 171265, 201769 | 10897 | AHL98310 | 24928 | 55432 | 85936, 116440, 146944, 177448, 207952 |
| 4715 | ADG42766 | 18746 | 49250 | 79754, 110258, 140762, 171266, 201770 | 10898 | AHL98322 | 24929 | 55433 | 85937, 116441, 146945, 177449, 207953 |
| 4716 | ADG42776 | 18747 | 49251 | 79755, 110259, 140763, 171267, 201771 | 10899 | AHL98334 | 24930 | 55434 | 85938, 116442, 146946, 177450, 207954 |
| 4717 | ADG42796 | 18748 | 49252 | 79756, 110260, 140764, 171268, 201772 | 10900 | AHL98346 | 24931 | 55435 | 85939, 116443, 146947, 177451, 207955 |
| 4718 | ADG42806 | 18749 | 49253 | 79757, 110261, 140765, 171269, 201773 | 10901 | AHL98357 | 24932 | 55436 | 85940, 116444, 146948, 177452, 207956 |
| 4719 | ADG42816 | 18750 | 49254 | 79758, 110262, 140766, 171270, 201774 | 10902 | AHL98369 | 24933 | 55437 | 85941, 116445, 146949, 177453, 207957 |
| 4720 | ADG42826 | 18751 | 49255 | 79759, 110263, 140767, 171271, 201775 | 10903 | AHL98381 | 24934 | 55438 | 85942, 116446, 146950, 177454, 207958 |
| 4721 | ADG42836 | 18752 | 49256 | 79760, 110264, 140768, 171272, 201776 | 10904 | AHL98393 | 24935 | 55439 | 85943, 116447, 146951, 177455, 207959 |
| 4722 | ADG42846 | 18753 | 49257 | 79761, 110265, 140769, 171273, 201777 | 10905 | AHL98405 | 24936 | 55440 | 85944, 116448, 146952, 177456, 207960 |
| 4723 | ADG42856 | 18754 | 49258 | 79762, 110266, 140770, 171274, 201778 | 10906 | AHL98417 | 24937 | 55441 | 85945, 116449, 146953, 177457, 207961 |
| 4724 | ADG42866 | 18755 | 49259 | 79763, 110267, 140771, 171275, 201779 | 10907 | AHL98429 | 24938 | 55442 | 85946, 116450, 146954, 177458, 207962 |
| 4725 | ADG42876 | 18756 | 49260 | 79764, 110268, 140772, 171276, 201780 | 10908 | AHL98452 | 24939 | 55443 | 85947, 116451, 146955, 177459, 207963 |
| 4726 | ADG42886 | 18757 | 49261 | 79765, 110269, 140773, 171277, 201781 | 10909 | AHL98474 | 24940 | 55444 | 85948, 116452, 146956, 177460, 207964 |
| 4727 | ADG42896 | 18758 | 49262 | 79766, 110270, 140774, 171278, 201782 | 10910 | AHL98485 | 24941 | 55445 | 85949, 116453, 146957, 177461, 207965 |

FIG. 3 continued

| | | | | | | | | | |
|---|---|---|---|---|---|---|---|---|---|
| 4728 | ADG42906 | 18759 | 49263 | 79767, 110271, 140775, 171279, 201783 | 10911 | AHL98497 | 24942 | 55446 | 85950, 116454, 146958, 177462, 207966 |
| 4729 | ADG42916 | 18760 | 49264 | 79768, 110272, 140776, 171280, 201784 | 10912 | AHL98509 | 24943 | 55447 | 85951, 116455, 146959, 177463, 207967 |
| 4730 | ADG42926 | 18761 | 49265 | 79769, 110273, 140777, 171281, 201785 | 10913 | AHL98521 | 24944 | 55448 | 85952, 116456, 146960, 177464, 207968 |
| 4731 | ADG58909 | 18762 | 49266 | 79770, 110274, 140778, 171282, 201786 | 10914 | AHL98533 | 24945 | 55449 | 85953, 116457, 146961, 177465, 207969 |
| 4732 | ADG58910 | 18763 | 49267 | 79771, 110275, 140779, 171283, 201787 | 10915 | AHL98545 | 24946 | 55450 | 85954, 116458, 146962, 177466, 207970 |
| 4733 | ADG58913 | 18764 | 49268 | 79772, 110276, 140780, 171284, 201788 | 10916 | AHL98557 | 24947 | 55451 | 85955, 116459, 146963, 177467, 207971 |
| 4734 | ADG58914 | 18765 | 49269 | 79773, 110277, 140781, 171285, 201789 | 10917 | AHL98569 | 24948 | 55452 | 85956, 116460, 146964, 177468, 207972 |
| 4735 | ADG58916 | 18766 | 49270 | 79774, 110278, 140782, 171286, 201790 | 10918 | AHL98581 | 24949 | 55453 | 85957, 116461, 146965, 177469, 207973 |
| 4736 | ADG58917 | 18767 | 49271 | 79775, 110279, 140783, 171287, 201791 | 10919 | AHL98593 | 24950 | 55454 | 85958, 116462, 146966, 177470, 207974 |
| 4737 | ADG58918 | 18768 | 49272 | 79776, 110280, 140784, 171288, 201792 | 10920 | AHL98605 | 24951 | 55455 | 85959, 116463, 146967, 177471, 207975 |
| 4738 | ADG58919 | 18769 | 49273 | 79777, 110281, 140785, 171289, 201793 | 10921 | AHL98617 | 24952 | 55456 | 85960, 116464, 146968, 177472, 207976 |
| 4739 | ADG58920 | 18770 | 49274 | 79778, 110282, 140786, 171290, 201794 | 10922 | AHL98629 | 24953 | 55457 | 85961, 116465, 146969, 177473, 207977 |
| 4740 | ADG58921 | 18771 | 49275 | 79779, 110283, 140787, 171291, 201795 | 10923 | AHL98641 | 24954 | 55458 | 85962, 116466, 146970, 177474, 207978 |
| 4741 | ADG58922 | 18772 | 49276 | 79780, 110284, 140788, 171292, 201796 | 10924 | AHL98653 | 24955 | 55459 | 85963, 116467, 146971, 177475, 207979 |
| 4742 | ADG58923 | 18773 | 49277 | 79781, 110285, 140789, 171293, 201797 | 10925 | AHL98665 | 24956 | 55460 | 85964, 116468, 146972, 177476, 207980 |
| 4743 | ADG58924 | 18774 | 49278 | 79782, 110286, 140790, 171294, 201798 | 10926 | AHL98677 | 24957 | 55461 | 85965, 116469, 146973, 177477, 207981 |
| 4744 | ADG58925 | 18775 | 49279 | 79783, 110287, 140791, 171295, 201799 | 10927 | AHL98689 | 24958 | 55462 | 85966, 116470, 146974, 177478, 207982 |
| 4745 | ADG58926 | 18776 | 49280 | 79784, 110288, 140792, 171296, 201800 | 10928 | AHL98702 | 24959 | 55463 | 85967, 116471, 146975, 177479, 207983 |

FIG. 3 continued

| | | | | | | | | | |
|---|---|---|---|---|---|---|---|---|---|
| 4746 | ADG58927 | 18777 | 49281 | 79785, 110289, 140793, 171297, 201801 | 10929 | AHL98714 | 24960 | 55464 | 85968, 116472, 146976, 177480, 207984 |
| 4747 | ADG58928 | 18778 | 49282 | 79786, 110290, 140794, 171298, 201802 | 10930 | AHL98725 | 24961 | 55465 | 85969, 116473, 146977, 177481, 207985 |
| 4748 | ADG58929 | 18779 | 49283 | 79787, 110291, 140795, 171299, 201803 | 10931 | AHL98737 | 24962 | 55466 | 85970, 116474, 146978, 177482, 207986 |
| 4749 | ADG58931 | 18780 | 49284 | 79788, 110292, 140796, 171300, 201804 | 10932 | AHL98749 | 24963 | 55467 | 85971, 116475, 146979, 177483, 207987 |
| 4750 | ADG58932 | 18781 | 49285 | 79789, 110293, 140797, 171301, 201805 | 10933 | AHL98761 | 24964 | 55468 | 85972, 116476, 146980, 177484, 207988 |
| 4751 | ADG58933 | 18782 | 49286 | 79790, 110294, 140798, 171302, 201806 | 10934 | AHL98773 | 24965 | 55469 | 85973, 116477, 146981, 177485, 207989 |
| 4752 | ADG58934 | 18783 | 49287 | 79791, 110295, 140799, 171303, 201807 | 10935 | AHL98785 | 24966 | 55470 | 85974, 116478, 146982, 177486, 207990 |
| 4753 | ADG58935 | 18784 | 49288 | 79792, 110296, 140800, 171304, 201808 | 10936 | AHL98797 | 24967 | 55471 | 85975, 116479, 146983, 177487, 207991 |
| 4754 | ADG58936 | 18785 | 49289 | 79793, 110297, 140801, 171305, 201809 | 10937 | AHL98809 | 24968 | 55472 | 85976, 116480, 146984, 177488, 207992 |
| 4755 | ADG58937 | 18786 | 49290 | 79794, 110298, 140802, 171306, 201810 | 10938 | AHL98821 | 24969 | 55473 | 85977, 116481, 146985, 177489, 207993 |
| 4756 | ADG58938 | 18787 | 49291 | 79795, 110299, 140803, 171307, 201811 | 10939 | AHL98833 | 24970 | 55474 | 85978, 116482, 146986, 177490, 207994 |
| 4757 | ADG59589 | 18788 | 49292 | 79796, 110300, 140804, 171308, 201812 | 10940 | AHL98845 | 24971 | 55475 | 85979, 116483, 146987, 177491, 207995 |
| 4758 | ADG59590 | 18789 | 49293 | 79797, 110301, 140805, 171309, 201813 | 10941 | AHL98857 | 24972 | 55476 | 85980, 116484, 146988, 177492, 207996 |
| 4759 | ADG59591 | 18790 | 49294 | 79798, 110302, 140806, 171310, 201814 | 10942 | AHL98869 | 24973 | 55477 | 85981, 116485, 146989, 177493, 207997 |
| 4760 | ADG59592 | 18791 | 49295 | 79799, 110303, 140807, 171311, 201815 | 10943 | AHL98881 | 24974 | 55478 | 85982, 116486, 146990, 177494, 207998 |
| 4761 | ADG59593 | 18792 | 49296 | 79800, 110304, 140808, 171312, 201816 | 10944 | AHL98893 | 24975 | 55479 | 85983, 116487, 146991, 177495, 207999 |
| 4762 | ADG59594 | 18793 | 49297 | 79801, 110305, 140809, 171313, 201817 | 10945 | AHL98905 | 24976 | 55480 | 85984, 116488, 146992, 177496, 208000 |
| 4763 | ADG59595 | 18794 | 49298 | 79802, 110306, 140810, 171314, 201818 | 10946 | AHL98916 | 24977 | 55481 | 85985, 116489, 146993, 177497, 208001 |

FIG. 3 continued

| | | | | | | | | | |
|---|---|---|---|---|---|---|---|---|---|
| 4764 | ADG59596 | 18795 | 49299 | 79803, 110307, 140811, 171315, 201819 | 10947 | AHL98928 | 24978 | 55482 | 85986, 116490, 146994, 177498, 208002 |
| 4765 | ADG59597 | 18796 | 49300 | 79804, 110308, 140812, 171316, 201820 | 10948 | AHL98940 | 24979 | 55483 | 85987, 116491, 146995, 177499, 208003 |
| 4766 | ADG59598 | 18797 | 49301 | 79805, 110309, 140813, 171317, 201821 | 10949 | AHL98952 | 24980 | 55484 | 85988, 116492, 146996, 177500, 208004 |
| 4767 | ADG59599 | 18798 | 49302 | 79806, 110310, 140814, 171318, 201822 | 10950 | AHL98964 | 24981 | 55485 | 85989, 116493, 146997, 177501, 208005 |
| 4768 | ADG59601 | 18799 | 49303 | 79807, 110311, 140815, 171319, 201823 | 10951 | AHL98976 | 24982 | 55486 | 85990, 116494, 146998, 177502, 208006 |
| 4769 | ADG59602 | 18800 | 49304 | 79808, 110312, 140816, 171320, 201824 | 10952 | AHL98988 | 24983 | 55487 | 85991, 116495, 146999, 177503, 208007 |
| 4770 | ADG59603 | 18801 | 49305 | 79809, 110313, 140817, 171321, 201825 | 10953 | AHL99000 | 24984 | 55488 | 85992, 116496, 147000, 177504, 208008 |
| 4771 | ADG59604 | 18802 | 49306 | 79810, 110314, 140818, 171322, 201826 | 10954 | AHL99012 | 24985 | 55489 | 85993, 116497, 147001, 177505, 208009 |
| 4772 | ADG59605 | 18803 | 49307 | 79811, 110315, 140819, 171323, 201827 | 10955 | AHL99024 | 24986 | 55490 | 85994, 116498, 147002, 177506, 208010 |
| 4773 | ADG59606 | 18804 | 49308 | 79812, 110316, 140820, 171324, 201828 | 10956 | AHL99036 | 24987 | 55491 | 85995, 116499, 147003, 177507, 208011 |
| 4774 | ADG59607 | 18805 | 49309 | 79813, 110317, 140821, 171325, 201829 | 10957 | AHL99048 | 24988 | 55492 | 85996, 116500, 147004, 177508, 208012 |
| 4775 | ADG59608 | 18806 | 49310 | 79814, 110318, 140822, 171326, 201830 | 10958 | AHL99060 | 24989 | 55493 | 85997, 116501, 147005, 177509, 208013 |
| 4776 | ADG59609 | 18807 | 49311 | 79815, 110319, 140823, 171327, 201831 | 10959 | AHL99072 | 24990 | 55494 | 85998, 116502, 147006, 177510, 208014 |
| 4777 | ADG59610 | 18808 | 49312 | 79816, 110320, 140824, 171328, 201832 | 10960 | AHL99084 | 24991 | 55495 | 85999, 116503, 147007, 177511, 208015 |
| 4778 | ADG59611 | 18809 | 49313 | 79817, 110321, 140825, 171329, 201833 | 10961 | AHL99096 | 24992 | 55496 | 86000, 116504, 147008, 177512, 208016 |
| 4779 | ADG59612 | 18810 | 49314 | 79818, 110322, 140826, 171330, 201834 | 10962 | AHL99108 | 24993 | 55497 | 86001, 116505, 147009, 177513, 208017 |
| 4780 | ADG59613 | 18811 | 49315 | 79819, 110323, 140827, 171331, 201835 | 10963 | AHL99120 | 24994 | 55498 | 86002, 116506, 147010, 177514, 208018 |
| 4781 | ADG59614 | 18812 | 49316 | 79820, 110324, 140828, 171332, 201836 | 10964 | AHL99132 | 24995 | 55499 | 86003, 116507, 147011, 177515, 208019 |

FIG. 3 continued

| | | | | | | | | | |
|---|---|---|---|---|---|---|---|---|---|
| 4782 | ADH01811 | 18813 | 49317 | 79821, 110325, 140829, 171333, 201837 | 10965 | AHL99144 | 24996 | 55500 | 86004, 116508, 147012, 177516, 208020 |
| 4783 | ADH01821 | 18814 | 49318 | 79822, 110326, 140830, 171334, 201838 | 10966 | AHL99156 | 24997 | 55501 | 86005, 116509, 147013, 177517, 208021 |
| 4784 | ADH01831 | 18815 | 49319 | 79823, 110327, 140831, 171335, 201839 | 10967 | AHL99168 | 24998 | 55502 | 86006, 116510, 147014, 177518, 208022 |
| 4785 | ADH01841 | 18816 | 49320 | 79824, 110328, 140832, 171336, 201840 | 10968 | AHL99180 | 24999 | 55503 | 86007, 116511, 147015, 177519, 208023 |
| 4786 | ADH01851 | 18817 | 49321 | 79825, 110329, 140833, 171337, 201841 | 10969 | AHL99204 | 25000 | 55504 | 86008, 116512, 147016, 177520, 208024 |
| 4787 | ADH01861 | 18818 | 49322 | 79826, 110330, 140834, 171338, 201842 | 10970 | AHL99216 | 25001 | 55505 | 86009, 116513, 147017, 177521, 208025 |
| 4788 | ADH01871 | 18819 | 49323 | 79827, 110331, 140835, 171339, 201843 | 10971 | AHL99228 | 25002 | 55506 | 86010, 116514, 147018; 177522, 208026 |
| 4789 | ADH01881 | 18820 | 49324 | 79828, 110332, 140836, 171340, 201844 | 10972 | AHL99240 | 25003 | 55507 | 86011, 116515, 147019, 177523, 208027 |
| 4790 | ADH01891 | 18821 | 49325 | 79829, 110333, 140837, 171341, 201845 | 10973 | AHL99252 | 25004 | 55508 | 86012, 116516, 147020, 177524, 208028 |
| 4791 | ADH01901 | 18822 | 49326 | 79830, 110334, 140838, 171342, 201846 | 10974 | AHL99264 | 25005 | 55509 | 86013, 116517, 147021, 177525, 208029 |
| 4792 | ADH01911 | 18823 | 49327 | 79831, 110335, 140839, 171343, 201847 | 10975 | AHL99276 | 25006 | 55510 | 86014, 116518, 147022, 177526, 208030 |
| 4793 | ADH01921 | 18824 | 49328 | 79832, 110336, 140840, 171344, 201848 | 10976 | AHL99288 | 25007 | 55511 | 86015, 116519, 147023, 177527, 208031 |
| 4794 | ADH01931 | 18825 | 49329 | 79833, 110337, 140841, 171345, 201849 | 10977 | AHL99300 | 25008 | 55512 | 86016, 116520, 147024, 177528, 208032 |
| 4795 | ADH01941 | 18826 | 49330 | 79834, 110338, 140842, 171346, 201850 | 10978 | AHL99312 | 25009 | 55513 | 86017, 116521, 147025, 177529, 208033 |
| 4796 | ADH01951 | 18827 | 49331 | 79835, 110339, 140843, 171347, 201851 | 10979 | AHL99324 | 25010 | 55514 | 86018, 116522, 147026, 177530, 208034 |
| 4797 | ADH01961 | 18828 | 49332 | 79836, 110340, 140844, 171348, 201852 | 10980 | AHL99348 | 25011 | 55515 | 86019, 116523, 147027, 177531, 208035 |
| 4798 | ADH01981 | 18829 | 49333 | 79837, 110341, 140845, 171349, 201853 | 10981 | AHL99359 | 25012 | 55516 | 86020, 116524, 147028, 177532, 208036 |
| 4799 | ADH01991 | 18830 | 49334 | 79838, 110342, 140846, 171350, 201854 | 10982 | AHL99370 | 25013 | 55517 | 86021, 116525, 147029, 177533, 208037 |

FIG. 3 continued

| | | | | | | | | | |
|---|---|---|---|---|---|---|---|---|---|
| 4800 | ADH02011 | 18831 | 49335 | 79839, 110343, 140847, 171351, 201855 | 10983 | AHL99393 | 25014 | 55518 | 86022, 116526, 147030, 177534, 208038 |
| 4801 | ADH02021 | 18832 | 49336 | 79840, 110344, 140848, 171352, 201856 | 10984 | AHL99417 | 25015 | 55519 | 86023, 116527, 147031, 177535, 208039 |
| 4802 | ADI24510 | 18833 | 49337 | 79841, 110345, 140849, 171353, 201857 | 10985 | AHL99429 | 25016 | 55520 | 86024, 116528, 147032, 177536, 208040 |
| 4803 | ADI24516 | 18834 | 49338 | 79842, 110346, 140850, 171354, 201858 | 10986 | AHL99441 | 25017 | 55521 | 86025, 116529, 147033, 177537, 208041 |
| 4804 | ADI24518 | 18835 | 49339 | 79843, 110347, 140851, 171355, 201859 | 10987 | AHL99453 | 25018 | 55522 | 86026, 116530, 147034, 177538, 208042 |
| 4805 | ADI24522 | 18836 | 49340 | 79844, 110348, 140852, 171356, 201860 | 10988 | AHL99477 | 25019 | 55523 | 86027, 116531, 147035, 177539, 208043 |
| 4806 | ADI24524 | 18837 | 49341 | 79845, 110349, 140853, 171357, 201861 | 10989 | AHL99489 | 25020 | 55524 | 86028, 116532, 147036, 177540, 208044 |
| 4807 | ADI24526 | 18838 | 49342 | 79846, 110350, 140854, 171358, 201862 | 10990 | AHL99501 | 25021 | 55525 | 86029, 116533, 147037, 177541, 208045 |
| 4808 | ADI24528 | 18839 | 49343 | 79847, 110351, 140855, 171359, 201863 | 10991 | AHL99525 | 25022 | 55526 | 86030, 116534, 147038, 177542, 208046 |
| 4809 | ADI24530 | 18840 | 49344 | 79848, 110352, 140856, 171360, 201864 | 10992 | AHL99537 | 25023 | 55527 | 86031, 116535, 147039, 177543, 208047 |
| 4810 | ADI24532 | 18841 | 49345 | 79849, 110353, 140857, 171361, 201865 | 10993 | AHL99549 | 25024 | 55528 | 86032, 116536, 147040, 177544, 208048 |
| 4811 | ADI24538 | 18842 | 49346 | 79850, 110354, 140858, 171362, 201866 | 10994 | AHL99561 | 25025 | 55529 | 86033, 116537, 147041, 177545, 208049 |
| 4812 | ADI24548 | 18843 | 49347 | 79851, 110355, 140859, 171363, 201867 | 10995 | AHL99573 | 25026 | 55530 | 86034, 116538, 147042, 177546, 208050 |
| 4813 | ADI24556 | 18844 | 49348 | 79852, 110356, 140860, 171364, 201868 | 10996 | AHL99585 | 25027 | 55531 | 86035, 116539, 147043, 177547, 208051 |
| 4814 | ADI24558 | 18845 | 49349 | 79853, 110357, 140861, 171365, 201869 | 10997 | AHL99597 | 25028 | 55532 | 86036, 116540, 147044, 177548, 208052 |
| 4815 | ADI24560 | 18846 | 49350 | 79854, 110358, 140862, 171366, 201870 | 10998 | AHL99608 | 25029 | 55533 | 86037, 116541, 147045, 177549, 208053 |
| 4816 | ADI24562 | 18847 | 49351 | 79855, 110359, 140863, 171367, 201871 | 10999 | AHL99620 | 25030 | 55534 | 86038, 116542, 147046, 177550, 208054 |
| 4817 | ADI24564 | 18848 | 49352 | 79856, 110360, 140864, 171368, 201872 | 11000 | AHL99632 | 25031 | 55535 | 86039, 116543, 147047, 177551, 208055 |

FIG. 3 continued

| | | | | | | | | | |
|---|---|---|---|---|---|---|---|---|---|
| 4818 | ADI24566 | 18849 | 49353 | 79857, 110361, 140865, 171369, 201873 | 11001 | AHL99644 | 25032 | 55536 | 86040, 116544, 147048, 177552, 208056 |
| 4819 | ADI24568 | 18850 | 49354 | 79858, 110362, 140866, 171370, 201874 | 11002 | AHL99668 | 25033 | 55537 | 86041, 116545, 147049, 177553, 208057 |
| 4820 | ADI24570 | 18851 | 49355 | 79859, 110363, 140867, 171371, 201875 | 11003 | AHL99680 | 25034 | 55538 | 86042, 116546, 147050, 177554, 208058 |
| 4821 | ADI24572 | 18852 | 49356 | 79860, 110364, 140868, 171372, 201876 | 11004 | AHL99692 | 25035 | 55539 | 86043, 116547, 147051, 177555, 208059 |
| 4822 | ADI24574 | 18853 | 49357 | 79861, 110365, 140869, 171373, 201877 | 11005 | AHL99704 | 25036 | 55540 | 86044, 116548, 147052, 177556, 208060 |
| 4823 | ADI24576 | 18854 | 49358 | 79862, 110366, 140870, 171374, 201878 | 11006 | AHL99716 | 25037 | 55541 | 86045, 116549, 147053, 177557, 208061 |
| 4824 | ADI24580 | 18855 | 49359 | 79863, 110367, 140871, 171375, 201879 | 11007 | AHL99740 | 25038 | 55542 | 86046, 116550, 147054, 177558, 208062 |
| 4825 | ADI24582 | 18856 | 49360 | 79864, 110368, 140872, 171376, 201880 | 11008 | AHL99751 | 25039 | 55543 | 86047, 116551, 147055, 177559, 208063 |
| 4826 | ADI24584 | 18857 | 49361 | 79865, 110369, 140873, 171377, 201881 | 11009 | AHL99763 | 25040 | 55544 | 86048, 116552, 147056, 177560, 208064 |
| 4827 | ADI24592 | 18858 | 49362 | 79866, 110370, 140874, 171378, 201882 | 11010 | AHL99775 | 25041 | 55545 | 86049, 116553, 147057, 177561, 208065 |
| 4828 | ADI24598 | 18859 | 49363 | 79867, 110371, 140875, 171379, 201883 | 11011 | AHL99787 | 25042 | 55546 | 86050, 116554, 147058, 177562, 208066 |
| 4829 | ADI24604 | 18860 | 49364 | 79868, 110372, 140876, 171380, 201884 | 11012 | AHL99799 | 25043 | 55547 | 86051, 116555, 147059, 177563, 208067 |
| 4830 | ADI24620 | 18861 | 49365 | 79869, 110373, 140877, 171381, 201885 | 11013 | AHL99811 | 25044 | 55548 | 86052, 116556, 147060, 177564, 208068 |
| 4831 | ADI24622 | 18862 | 49366 | 79870, 110374, 140878, 171382, 201886 | 11014 | AHL99823 | 25045 | 55549 | 86053, 116557, 147061, 177565, 208069 |
| 4832 | ADI46780 | 18863 | 49367 | 79871, 110375, 140879, 171383, 201887 | 11015 | AHL99835 | 25046 | 55550 | 86054, 116558, 147062, 177566, 208070 |
| 4833 | ADI46789 | 18864 | 49368 | 79872, 110376, 140880, 171384, 201888 | 11016 | AHL99847 | 25047 | 55551 | 86055, 116559, 147063, 177567, 208071 |
| 4834 | ADI48185 | 18865 | 49369 | 79873, 110377, 140881, 171385, 201889 | 11017 | AHL99859 | 25048 | 55552 | 86056, 116560, 147064, 177568, 208072 |
| 4835 | ADI48187 | 18866 | 49370 | 79874, 110378, 140882, 171386, 201890 | 11018 | AHL99871 | 25049 | 55553 | 86057, 116561, 147065, 177569, 208073 |

FIG. 3 continued

| | | | | | | | | | |
|---|---|---|---|---|---|---|---|---|---|
| 4836 | ADI48189 | 18867 | 49371 | 79875, 110379, 140883, 171387, 201891 | 11019 | AHL99883 | 25050 | 55554 | 86058, 116562, 147066, 177570, 208074 |
| 4837 | ADI48191 | 18868 | 49372 | 79876, 110380, 140884, 171388, 201892 | 11020 | AHL99895 | 25051 | 55555 | 86059, 116563, 147067, 177571, 208075 |
| 4838 | ADI48193 | 18869 | 49373 | 79877, 110381, 140885, 171389, 201893 | 11021 | AHL99907 | 25052 | 55556 | 86060, 116564, 147068, 177572, 208076 |
| 4839 | ADI48195 | 18870 | 49374 | 79878, 110382, 140886, 171390, 201894 | 11022 | AHL99919 | 25053 | 55557 | 86061, 116565, 147069, 177573, 208077 |
| 4840 | ADI48197 | 18871 | 49375 | 79879, 110383, 140887, 171391, 201895 | 11023 | AHL99943 | 25054 | 55558 | 86062, 116566, 147070, 177574, 208078 |
| 4841 | ADI48199 | 18872 | 49376 | 79880, 110384, 140888, 171392, 201896 | 11024 | AHL99955 | 25055 | 55559 | 86063, 116567, 147071, 177575, 208079 |
| 4842 | ADI48201 | 18873 | 49377 | 79881, 110385, 140889, 171393, 201897 | 11025 | AHL99967 | 25056 | 55560 | 86064, 116568, 147072, 177576, 208080 |
| 4843 | ADI48203 | 18874 | 49378 | 79882, 110386, 140890, 171394, 201898 | 11026 | AHL99979 | 25057 | 55561 | 86065, 116569, 147073, 177577, 208081 |
| 4844 | ADI48205 | 18875 | 49379 | 79883, 110387, 140891, 171395, 201899 | 11027 | AHL99991 | 25058 | 55562 | 86066, 116570, 147074, 177578, 208082 |
| 4845 | ADI48207 | 18876 | 49380 | 79884, 110388, 140892, 171396, 201900 | 11028 | AHM00004 | 25059 | 55563 | 86067, 116571, 147075, 177579, 208083 |
| 4846 | ADI48209 | 18877 | 49381 | 79885, 110389, 140893, 171397, 201901 | 11029 | AHM00016 | 25060 | 55564 | 86068, 116572, 147076, 177580, 208084 |
| 4847 | ADI48211 | 18878 | 49382 | 79886, 110390, 140894, 171398, 201902 | 11030 | AHM00028 | 25061 | 55565 | 86069, 116573, 147077, 177581, 208085 |
| 4848 | ADI48213 | 18879 | 49383 | 79887, 110391, 140895, 171399, 201903 | 11031 | AHM00040 | 25062 | 55566 | 86070, 116574, 147078, 177582, 208086 |
| 4849 | ADI48215 | 18880 | 49384 | 79888, 110392, 140896, 171400, 201904 | 11032 | AHM00052 | 25063 | 55567 | 86071, 116575, 147079, 177583, 208087 |
| 4850 | ADI48217 | 18881 | 49385 | 79889, 110393, 140897, 171401, 201905 | 11033 | AHM00064 | 25064 | 55568 | 86072, 116576, 147080, 177584, 208088 |
| 4851 | ADI48219 | 18882 | 49386 | 79890, 110394, 140898, 171402, 201906 | 11034 | AHM00076 | 25065 | 55569 | 86073, 116577, 147081, 177585, 208089 |
| 4852 | ADI48221 | 18883 | 49387 | 79891, 110395, 140899, 171403, 201907 | 11035 | AHM00088 | 25066 | 55570 | 86074, 116578, 147082, 177586, 208090 |
| 4853 | ADI48625 | 18884 | 49388 | 79892, 110396, 140900, 171404, 201908 | 11036 | AHM00100 | 25067 | 55571 | 86075, 116579, 147083, 177587, 208091 |

FIG. 3 continued

| | | | | | | | | | |
|---|---|---|---|---|---|---|---|---|---|
| 4854 | ADI48635 | 18885 | 49389 | 79893, 110397, 140901, 171405, 201909 | 11037 | AHM00111 | 25068 | 55572 | 86076, 116580, 147084, 177588, 208092 |
| 4855 | ADI48655 | 18886 | 49390 | 79894, 110398, 140902, 171406, 201910 | 11038 | AHM00123 | 25069 | 55573 | 86077, 116581, 147085, 177589, 208093 |
| 4856 | ADI48665 | 18887 | 49391 | 79895, 110399, 140903, 171407, 201911 | 11039 | AHM00135 | 25070 | 55574 | 86078, 116582, 147086, 177590, 208094 |
| 4857 | ADI48675 | 18888 | 49392 | 79896, 110400, 140904, 171408, 201912 | 11040 | AHM00147 | 25071 | 55575 | 86079, 116583, 147087, 177591, 208095 |
| 4858 | ADI48685 | 18889 | 49393 | 79897, 110401, 140905, 171409, 201913 | 11041 | AHM00159 | 25072 | 55576 | 86080, 116584, 147088, 177592, 208096 |
| 4859 | ADI48695 | 18890 | 49394 | 79898, 110402, 140906, 171410, 201914 | 11042 | AHM00171 | 25073 | 55577 | 86081, 116585, 147089, 177593, 208097 |
| 4860 | ADI48705 | 18891 | 49395 | 79899, 110403, 140907, 171411, 201915 | 11043 | AHM00183 | 25074 | 55578 | 86082, 116586, 147090, 177594, 208098 |
| 4861 | ADI48715 | 18892 | 49396 | 79900, 110404, 140908, 171412, 201916 | 11044 | AHM00195 | 25075 | 55579 | 86083, 116587, 147091, 177595, 208099 |
| 4862 | ADI48725 | 18893 | 49397 | 79901, 110405, 140909, 171413, 201917 | 11045 | AHM00207 | 25076 | 55580 | 86084, 116588, 147092, 177596, 208100 |
| 4863 | ADI48735 | 18894 | 49398 | 79902, 110406, 140910, 171414, 201918 | 11046 | AHM00219 | 25077 | 55581 | 86085, 116589, 147093, 177597, 208101 |
| 4864 | ADI48745 | 18895 | 49399 | 79903, 110407, 140911, 171415, 201919 | 11047 | AHM00231 | 25078 | 55582 | 86086, 116590, 147094, 177598, 208102 |
| 4865 | ADI48755 | 18896 | 49400 | 79904, 110408, 140912, 171416, 201920 | 11048 | AHM00243 | 25079 | 55583 | 86087, 116591, 147095, 177599, 208103 |
| 4866 | ADI48765 | 18897 | 49401 | 79905, 110409, 140913, 171417, 201921 | 11049 | AHM00255 | 25080 | 55584 | 86088, 116592, 147096, 177600, 208104 |
| 4867 | ADI48775 | 18898 | 49402 | 79906, 110410, 140914, 171418, 201922 | 11050 | AHM00267 | 25081 | 55585 | 86089, 116593, 147097, 177601, 208105 |
| 4868 | ADI48785 | 18899 | 49403 | 79907, 110411, 140915, 171419, 201923 | 11051 | AHM00279 | 25082 | 55586 | 86090, 116594, 147098, 177602, 208106 |
| 4869 | ADI48795 | 18900 | 49404 | 79908, 110412, 140916, 171420, 201924 | 11052 | AHM00291 | 25083 | 55587 | 86091, 116595, 147099, 177603, 208107 |
| 4870 | ADI49032 | 18901 | 49405 | 79909, 110413, 140917, 171421, 201925 | 11053 | AHM00303 | 25084 | 55588 | 86092, 116596, 147100, 177604, 208108 |
| 4871 | ADI49243 | 18902 | 49406 | 79910, 110414, 140918, 171422, 201926 | 11054 | AHM00315 | 25085 | 55589 | 86093, 116597, 147101, 177605, 208109 |

FIG. 3 continued

| | | | | | | | | | |
|---|---|---|---|---|---|---|---|---|---|
| 4872 | ADI49263 | 18903 | 49407 | 79911, 110415, 140919, 171423, 201927 | 11055 | AHM00327 | 25086 | 55590 | 86094, 116598, 147102, 177606, 208110 |
| 4873 | ADI49273 | 18904 | 49408 | 79912, 110416, 140920, 171424, 201928 | 11056 | AHM00339 | 25087 | 55591 | 86095, 116599, 147103, 177607, 208111 |
| 4874 | ADI49283 | 18905 | 49409 | 79913, 110417, 140921, 171425, 201929 | 11057 | AHM00351 | 25088 | 55592 | 86096, 116600, 147104, 177608, 208112 |
| 4875 | ADI49315 | 18906 | 49410 | 79914, 110418, 140922, 171426, 201930 | 11058 | AHM00363 | 25089 | 55593 | 86097, 116601, 147105, 177609, 208113 |
| 4876 | ADI49325 | 18907 | 49411 | 79915, 110419, 140923, 171427, 201931 | 11059 | AHM00375 | 25090 | 55594 | 86098, 116602, 147106, 177610, 208114 |
| 4877 | ADI49335 | 18908 | 49412 | 79916, 110420, 140924, 171428, 201932 | 11060 | AHM00398 | 25091 | 55595 | 86099, 116603, 147107, 177611, 208115 |
| 4878 | ADI49345 | 18909 | 49413 | 79917, 110421, 140925, 171429, 201933 | 11061 | AHM00410 | 25092 | 55596 | 86100, 116604, 147108, 177612, 208116 |
| 4879 | ADI49355 | 18910 | 49414 | 79918, 110422, 140926, 171430, 201934 | 11062 | AHM00422 | 25093 | 55597 | 86101, 116605, 147109, 177613, 208117 |
| 4880 | ADI49365 | 18911 | 49415 | 79919, 110423, 140927, 171431, 201935 | 11063 | AHM00434 | 25094 | 55598 | 86102, 116606, 147110, 177614, 208118 |
| 4881 | ADI49375 | 18912 | 49416 | 79920, 110424, 140928, 171432, 201936 | 11064 | AHM00446 | 25095 | 55599 | 86103, 116607, 147111, 177615, 208119 |
| 4882 | ADI49385 | 18913 | 49417 | 79921, 110425, 140929, 171433, 201937 | 11065 | AHM00458 | 25096 | 55600 | 86104, 116608, 147112, 177616, 208120 |
| 4883 | ADI49395 | 18914 | 49418 | 79922, 110426, 140930, 171434, 201938 | 11066 | AHM00470 | 25097 | 55601 | 86105, 116609, 147113, 177617, 208121 |
| 4884 | ADI49720 | 18915 | 49419 | 79923, 110427, 140931, 171435, 201939 | 11067 | AHM00482 | 25098 | 55602 | 86106, 116610, 147114, 177618, 208122 |
| 4885 | ADI49730 | 18916 | 49420 | 79924, 110428, 140932, 171436, 201940 | 11068 | AHM00494 | 25099 | 55603 | 86107, 116611, 147115, 177619, 208123 |
| 4886 | ADI49740 | 18917 | 49421 | 79925, 110429, 140933, 171437, 201941 | 11069 | AHM00506 | 25100 | 55604 | 86108, 116612, 147116, 177620, 208124 |
| 4887 | ADI49750 | 18918 | 49422 | 79926, 110430, 140934, 171438, 201942 | 11070 | AHM00518 | 25101 | 55605 | 86109, 116613, 147117, 177621, 208125 |
| 4888 | ADI49760 | 18919 | 49423 | 79927, 110431, 140935, 171439, 201943 | 11071 | AHM00530 | 25102 | 55606 | 86110, 116614, 147118, 177622, 208126 |
| 4889 | ADI49780 | 18920 | 49424 | 79928, 110432, 140936, 171440, 201944 | 11072 | AHM00542 | 25103 | 55607 | 86111, 116615, 147119, 177623, 208127 |

FIG. 3 continued

| | | | | | | | | | |
|---|---|---|---|---|---|---|---|---|---|
| 4890 | ADI49790 | 18921 | 49425 | 79929, 110433, 140937, 171441, 201945 | 11073 | AHM00546 | 25104 | 55608 | 86112, 116616, 147120, 177624, 208128 |
| 4891 | ADI49821 | 18922 | 49426 | 79930, 110434, 140938, 171442, 201946 | 11074 | AHM00558 | 25105 | 55609 | 86113, 116617, 147121, 177625, 208129 |
| 4892 | ADI50029 | 18923 | 49427 | 79931, 110435, 140939, 171443, 201947 | 11075 | AHM00570 | 25106 | 55610 | 86114, 116618, 147122, 177626, 208130 |
| 4893 | ADI52830 | 18924 | 49428 | 79932, 110436, 140940, 171444, 201948 | 11076 | AHM00582 | 25107 | 55611 | 86115, 116619, 147123, 177627, 208131 |
| 4894 | ADI52831 | 18925 | 49429 | 79933, 110437, 140941, 171445, 201949 | 11077 | AHM00594 | 25108 | 55612 | 86116, 116620, 147124, 177628, 208132 |
| 4895 | ADI52832 | 18926 | 49430 | 79934, 110438, 140942, 171446, 201950 | 11078 | AHM00606 | 25109 | 55613 | 86117, 116621, 147125, 177629, 208133 |
| 4896 | ADI52833 | 18927 | 49431 | 79935, 110439, 140943, 171447, 201951 | 11079 | AHM00618 | 25110 | 55614 | 86118, 116622, 147126, 177630, 208134 |
| 4897 | ADI75821 | 18928 | 49432 | 79936, 110440, 140944, 171448, 201952 | 11080 | AHM00630 | 25111 | 55615 | 86119, 116623, 147127, 177631, 208135 |
| 4898 | ADI75832 | 18929 | 49433 | 79937, 110441, 140945, 171449, 201953 | 11081 | AHM00642 | 25112 | 55616 | 86120, 116624, 147128, 177632, 208136 |
| 4899 | ADI75854 | 18930 | 49434 | 79938, 110442, 140946, 171450, 201954 | 11082 | AHM00654 | 25113 | 55617 | 86121, 116625, 147129, 177633, 208137 |
| 4900 | ADI75876 | 18931 | 49435 | 79939, 110443, 140947, 171451, 201955 | 11083 | AHM00666 | 25114 | 55618 | 86122, 116626, 147130, 177634, 208138 |
| 4901 | ADI75887 | 18932 | 49436 | 79940, 110444, 140948, 171452, 201956 | 11084 | AHM00678 | 25115 | 55619 | 86123, 116627, 147131, 177635, 208139 |
| 4902 | ADI75909 | 18933 | 49437 | 79941, 110445, 140949, 171453, 201957 | 11085 | AHM00690 | 25116 | 55620 | 86124, 116628, 147132, 177636, 208140 |
| 4903 | ADI75920 | 18934 | 49438 | 79942, 110446, 140950, 171454, 201958 | 11086 | AHM00701 | 25117 | 55621 | 86125, 116629, 147133, 177637, 208141 |
| 4904 | ADI77352 | 18935 | 49439 | 79943, 110447, 140951, 171455, 201959 | 11087 | AHM00713 | 25118 | 55622 | 86126, 116630, 147134, 177638, 208142 |
| 4905 | ADI77363 | 18936 | 49440 | 79944, 110448, 140952, 171456, 201960 | 11088 | AHM00725 | 25119 | 55623 | 86127, 116631, 147135, 177639, 208143 |
| 4906 | ADI99500 | 18937 | 49441 | 79945, 110449, 140953, 171457, 201961 | 11089 | AHM00737 | 25120 | 55624 | 86128, 116632, 147136, 177640, 208144 |
| 4907 | ADI99553 | 18938 | 49442 | 79946, 110450, 140954, 171458, 201962 | 11090 | AHM00749 | 25121 | 55625 | 86129, 116633, 147137, 177641, 208145 |

FIG. 3 continued

| | | | | | | | | | |
|---|---|---|---|---|---|---|---|---|---|
| 4908 | ADI99563 | 18939 | 49443 | 79947, 110451, 140955, 171459, 201963 | 11091 | AHM00761 | 25122 | 55626 | 86130, 116634, 147138, 177642, 208146 |
| 4909 | ADI99573 | 18940 | 49444 | 79948, 110452, 140956, 171460, 201964 | 11092 | AHM00785 | 25123 | 55627 | 86131, 116635, 147139, 177643, 208147 |
| 4910 | ADI99583 | 18941 | 49445 | 79949, 110453, 140957, 171461, 201965 | 11093 | AHM00797 | 25124 | 55628 | 86132, 116636, 147140, 177644, 208148 |
| 4911 | ADI99593 | 18942 | 49446 | 79950, 110454, 140958, 171462, 201966 | 11094 | AHM00809 | 25125 | 55629 | 86133, 116637, 147141, 177645, 208149 |
| 4912 | ADI99613 | 18943 | 49447 | 79951, 110455, 140959, 171463, 201967 | 11095 | AHM00821 | 25126 | 55630 | 86134, 116638, 147142, 177646, 208150 |
| 4913 | ADI99623 | 18944 | 49448 | 79952, 110456, 140960, 171464, 201968 | 11096 | AHM00833 | 25127 | 55631 | 86135, 116639, 147143, 177647, 208151 |
| 4914 | ADI99633 | 18945 | 49449 | 79953, 110457, 140961, 171465, 201969 | 11097 | AHM00845 | 25128 | 55632 | 86136, 116640, 147144, 177648, 208152 |
| 4915 | ADI99643 | 18946 | 49450 | 79954, 110458, 140962, 171466, 201970 | 11098 | AHM00857 | 25129 | 55633 | 86137, 116641, 147145, 177649, 208153 |
| 4916 | ADI99653 | 18947 | 49451 | 79955, 110459, 140963, 171467, 201971 | 11099 | AHM00869 | 25130 | 55634 | 86138, 116642, 147146, 177650, 208154 |
| 4917 | ADI99663 | 18948 | 49452 | 79956, 110460, 140964, 171468, 201972 | 11100 | AHM00881 | 25131 | 55635 | 86139, 116643, 147147, 177651, 208155 |
| 4918 | ADI99673 | 18949 | 49453 | 79957, 110461, 140965, 171469, 201973 | 11101 | AHM00893 | 25132 | 55636 | 86140, 116644, 147148, 177652, 208156 |
| 4919 | ADI99683 | 18950 | 49454 | 79958, 110462, 140966, 171470, 201974 | 11102 | AHM00905 | 25133 | 55637 | 86141, 116645, 147149, 177653, 208157 |
| 4920 | ADI99703 | 18951 | 49455 | 79959, 110463, 140967, 171471, 201975 | 11103 | AHM00917 | 25134 | 55638 | 86142, 116646, 147150, 177654, 208158 |
| 4921 | ADI99713 | 18952 | 49456 | 79960, 110464, 140968, 171472, 201976 | 11104 | AHM00929 | 25135 | 55639 | 86143, 116647, 147151, 177655, 208159 |
| 4922 | ADI99723 | 18953 | 49457 | 79961, 110465, 140969, 171473, 201977 | 11105 | AHM00941 | 25136 | 55640 | 86144, 116648, 147152, 177656, 208160 |
| 4923 | ADI99733 | 18954 | 49458 | 79962, 110466, 140970, 171474, 201978 | 11106 | AHM00953 | 25137 | 55641 | 86145, 116649, 147153, 177657, 208161 |
| 4924 | ADJ00487 | 18955 | 49459 | 79963, 110467, 140971, 171475, 201979 | 11107 | AHM00965 | 25138 | 55642 | 86146, 116650, 147154, 177658, 208162 |
| 4925 | ADJ00488 | 18956 | 49460 | 79964, 110468, 140972, 171476, 201980 | 11108 | AHM00977 | 25139 | 55643 | 86147, 116651, 147155, 177659, 208163 |

FIG. 3 continued

| | | | | | | | | | |
|---|---|---|---|---|---|---|---|---|---|
| 4926 | ADJ00489 | 18957 | 49461 | 79965, 110469, 140973, 171477, 201981 | 11109 | AHM24226 | 25140 | 55644 | 86148, 116652, 147156, 177660, 208164 |
| 4927 | ADJ00490 | 18958 | 49462 | 79966, 110470, 140974, 171478, 201982 | 11110 | AHM24238 | 25141 | 55645 | 86149, 116653, 147157, 177661, 208165 |
| 4928 | ADJ00491 | 18959 | 49463 | 79967, 110471, 140975, 171479, 201983 | 11111 | AHM24250 | 25142 | 55646 | 86150, 116654, 147158, 177662, 208166 |
| 4929 | ADJ18160 | 18960 | 49464 | 79968, 110472, 140976, 171480, 201984 | 11112 | AHM98312 | 25143 | 55647 | 86151, 116655, 147159, 177663, 208167 |
| 4930 | ADJ18161 | 18961 | 49465 | 79969, 110473, 140977, 171481, 201985 | 11113 | AHM98331 | 25144 | 55648 | 86152, 116656, 147160, 177664, 208168 |
| 4931 | ADJ18162 | 18962 | 49466 | 79970, 110474, 140978, 171482, 201986 | 11114 | AHM98342 | 25145 | 55649 | 86153, 116657, 147161, 177665, 208169 |
| 4932 | ADJ18164 | 18963 | 49467 | 79971, 110475, 140979, 171483, 201987 | 11115 | AHM98353 | 25146 | 55650 | 86154, 116658, 147162, 177666, 208170 |
| 4933 | ADJ18166 | 18964 | 49468 | 79972, 110476, 140980, 171484, 201988 | 11116 | AHM98364 | 25147 | 55651 | 86155, 116659, 147163, 177667, 208171 |
| 4934 | ADJ18168 | 18965 | 49469 | 79973, 110477, 140981, 171485, 201989 | 11117 | AHM98375 | 25148 | 55652 | 86156, 116660, 147164, 177668, 208172 |
| 4935 | ADJ18170 | 18966 | 49470 | 79974, 110478, 140982, 171486, 201990 | 11118 | AHM98386 | 25149 | 55653 | 86157, 116661, 147165, 177669, 208173 |
| 4936 | ADJ18172 | 18967 | 49471 | 79975, 110479, 140983, 171487, 201991 | 11119 | AHM98408 | 25150 | 55654 | 86158, 116662, 147166, 177670, 208174 |
| 4937 | ADJ18174 | 18968 | 49472 | 79976, 110480, 140984, 171488, 201992 | 11120 | AHM98419 | 25151 | 55655 | 86159, 116663, 147167, 177671, 208175 |
| 4938 | ADJ18176 | 18969 | 49473 | 79977, 110481, 140985, 171489, 201993 | 11121 | AHM98430 | 25152 | 55656 | 86160, 116664, 147168, 177672, 208176 |
| 4939 | ADJ37250 | 18970 | 49474 | 79978, 110482, 140986, 171490, 201994 | 11122 | AHM98441 | 25153 | 55657 | 86161, 116665, 147169, 177673, 208177 |
| 4940 | ADJ37252 | 18971 | 49475 | 79979, 110483, 140987, 171491, 201995 | 11123 | AHM98452 | 25154 | 55658 | 86162, 116666, 147170, 177674, 208178 |
| 4941 | ADJ37263 | 18972 | 49476 | 79980, 110484, 140988, 171492, 201996 | 11124 | AHM98474 | 25155 | 55659 | 86163, 116667, 147171, 177675, 208179 |
| 4942 | ADJ37273 | 18973 | 49477 | 79981, 110485, 140989, 171493, 201997 | 11125 | AHM98485 | 25156 | 55660 | 86164, 116668, 147172, 177676, 208180 |
| 4943 | ADJ40447 | 18974 | 49478 | 79982, 110486, 140990, 171494, 201998 | 11126 | AHM98496 | 25157 | 55661 | 86165, 116669, 147173, 177677, 208181 |

FIG. 3 continued

| | | | | | | | | | |
|---|---|---|---|---|---|---|---|---|---|
| 4944 | ADJ40457 | 18975 | 49479 | 79983, 110487, 140991, 171495, 201999 | 11127 | AHM98507 | 25158 | 55662 | 86166, 116670, 147174, 177678, 208182 |
| 4945 | ADJ40467 | 18976 | 49480 | 79984, 110488, 140992, 171496, 202000 | 11128 | AHM98518 | 25159 | 55663 | 86167, 116671, 147175, 177679, 208183 |
| 4946 | ADJ40477 | 18977 | 49481 | 79985, 110489, 140993, 171497, 202001 | 11129 | AHM98529 | 25160 | 55664 | 86168, 116672, 147176, 177680, 208184 |
| 4947 | ADJ40487 | 18978 | 49482 | 79986, 110490, 140994, 171498, 202002 | 11130 | AHM98540 | 25161 | 55665 | 86169, 116673, 147177, 177681, 208185 |
| 4948 | ADJ40507 | 18979 | 49483 | 79987, 110491, 140995, 171499, 202003 | 11131 | AHM98562 | 25162 | 55666 | 86170, 116674, 147178, 177682, 208186 |
| 4949 | ADJ40517 | 18980 | 49484 | 79988, 110492, 140996, 171500, 202004 | 11132 | AHM98573 | 25163 | 55667 | 86171, 116675, 147179, 177683, 208187 |
| 4950 | ADJ40527 | 18981 | 49485 | 79989, 110493, 140997, 171501, 202005 | 11133 | AHM98584 | 25164 | 55668 | 86172, 116676, 147180, 177684, 208188 |
| 4951 | ADJ40537 | 18982 | 49486 | 79990, 110494, 140998, 171502, 202006 | 11134 | AHM98595 | 25165 | 55669 | 86173, 116677, 147181, 177685, 208189 |
| 4952 | ADJ40547 | 18983 | 49487 | 79991, 110495, 140999, 171503, 202007 | 11135 | AHM98606 | 25166 | 55670 | 86174, 116678, 147182, 177686, 208190 |
| 4953 | ADJ40557 | 18984 | 49488 | 79992, 110496, 141000, 171504, 202008 | 11136 | AHM98617 | 25167 | 55671 | 86175, 116679, 147183, 177687, 208191 |
| 4954 | ADJ40577 | 18985 | 49489 | 79993, 110497, 141001, 171505, 202009 | 11137 | AHM98628 | 25168 | 55672 | 86176, 116680, 147184, 177688, 208192 |
| 4955 | ADJ40587 | 18986 | 49490 | 79994, 110498, 141002, 171506, 202010 | 11138 | AHM98639 | 25169 | 55673 | 86177, 116681, 147185, 177689, 208193 |
| 4956 | ADJ40597 | 18987 | 49491 | 79995, 110499, 141003, 171507, 202011 | 11139 | AHM98650 | 25170 | 55674 | 86178, 116682, 147186, 177690, 208194 |
| 4957 | ADJ40607 | 18988 | 49492 | 79996, 110500, 141004, 171508, 202012 | 11140 | AHM98661 | 25171 | 55675 | 86179, 116683, 147187, 177691, 208195 |
| 4958 | ADJ40617 | 18989 | 49493 | 79997, 110501, 141005, 171509, 202013 | 11141 | AHM98672 | 25172 | 55676 | 86180, 116684, 147188, 177692, 208196 |
| 4959 | ADJ40627 | 18990 | 49494 | 79998, 110502, 141006, 171510, 202014 | 11142 | AHM98683 | 25173 | 55677 | 86181, 116685, 147189, 177693, 208197 |
| 4960 | ADJ40637 | 18991 | 49495 | 79999, 110503, 141007, 171511, 202015 | 11143 | AHM98693 | 25174 | 55678 | 86182, 116686, 147190, 177694, 208198 |
| 4961 | ADJ40657 | 18992 | 49496 | 80000, 110504, 141008, 171512, 202016 | 11144 | AHM98704 | 25175 | 55679 | 86183, 116687, 147191, 177695, 208199 |

FIG. 3 continued

| | | | | | | | | | |
|---|---|---|---|---|---|---|---|---|---|
| 4962 | ADJ40667 | 18993 | 49497 | 80001, 110505, 141009, 171513, 202017 | 11145 | AHM98715 | 25176 | 55680 | 86184, 116688, 147192, 177696, 208200 |
| 4963 | ADJ40677 | 18994 | 49498 | 80002, 110506, 141010, 171514, 202018 | 11146 | AHM98726 | 25177 | 55681 | 86185, 116689, 147193, 177697, 208201 |
| 4964 | ADJ41819 | 18995 | 49499 | 80003, 110507, 141011, 171515, 202019 | 11147 | AHM98737 | 25178 | 55682 | 86186, 116690, 147194, 177698, 208202 |
| 4965 | ADJ56642 | 18996 | 49500 | 80004, 110508, 141012, 171516, 202020 | 11148 | AHM98748 | 25179 | 55683 | 86187, 116691, 147195, 177699, 208203 |
| 4966 | ADJ56652 | 18997 | 49501 | 80005, 110509, 141013, 171517, 202021 | 11149 | AHM98759 | 25180 | 55684 | 86188, 116692, 147196, 177700, 208204 |
| 4967 | ADJ80637 | 18998 | 49502 | 80006, 110510, 141014, 171518, 202022 | 11150 | AHM98770 | 25181 | 55685 | 86189, 116693, 147197, 177701, 208205 |
| 4968 | ADJ80647 | 18999 | 49503 | 80007, 110511, 141015, 171519, 202023 | 11151 | AHM98781 | 25182 | 55686 | 86190, 116694, 147198, 177702, 208206 |
| 4969 | ADJ80657 | 19000 | 49504 | 80008, 110512, 141016, 171520, 202024 | 11152 | AHM98801 | 25183 | 55687 | 86191, 116695, 147199, 177703, 208207 |
| 4970 | ADJ80667 | 19001 | 49505 | 80009, 110513, 141017, 171521, 202025 | 11153 | AHM98812 | 25184 | 55688 | 86192, 116696, 147200, 177704, 208208 |
| 4971 | ADJ80677 | 19002 | 49506 | 80010, 110514, 141018, 171522, 202026 | 11154 | AHM98823 | 25185 | 55689 | 86193, 116697, 147201, 177705, 208209 |
| 4972 | ADJ80687 | 19003 | 49507 | 80011, 110515, 141019, 171523, 202027 | 11155 | AHM98839 | 25186 | 55690 | 86194, 116698, 147202, 177706, 208210 |
| 4973 | ADJ80697 | 19004 | 49508 | 80012, 110516, 141020, 171524, 202028 | 11156 | AHM98850 | 25187 | 55691 | 86195, 116699, 147203, 177707, 208211 |
| 4974 | ADJ80717 | 19005 | 49509 | 80013, 110517, 141021, 171525, 202029 | 11157 | AHM98861 | 25188 | 55692 | 86196, 116700, 147204, 177708, 208212 |
| 4975 | ADJ80727 | 19006 | 49510 | 80014, 110518, 141022, 171526, 202030 | 11158 | AHM98901 | 25189 | 55693 | 86197, 116701, 147205, 177709, 208213 |
| 4976 | ADJ80737 | 19007 | 49511 | 80015, 110519, 141023, 171527, 202031 | 11159 | AHM98912 | 25190 | 55694 | 86198, 116702, 147206, 177710, 208214 |
| 4977 | ADJ80747 | 19008 | 49512 | 80016, 110520, 141024, 171528, 202032 | 11160 | AHM98923 | 25191 | 55695 | 86199, 116703, 147207, 177711, 208215 |
| 4978 | ADJ80757 | 19009 | 49513 | 80017, 110521, 141025, 171529, 202033 | 11161 | AHM98935 | 25192 | 55696 | 86200, 116704, 147208, 177712, 208216 |
| 4979 | ADJ80767 | 19010 | 49514 | 80018, 110522, 141026, 171530, 202034 | 11162 | AHM98943 | 25193 | 55697 | 86201, 116705, 147209, 177713, 208217 |

FIG. 3 continued

| | | | | | | | | | |
|---|---|---|---|---|---|---|---|---|---|
| 4980 | ADJ80777 | 19011 | 49515 | 80019, 110523, 141027, 171531, 202035 | 11163 | AHM98954 | 25194 | 55698 | 86202, 116706, 147210, 177714, 208218 |
| 4981 | ADJ80787 | 19012 | 49516 | 80020, 110524, 141028, 171532, 202036 | 11164 | AHM98972 | 25195 | 55699 | 86203, 116707, 147211, 177715, 208219 |
| 4982 | ADJ80797 | 19013 | 49517 | 80021, 110525, 141029, 171533, 202037 | 11165 | AHM98978 | 25196 | 55700 | 86204, 116708, 147212, 177716, 208220 |
| 4983 | ADJ80807 | 19014 | 49518 | 80022, 110526, 141030, 171534, 202038 | 11166 | AHM98990 | 25197 | 55701 | 86205, 116709, 147213, 177717, 208221 |
| 4984 | ADJ80817 | 19015 | 49519 | 80023, 110527, 141031, 171535, 202039 | 11167 | AHM99000 | 25198 | 55702 | 86206, 116710, 147214, 177718, 208222 |
| 4985 | ADJ80827 | 19016 | 49520 | 80024, 110528, 141032, 171536, 202040 | 11168 | AHM99011 | 25199 | 55703 | 86207, 116711, 147215, 177719, 208223 |
| 4986 | ADJ80837 | 19017 | 49521 | 80025, 110529, 141033, 171537, 202041 | 11169 | AHM99022 | 25200 | 55704 | 86208, 116712, 147216, 177720, 208224 |
| 4987 | ADJ80851 | 19018 | 49522 | 80026, 110530, 141034, 171538, 202042 | 11170 | AHM99034 | 25201 | 55705 | 86209, 116713, 147217, 177721, 208225 |
| 4988 | ADJ80861 | 19019 | 49523 | 80027, 110531, 141035, 171539, 202043 | 11171 | AHM99046 | 25202 | 55706 | 86210, 116714, 147218, 177722, 208226 |
| 4989 | ADJ80871 | 19020 | 49524 | 80028, 110532, 141036, 171540, 202044 | 11172 | AHM99057 | 25203 | 55707 | 86211, 116715, 147219, 177723, 208227 |
| 4990 | ADJ80886 | 19021 | 49525 | 80029, 110533, 141037, 171541, 202045 | 11173 | AHM99068 | 25204 | 55708 | 86212, 116716, 147220, 177724, 208228 |
| 4991 | ADJ80896 | 19022 | 49526 | 80030, 110534, 141038, 171542, 202046 | 11174 | AHM99078 | 25205 | 55709 | 86213, 116717, 147221, 177725, 208229 |
| 4992 | ADJ80913 | 19023 | 49527 | 80031, 110535, 141039, 171543, 202047 | 11175 | AHN00720 | 25206 | 55710 | 86214, 116718, 147222, 177726, 208230 |
| 4993 | ADJ80930 | 19024 | 49528 | 80032, 110536, 141040, 171544, 202048 | 11176 | AHN00767 | 25207 | 55711 | 86215, 116719, 147223, 177727, 208231 |
| 4994 | ADJ80950 | 19025 | 49529 | 80033, 110537, 141041, 171545, 202049 | 11177 | AHN96324 | 25208 | 55712 | 86216, 116720, 147224, 177728, 208232 |
| 4995 | ADJ80960 | 19026 | 49530 | 80034, 110538, 141042, 171546, 202050 | 11178 | AHN96448 | 25209 | 55713 | 86217, 116721, 147225, 177729, 208233 |
| 4996 | ADJ80970 | 19027 | 49531 | 80035, 110539, 141043, 171547, 202051 | 11179 | AHN96450 | 25210 | 55714 | 86218, 116722, 147226, 177730, 208234 |
| 4997 | ADJ80980 | 19028 | 49532 | 80036, 110540, 141044, 171548, 202052 | 11180 | AHN96451 | 25211 | 55715 | 86219, 116723, 147227, 177731, 208235 |

FIG. 3 continued

| | | | | | | | | | |
|---|---|---|---|---|---|---|---|---|---|
| 4998 | ADJ80996 | 19029 | 49533 | 80037, 110541, 141045, 171549, 202053 | 11181 | AHN96453 | 25212 | 55716 | 86220, 116724, 147228, 177732, 208236 |
| 4999 | ADJ81006 | 19030 | 49534 | 80038, 110542, 141046, 171550, 202054 | 11182 | AHZ13526 | 25213 | 55717 | 86221, 116725, 147229, 177733, 208237 |
| 5000 | ADJ81016 | 19031 | 49535 | 80039, 110543, 141047, 171551, 202055 | 11183 | AHZ13584 | 25214 | 55718 | 86222, 116726, 147230, 177734, 208238 |
| 5001 | ADJ81026 | 19032 | 49536 | 80040, 110544, 141048, 171552, 202056 | 11184 | AHZ35575 | 25215 | 55719 | 86223, 116727, 147231, 177735, 208239 |
| 5002 | ADJ81036 | 19033 | 49537 | 80041, 110545, 141049, 171553, 202057 | 11185 | AHZ35587 | 25216 | 55720 | 86224, 116728, 147232, 177736, 208240 |
| 5003 | ADJ81046 | 19034 | 49538 | 80042, 110546, 141050, 171554, 202058 | 11186 | AHZ35611 | 25217 | 55721 | 86225, 116729, 147233, 177737, 208241 |
| 5004 | ADJ81056 | 19035 | 49539 | 80043, 110547, 141051, 171555, 202059 | 11187 | AHZ35623 | 25218 | 55722 | 86226, 116730, 147234, 177738, 208242 |
| 5005 | ADJ81066 | 19036 | 49540 | 80044, 110548, 141052, 171556, 202060 | 11188 | AHZ35635 | 25219 | 55723 | 86227, 116731, 147235, 177739, 208243 |
| 5006 | ADJ84775 | 19037 | 49541 | 80045, 110549, 141053, 171557, 202061 | 11189 | AHZ35647 | 25220 | 55724 | 86228, 116732, 147236, 177740, 208244 |
| 5007 | ADJ88785 | 19038 | 49542 | 80046, 110550, 141054, 171558, 202062 | 11190 | AHZ35659 | 25221 | 55725 | 86229, 116733, 147237, 177741, 208245 |
| 5008 | ADK21716 | 19039 | 49543 | 80047, 110551, 141055, 171559, 202063 | 11191 | AHZ35671 | 25222 | 55726 | 86230, 116734, 147238, 177742, 208246 |
| 5009 | ADK21726 | 19040 | 49544 | 80048, 110552, 141056, 171560, 202064 | 11192 | AHZ35683 | 25223 | 55727 | 86231, 116735, 147239, 177743, 208247 |
| 5010 | ADK21736 | 19041 | 49545 | 80049, 110553, 141057, 171561, 202065 | 11193 | AHZ35695 | 25224 | 55728 | 86232, 116736, 147240, 177744, 208248 |
| 5011 | ADK21746 | 19042 | 49546 | 80050, 110554, 141058, 171562, 202066 | 11194 | AHZ35719 | 25225 | 55729 | 86233, 116737, 147241, 177745, 208249 |
| 5012 | ADK21756 | 19043 | 49547 | 80051, 110555, 141059, 171563, 202067 | 11195 | AHZ35731 | 25226 | 55730 | 86234, 116738, 147242, 177746, 208250 |
| 5013 | ADK21766 | 19044 | 49548 | 80052, 110556, 141060, 171564, 202068 | 11196 | AHZ35743 | 25227 | 55731 | 86235, 116739, 147243, 177747, 208251 |
| 5014 | ADK21776 | 19045 | 49549 | 80053, 110557, 141061, 171565, 202069 | 11197 | AHZ35755 | 25228 | 55732 | 86236, 116740, 147244, 177748, 208252 |
| 5015 | ADK21786 | 19046 | 49550 | 80054, 110558, 141062, 171566, 202070 | 11198 | AHZ35767 | 25229 | 55733 | 86237, 116741, 147245, 177749, 208253 |

FIG. 3 continued

| | | | | | | | | | |
|---|---|---|---|---|---|---|---|---|---|
| 5016 | ADK21796 | 19047 | 49551 | 80055, 110559, 141063, 171567, 202071 | 11199 | AHZ35779 | 25230 | 55734 | 86238, 116742, 147246, 177750, 208254 |
| 5017 | ADK21806 | 19048 | 49552 | 80056, 110560, 141064, 171568, 202072 | 11200 | AHZ35803 | 25231 | 55735 | 86239, 116743, 147247, 177751, 208255 |
| 5018 | ADK21816 | 19049 | 49553 | 80057, 110561, 141065, 171569, 202073 | 11201 | AHZ35814 | 25232 | 55736 | 86240, 116744, 147248, 177752, 208256 |
| 5019 | ADK21826 | 19050 | 49554 | 80058, 110562, 141066, 171570, 202074 | 11202 | AHZ35837 | 25233 | 55737 | 86241, 116745, 147249, 177753, 208257 |
| 5020 | ADK21836 | 19051 | 49555 | 80059, 110563, 141067, 171571, 202075 | 11203 | AHZ35848 | 25234 | 55738 | 86242, 116746, 147250, 177754, 208258 |
| 5021 | ADK21846 | 19052 | 49556 | 80060, 110564, 141068, 171572, 202076 | 11204 | AHZ35859 | 25235 | 55739 | 86243, 116747, 147251, 177755, 208259 |
| 5022 | ADK21856 | 19053 | 49557 | 80061, 110565, 141069, 171573, 202077 | 11205 | AHZ35870 | 25236 | 55740 | 86244, 116748, 147252, 177756, 208260 |
| 5023 | ADK21866 | 19054 | 49558 | 80062, 110566, 141070, 171574, 202078 | 11206 | AHZ35882 | 25237 | 55741 | 86245, 116749, 147253, 177757, 208261 |
| 5024 | ADK21876 | 19055 | 49559 | 80063, 110567, 141071, 171575, 202079 | 11207 | AHZ35894 | 25238 | 55742 | 86246, 116750, 147254, 177758, 208262 |
| 5025 | ADK21886 | 19056 | 49560 | 80064, 110568, 141072, 171576, 202080 | 11208 | AHZ35905 | 25239 | 55743 | 86247, 116751, 147255, 177759, 208263 |
| 5026 | ADK21896 | 19057 | 49561 | 80065, 110569, 141073, 171577, 202081 | 11209 | AHZ35916 | 25240 | 55744 | 86248, 116752, 147256, 177760, 208264 |
| 5027 | ADK21906 | 19058 | 49562 | 80066, 110570, 141074, 171578, 202082 | 11210 | AHZ35927 | 25241 | 55745 | 86249, 116753, 147257, 177761, 208265 |
| 5028 | ADK21916 | 19059 | 49563 | 80067, 110571, 141075, 171579, 202083 | 11211 | AHZ35938 | 25242 | 55746 | 86250, 116754, 147258, 177762, 208266 |
| 5029 | ADK21926 | 19060 | 49564 | 80068, 110572, 141076, 171580, 202084 | 11212 | AHZ35949 | 25243 | 55747 | 86251, 116755, 147259, 177763, 208267 |
| 5030 | ADK21936 | 19061 | 49565 | 80069, 110573, 141077, 171581, 202085 | 11213 | AHZ35961 | 25244 | 55748 | 86252, 116756, 147260, 177764, 208268 |
| 5031 | ADK21946 | 19062 | 49566 | 80070, 110574, 141078, 171582, 202086 | 11214 | AHZ35972 | 25245 | 55749 | 86253, 116757, 147261, 177765, 208269 |
| 5032 | ADK21956 | 19063 | 49567 | 80071, 110575, 141079, 171583, 202087 | 11215 | AHZ35983 | 25246 | 55750 | 86254, 116758, 147262, 177766, 208270 |
| 5033 | ADK32393 | 19064 | 49568 | 80072, 110576, 141080, 171584, 202088 | 11216 | AHZ35994 | 25247 | 55751 | 86255, 116759, 147263, 177767, 208271 |

FIG. 3 continued

| | | | | | | | | | |
|---|---|---|---|---|---|---|---|---|---|
| 5034 | ADK32403 | 19065 | 49569 | 80073, 110577, 141081, 171585, 202089 | 11217 | AHZ36005 | 25248 | 55752 | 86256, 116760, 147264, 177768, 208272 |
| 5035 | ADK32413 | 19066 | 49570 | 80074, 110578, 141082, 171586, 202090 | 11218 | AHZ36016 | 25249 | 55753 | 86257, 116761, 147265, 177769, 208273 |
| 5036 | ADK32423 | 19067 | 49571 | 80075, 110579, 141083, 171587, 202091 | 11219 | AHZ36027 | 25250 | 55754 | 86258, 116762, 147266, 177770, 208274 |
| 5037 | ADK32433 | 19068 | 49572 | 80076, 110580, 141084, 171588, 202092 | 11220 | AHZ36050 | 25251 | 55755 | 86259, 116763, 147267, 177771, 208275 |
| 5038 | ADK32443 | 19069 | 49573 | 80077, 110581, 141085, 171589, 202093 | 11221 | AHZ36062 | 25252 | 55756 | 86260, 116764, 147268, 177772, 208276 |
| 5039 | ADK32453 | 19070 | 49574 | 80078, 110582, 141086, 171590, 202094 | 11222 | AHZ36084 | 25253 | 55757 | 86261, 116765, 147269, 177773, 208277 |
| 5040 | ADK32463 | 19071 | 49575 | 80079, 110583, 141087, 171591, 202095 | 11223 | AHZ36095 | 25254 | 55758 | 86262, 116766, 147270, 177774, 208278 |
| 5041 | ADK32473 | 19072 | 49576 | 80080, 110584, 141088, 171592, 202096 | 11224 | AHZ36106 | 25255 | 55759 | 86263, 116767, 147271, 177775, 208279 |
| 5042 | ADK32483 | 19073 | 49577 | 80081, 110585, 141089, 171593, 202097 | 11225 | AHZ36117 | 25256 | 55760 | 86264, 116768, 147272, 177776, 208280 |
| 5043 | ADK32493 | 19074 | 49578 | 80082, 110586, 141090, 171594, 202098 | 11226 | AHZ36128 | 25257 | 55761 | 86265, 116769, 147273, 177777, 208281 |
| 5044 | ADK32505 | 19075 | 49579 | 80083, 110587, 141091, 171595, 202099 | 11227 | AHZ36139 | 25258 | 55762 | 86266, 116770, 147274, 177778, 208282 |
| 5045 | ADK32640 | 19076 | 49580 | 80084, 110588, 141092, 171596, 202100 | 11228 | AHZ36150 | 25259 | 55763 | 86267, 116771, 147275, 177779, 208283 |
| 5046 | ADK32650 | 19077 | 49581 | 80085, 110589, 141093, 171597, 202101 | 11229 | AHZ36161 | 25260 | 55764 | 86268, 116772, 147276, 177780, 208284 |
| 5047 | ADK32660 | 19078 | 49582 | 80086, 110590, 141094, 171598, 202102 | 11230 | AHZ36172 | 25261 | 55765 | 86269, 116773, 147277, 177781, 208285 |
| 5048 | ADK32670 | 19079 | 49583 | 80087, 110591, 141095, 171599, 202103 | 11231 | AHZ36183 | 25262 | 55766 | 86270, 116774, 147278, 177782, 208286 |
| 5049 | ADK32680 | 19080 | 49584 | 80088, 110592, 141096, 171600, 202104 | 11232 | AHZ36194 | 25263 | 55767 | 86271, 116775, 147279, 177783, 208287 |
| 5050 | ADK32690 | 19081 | 49585 | 80089, 110593, 141097, 171601, 202105 | 11233 | AHZ36206 | 25264 | 55768 | 86272, 116776, 147280, 177784, 208288 |
| 5051 | ADK32700 | 19082 | 49586 | 80090, 110594, 141098, 171602, 202106 | 11234 | AHZ36218 | 25265 | 55769 | 86273, 116777, 147281, 177785, 208289 |

FIG. 3 continued

| | | | | | | | | | |
|---|---|---|---|---|---|---|---|---|---|
| 5052 | ADK32779 | 19083 | 49587 | 80091, 110595, 141099, 171603, 202107 | 11235 | AHZ36229 | 25266 | 55770 | 86274, 116778, 147282, 177786, 208290 |
| 5053 | ADK33614 | 19084 | 49588 | 80092, 110596, 141100, 171604, 202108 | 11236 | AHZ36241 | 25267 | 55771 | 86275, 116779, 147283, 177787, 208291 |
| 5054 | ADK33624 | 19085 | 49589 | 80093, 110597, 141101, 171605, 202109 | 11237 | AHZ36252 | 25268 | 55772 | 86276, 116780, 147284, 177788, 208292 |
| 5055 | ADK33634 | 19086 | 49590 | 80094, 110598, 141102, 171606, 202110 | 11238 | AHZ36263 | 25269 | 55773 | 86277, 116781, 147285, 177789, 208293 |
| 5056 | ADK33644 | 19087 | 49591 | 80095, 110599, 141103, 171607, 202111 | 11239 | AHZ36274 | 25270 | 55774 | 86278, 116782, 147286, 177790, 208294 |
| 5057 | ADK33654 | 19088 | 49592 | 80096, 110600, 141104, 171608, 202112 | 11240 | AHZ36286 | 25271 | 55775 | 86279, 116783, 147287, 177791, 208295 |
| 5058 | ADK33664 | 19089 | 49593 | 80097, 110601, 141105, 171609, 202113 | 11241 | AHZ36297 | 25272 | 55776 | 86280, 116784, 147288, 177792, 208296 |
| 5059 | ADK33674 | 19090 | 49594 | 80098, 110602, 141106, 171610, 202114 | 11242 | AHZ36309 | 25273 | 55777 | 86281, 116785, 147289, 177793, 208297 |
| 5060 | ADK33684 | 19091 | 49595 | 80099, 110603, 141107, 171611, 202115 | 11243 | AHZ36320 | 25274 | 55778 | 86282, 116786, 147290, 177794, 208298 |
| 5061 | ADK33694 | 19092 | 49596 | 80100, 110604, 141108, 171612, 202116 | 11244 | AHZ36331 | 25275 | 55779 | 86283, 116787, 147291, 177795, 208299 |
| 5062 | ADK33704 | 19093 | 49597 | 80101, 110605, 141109, 171613, 202117 | 11245 | AHZ36353 | 25276 | 55780 | 86284, 116788, 147292, 177796, 208300 |
| 5063 | ADK33714 | 19094 | 49598 | 80102, 110606, 141110, 171614, 202118 | 11246 | AHZ36365 | 25277 | 55781 | 86285, 116789, 147293, 177797, 208301 |
| 5064 | ADK33744 | 19095 | 49599 | 80103, 110607, 141111, 171615, 202119 | 11247 | AHZ36376 | 25278 | 55782 | 86286, 116790, 147294, 177798, 208302 |
| 5065 | ADK33754 | 19096 | 49600 | 80104, 110608, 141112, 171616, 202120 | 11248 | AHZ36388 | 25279 | 55783 | 86287, 116791, 147295, 177799, 208303 |
| 5066 | ADK33764 | 19097 | 49601 | 80105, 110609, 141113, 171617, 202121 | 11249 | AHZ36400 | 25280 | 55784 | 86288, 116792, 147296, 177800, 208304 |
| 5067 | ADK33774 | 19098 | 49602 | 80106, 110610, 141114, 171618, 202122 | 11250 | AHZ36412 | 25281 | 55785 | 86289, 116793, 147297, 177801, 208305 |
| 5068 | ADK33784 | 19099 | 49603 | 80107, 110611, 141115, 171619, 202123 | 11251 | AHZ36424 | 25282 | 55786 | 86290, 116794, 147298, 177802, 208306 |
| 5069 | ADK33794 | 19100 | 49604 | 80108, 110612, 141116, 171620, 202124 | 11252 | AHZ36436 | 25283 | 55787 | 86291, 116795, 147299, 177803, 208307 |

FIG. 3 continued

| | | | | | | | | | |
|---|---|---|---|---|---|---|---|---|---|
| 5070 | ADK33804 | 19101 | 49605 | 80109, 110613, 141117, 171621, 202125 | 11253 | AHZ36448 | 25284 | 55788 | 86292, 116796, 147300, 177804, 208308 |
| 5071 | ADK33814 | 19102 | 49606 | 80110, 110614, 141118, 171622, 202126 | 11254 | AHZ36460 | 25285 | 55789 | 86293, 116797, 147301, 177805, 208309 |
| 5072 | ADK33824 | 19103 | 49607 | 80111, 110615, 141119, 171623, 202127 | 11255 | AHZ36472 | 25286 | 55790 | 86294, 116798, 147302, 177806, 208310 |
| 5073 | ADK33834 | 19104 | 49608 | 80112, 110616, 141120, 171624, 202128 | 11256 | AHZ36484 | 25287 | 55791 | 86295, 116799, 147303, 177807, 208311 |
| 5074 | ADK33844 | 19105 | 49609 | 80113, 110617, 141121, 171625, 202129 | 11257 | AHZ36496 | 25288 | 55792 | 86296, 116800, 147304, 177808, 208312 |
| 5075 | ADK33854 | 19106 | 49610 | 80114, 110618, 141122, 171626, 202130 | 11258 | AHZ36508 | 25289 | 55793 | 86297, 116801, 147305, 177809, 208313 |
| 5076 | ADK33864 | 19107 | 49611 | 80115, 110619, 141123, 171627, 202131 | 11259 | AHZ36520 | 25290 | 55794 | 86298, 116802, 147306, 177810, 208314 |
| 5077 | ADK33874 | 19108 | 49612 | 80116, 110620, 141124, 171628, 202132 | 11260 | AHZ36532 | 25291 | 55795 | 86299, 116803, 147307, 177811, 208315 |
| 5078 | ADK33884 | 19109 | 49613 | 80117, 110621, 141125, 171629, 202133 | 11261 | AHZ36544 | 25292 | 55796 | 86300, 116804, 147308, 177812, 208316 |
| 5079 | ADK33894 | 19110 | 49614 | 80118, 110622, 141126, 171630, 202134 | 11262 | AHZ36556 | 25293 | 55797 | 86301, 116805, 147309, 177813, 208317 |
| 5080 | ADK33904 | 19111 | 49615 | 80119, 110623, 141127, 171631, 202135 | 11263 | AHZ36568 | 25294 | 55798 | 86302, 116806, 147310, 177814, 208318 |
| 5081 | ADK33914 | 19112 | 49616 | 80120, 110624, 141128, 171632, 202136 | 11264 | AHZ36580 | 25295 | 55799 | 86303, 116807, 147311, 177815, 208319 |
| 5082 | ADK33924 | 19113 | 49617 | 80121, 110625, 141129, 171633, 202137 | 11265 | AHZ36592 | 25296 | 55800 | 86304, 116808, 147312, 177816, 208320 |
| 5083 | ADK33934 | 19114 | 49618 | 80122, 110626, 141130, 171634, 202138 | 11266 | AHZ36604 | 25297 | 55801 | 86305, 116809, 147313, 177817, 208321 |
| 5084 | ADK33944 | 19115 | 49619 | 80123, 110627, 141131, 171635, 202139 | 11267 | AHZ36616 | 25298 | 55802 | 86306, 116810, 147314, 177818, 208322 |
| 5085 | ADK33954 | 19116 | 49620 | 80124, 110628, 141132, 171636, 202140 | 11268 | AHZ36628 | 25299 | 55803 | 86307, 116811, 147315, 177819, 208323 |
| 5086 | ADK33964 | 19117 | 49621 | 80125, 110629, 141133, 171637, 202141 | 11269 | AHZ36640 | 25300 | 55804 | 86308, 116812, 147316, 177820, 208324 |
| 5087 | ADK33974 | 19118 | 49622 | 80126, 110630, 141134, 171638, 202142 | 11270 | AHZ36652 | 25301 | 55805 | 86309, 116813, 147317, 177821, 208325 |

FIG. 3 continued

| | | | | | | | | | |
|---|---|---|---|---|---|---|---|---|---|
| 5088 | ADK33984 | 19119 | 49623 | 80127, 110631, 141135, 171639, 202143 | 11271 | AHZ36664 | 25302 | 55806 | 86310, 116814, 147318, 177822, 208326 |
| 5089 | ADK39016 | 19120 | 49624 | 80128, 110632, 141136, 171640, 202144 | 11272 | AHZ36676 | 25303 | 55807 | 86311, 116815, 147319, 177823, 208327 |
| 5090 | ADK45315 | 19121 | 49625 | 80129, 110633, 141137, 171641, 202145 | 11273 | AHZ36688 | 25304 | 55808 | 86312, 116816, 147320, 177824, 208328 |
| 5091 | ADK45413 | 19122 | 49626 | 80130, 110634, 141138, 171642, 202146 | 11274 | AHZ39689 | 25305 | 55809 | 86313, 116817, 147321, 177825, 208329 |
| 5092 | ADK45424 | 19123 | 49627 | 80131, 110635, 141139, 171643, 202147 | 11275 | AHZ39713 | 25306 | 55810 | 86314, 116818, 147322, 177826, 208330 |
| 5093 | ADK45446 | 19124 | 49628 | 80132, 110636, 141140, 171644, 202148 | 11276 | AHZ39725 | 25307 | 55811 | 86315, 116819, 147323, 177827, 208331 |
| 5094 | ADK45457 | 19125 | 49629 | 80133, 110637, 141141, 171645, 202149 | 11277 | AHZ39737 | 25308 | 55812 | 86316, 116820, 147324, 177828, 208332 |
| 5095 | ADK45479 | 19126 | 49630 | 80134, 110638, 141142, 171646, 202150 | 11278 | AHZ39749 | 25309 | 55813 | 86317, 116821, 147325, 177829, 208333 |
| 5096 | ADK48799 | 19127 | 49631 | 80135, 110639, 141143, 171647, 202151 | 11279 | AHZ39761 | 25310 | 55814 | 86318, 116822, 147326, 177830, 208334 |
| 5097 | ADK62686 | 19128 | 49632 | 80136, 110640, 141144, 171648, 202152 | 11280 | AHZ39773 | 25311 | 55815 | 86319, 116823, 147327, 177831, 208335 |
| 5098 | ADK62696 | 19129 | 49633 | 80137, 110641, 141145, 171649, 202153 | 11281 | AHZ39785 | 25312 | 55816 | 86320, 116824, 147328, 177832, 208336 |
| 5099 | ADK64994 | 19130 | 49634 | 80138, 110642, 141146, 171650, 202154 | 11282 | AHZ39797 | 25313 | 55817 | 86321, 116825, 147329, 177833, 208337 |
| 5100 | ADK65002 | 19131 | 49635 | 80139, 110643, 141147, 171651, 202155 | 11283 | AHZ39821 | 25314 | 55818 | 86322, 116826, 147330, 177834, 208338 |
| 5101 | ADK65010 | 19132 | 49636 | 80140, 110644, 141148, 171652, 202156 | 11284 | AHZ39833 | 25315 | 55819 | 86323, 116827, 147331, 177835, 208339 |
| 5102 | ADK65018 | 19133 | 49637 | 80141, 110645, 141149, 171653, 202157 | 11285 | AHZ39844 | 25316 | 55820 | 86324, 116828, 147332, 177836, 208340 |
| 5103 | ADK87290 | 19134 | 49638 | 80142, 110646, 141150, 171654, 202158 | 11286 | AHZ39856 | 25317 | 55821 | 86325, 116829, 147333, 177837, 208341 |
| 5104 | ADK87292 | 19135 | 49639 | 80143, 110647, 141151, 171655, 202159 | 11287 | AHZ39868 | 25318 | 55822 | 86326, 116830, 147334, 177838, 208342 |
| 5105 | ADK87294 | 19136 | 49640 | 80144, 110648, 141152, 171656, 202160 | 11288 | AHZ39892 | 25319 | 55823 | 86327, 116831, 147335, 177839, 208343 |

FIG. 3 continued

| | | | | | | | | | |
|---|---|---|---|---|---|---|---|---|---|
| 5106 | ADK87297 | 19137 | 49641 | 80145, 110649, 141153, 171657, 202161 | 11289 | AHZ39904 | 25320 | 55824 | 86328, 116832, 147336, 177840, 208344 |
| 5107 | ADK87299 | 19138 | 49642 | 80146, 110650, 141154, 171658, 202162 | 11290 | AHZ39916 | 25321 | 55825 | 86329, 116833, 147337, 177841, 208345 |
| 5108 | ADK87301 | 19139 | 49643 | 80147, 110651, 141155, 171659, 202163 | 11291 | AHZ39928 | 25322 | 55826 | 86330, 116834, 147338, 177842, 208346 |
| 5109 | ADK87303 | 19140 | 49644 | 80148, 110652, 141156, 171660, 202164 | 11292 | AHZ39940 | 25323 | 55827 | 86331, 116835, 147339, 177843, 208347 |
| 5110 | ADK87305 | 19141 | 49645 | 80149, 110653, 141157, 171661, 202165 | 11293 | AHZ39952 | 25324 | 55828 | 86332, 116836, 147340, 177844, 208348 |
| 5111 | ADK87307 | 19142 | 49646 | 80150, 110654, 141158, 171662, 202166 | 11294 | AHZ39976 | 25325 | 55829 | 86333, 116837, 147341, 177845, 208349 |
| 5112 | ADK87312 | 19143 | 49647 | 80151, 110655, 141159, 171663, 202167 | 11295 | AHZ39988 | 25326 | 55830 | 86334, 116838, 147342, 177846, 208350 |
| 5113 | ADK87314 | 19144 | 49648 | 80152, 110656, 141160, 171664, 202168 | 11296 | AHZ40000 | 25327 | 55831 | 86335, 116839, 147343, 177847, 208351 |
| 5114 | ADK87316 | 19145 | 49649 | 80153, 110657, 141161, 171665, 202169 | 11297 | AHZ40012 | 25328 | 55832 | 86336, 116840, 147344, 177848, 208352 |
| 5115 | ADK87318 | 19146 | 49650 | 80154, 110658, 141162, 171666, 202170 | 11298 | AHZ40024 | 25329 | 55833 | 86337, 116841, 147345, 177849, 208353 |
| 5116 | ADK87320 | 19147 | 49651 | 80155, 110659, 141163, 171667, 202171 | 11299 | AHZ40036 | 25330 | 55834 | 86338, 116842, 147346, 177850, 208354 |
| 5117 | ADK87324 | 19148 | 49652 | 80156, 110660, 141164, 171668, 202172 | 11300 | AHZ40048 | 25331 | 55835 | 86339, 116843, 147347, 177851, 208355 |
| 5118 | ADK87327 | 19149 | 49653 | 80157, 110661, 141165, 171669, 202173 | 11301 | AHZ40063 | 25332 | 55836 | 86340, 116844, 147348, 177852, 208356 |
| 5119 | ADK87329 | 19150 | 49654 | 80158, 110662, 141166, 171670, 202174 | 11302 | AHZ40075 | 25333 | 55837 | 86341, 116845, 147349, 177853, 208357 |
| 5120 | ADK87330 | 19151 | 49655 | 80159, 110663, 141167, 171671, 202175 | 11303 | AHZ40087 | 25334 | 55838 | 86342, 116846, 147350, 177854, 208358 |
| 5121 | ADK87331 | 19152 | 49656 | 80160, 110664, 141168, 171672, 202176 | 11304 | AHZ40099 | 25335 | 55839 | 86343, 116847, 147351, 177855, 208359 |
| 5122 | ADK87332 | 19153 | 49657 | 80161, 110665, 141169, 171673, 202177 | 11305 | AHZ40111 | 25336 | 55840 | 86344, 116848, 147352, 177856, 208360 |
| 5123 | ADK87333 | 19154 | 49658 | 80162, 110666, 141170, 171674, 202178 | 11306 | AHZ40123 | 25337 | 55841 | 86345, 116849, 147353, 177857, 208361 |

FIG. 3 continued

| | | | | | | | | | |
|---|---|---|---|---|---|---|---|---|---|
| 5124 | ADK87335 | 19155 | 49659 | 80163, 110667, 141171, 171675, 202179 | 11307 | AHZ40133 | 25338 | 55842 | 86346, 116850, 147354, 177858, 208362 |
| 5125 | ADK87337 | 19156 | 49660 | 80164, 110668, 141172, 171676, 202180 | 11308 | AHZ40145 | 25339 | 55843 | 86347, 116851, 147355, 177859, 208363 |
| 5126 | ADK87339 | 19157 | 49661 | 80165, 110669, 141173, 171677, 202181 | 11309 | AHZ40157 | 25340 | 55844 | 86348, 116852, 147356, 177860, 208364 |
| 5127 | ADK90209 | 19158 | 49662 | 80166, 110670, 141174, 171678, 202182 | 11310 | AHZ40169 | 25341 | 55845 | 86349, 116853, 147357, 177861, 208365 |
| 5128 | ADK90213 | 19159 | 49663 | 80167, 110671, 141175, 171679, 202183 | 11311 | AHZ40180 | 25342 | 55846 | 86350, 116854, 147358, 177862, 208366 |
| 5129 | ADK90217 | 19160 | 49664 | 80168, 110672, 141176, 171680, 202184 | 11312 | AHZ40192 | 25343 | 55847 | 86351, 116855, 147359, 177863, 208367 |
| 5130 | ADK90221 | 19161 | 49665 | 80169, 110673, 141177, 171681, 202185 | 11313 | AHZ40204 | 25344 | 55848 | 86352, 116856, 147360, 177864, 208368 |
| 5131 | ADK90225 | 19162 | 49666 | 80170, 110674, 141178, 171682, 202186 | 11314 | AHZ40216 | 25345 | 55849 | 86353, 116857, 147361, 177865, 208369 |
| 5132 | ADK90229 | 19163 | 49667 | 80171, 110675, 141179, 171683, 202187 | 11315 | AHZ40228 | 25346 | 55850 | 86354, 116858, 147362, 177866, 208370 |
| 5133 | ADK90233 | 19164 | 49668 | 80172, 110676, 141180, 171684, 202188 | 11316 | AHZ40240 | 25347 | 55851 | 86355, 116859, 147363, 177867, 208371 |
| 5134 | ADK90241 | 19165 | 49669 | 80173, 110677, 141181, 171685, 202189 | 11317 | AHZ40252 | 25348 | 55852 | 86356, 116860, 147364, 177868, 208372 |
| 5135 | ADK90245 | 19166 | 49670 | 80174, 110678, 141182, 171686, 202190 | 11318 | AHZ40264 | 25349 | 55853 | 86357, 116861, 147365, 177869, 208373 |
| 5136 | ADK90249 | 19167 | 49671 | 80175, 110679, 141183, 171687, 202191 | 11319 | AHZ40276 | 25350 | 55854 | 86358, 116862, 147366, 177870, 208374 |
| 5137 | ADK90253 | 19168 | 49672 | 80176, 110680, 141184, 171688, 202192 | 11320 | AHZ40288 | 25351 | 55855 | 86359, 116863, 147367, 177871, 208375 |
| 5138 | ADK90257 | 19169 | 49673 | 80177, 110681, 141185, 171689, 202193 | 11321 | AHZ40312 | 25352 | 55856 | 86360, 116864, 147368, 177872, 208376 |
| 5139 | ADK90261 | 19170 | 49674 | 80178, 110682, 141186, 171690, 202194 | 11322 | AHZ40324 | 25353 | 55857 | 86361, 116865, 147369, 177873, 208377 |
| 5140 | ADK90265 | 19171 | 49675 | 80179, 110683, 141187, 171691, 202195 | 11323 | AHZ40336 | 25354 | 55858 | 86362, 116866, 147370, 177874, 208378 |
| 5141 | ADK90269 | 19172 | 49676 | 80180, 110684, 141188, 171692, 202196 | 11324 | AHZ40348 | 25355 | 55859 | 86363, 116867, 147371, 177875, 208379 |

FIG. 3 continued

| | | | | | | | | | |
|---|---|---|---|---|---|---|---|---|---|
| 5142 | ADK90273 | 19173 | 49677 | 80181, 110685, 141189, 171693, 202197 | 11325 | AHZ40360 | 25356 | 55860 | 86364, 116868, 147372, 177876, 208380 |
| 5143 | ADK90277 | 19174 | 49678 | 80182, 110686, 141190, 171694, 202198 | 11326 | AHZ40372 | 25357 | 55861 | 86365, 116869, 147373, 177877, 208381 |
| 5144 | ADK90281 | 19175 | 49679 | 80183, 110687, 141191, 171695, 202199 | 11327 | AHZ40384 | 25358 | 55862 | 86366, 116870, 147374, 177878, 208382 |
| 5145 | ADK90289 | 19176 | 49680 | 80184, 110688, 141192, 171696, 202200 | 11328 | AHZ40396 | 25359 | 55863 | 86367, 116871, 147375, 177879, 208383 |
| 5146 | ADK90293 | 19177 | 49681 | 80185, 110689, 141193, 171697, 202201 | 11329 | AHZ40408 | 25360 | 55864 | 86368, 116872, 147376, 177880, 208384 |
| 5147 | ADK90297 | 19178 | 49682 | 80186, 110690, 141194, 171698, 202202 | 11330 | AHZ40420 | 25361 | 55865 | 86369, 116873, 147377, 177881, 208385 |
| 5148 | ADK90301 | 19179 | 49683 | 80187, 110691, 141195, 171699, 202203 | 11331 | AHZ40432 | 25362 | 55866 | 86370, 116874, 147378, 177882, 208386 |
| 5149 | ADK90305 | 19180 | 49684 | 80188, 110692, 141196, 171700, 202204 | 11332 | AHZ40444 | 25363 | 55867 | 86371, 116875, 147379, 177883, 208387 |
| 5150 | ADK90309 | 19181 | 49685 | 80189, 110693, 141197, 171701, 202205 | 11333 | AHZ40456 | 25364 | 55868 | 86372, 116876, 147380, 177884, 208388 |
| 5151 | ADK90313 | 19182 | 49686 | 80190, 110694, 141198, 171702, 202206 | 11334 | AHZ40468 | 25365 | 55869 | 86373, 116877, 147381, 177885, 208389 |
| 5152 | ADK90317 | 19183 | 49687 | 80191, 110695, 141199, 171703, 202207 | 11335 | AHZ40480 | 25366 | 55870 | 86374, 116878, 147382, 177886, 208390 |
| 5153 | ADK90321 | 19184 | 49688 | 80192, 110696, 141200, 171704, 202208 | 11336 | AHZ40492 | 25367 | 55871 | 86375, 116879, 147383, 177887, 208391 |
| 5154 | ADK90325 | 19185 | 49689 | 80193, 110697, 141201, 171705, 202209 | 11337 | AHZ40503 | 25368 | 55872 | 86376, 116880, 147384, 177888, 208392 |
| 5155 | ADK90329 | 19186 | 49690 | 80194, 110698, 141202, 171706, 202210 | 11338 | AHZ40515 | 25369 | 55873 | 86377, 116881, 147385, 177889, 208393 |
| 5156 | ADK90333 | 19187 | 49691 | 80195, 110699, 141203, 171707, 202211 | 11339 | AHZ40527 | 25370 | 55874 | 86378, 116882, 147386, 177890, 208394 |
| 5157 | ADK90337 | 19188 | 49692 | 80196, 110700, 141204, 171708, 202212 | 11340 | AHZ40539 | 25371 | 55875 | 86379, 116883, 147387, 177891, 208395 |
| 5158 | ADK90341 | 19189 | 49693 | 80197, 110701, 141205, 171709, 202213 | 11341 | AHZ40551 | 25372 | 55876 | 86380, 116884, 147388, 177892, 208396 |
| 5159 | ADK90345 | 19190 | 49694 | 80198, 110702, 141206, 171710, 202214 | 11342 | AHZ40563 | 25373 | 55877 | 86381, 116885, 147389, 177893, 208397 |

FIG. 3 continued

| | | | | | | | | | |
|---|---|---|---|---|---|---|---|---|---|
| 5160 | ADK90349 | 19191 | 49695 | 80199, 110703, 141207, 171711, 202215 | 11343 | AHZ40575 | 25374 | 55878 | 86382, 116886, 147390, 177894, 208398 |
| 5161 | ADK90353 | 19192 | 49696 | 80200, 110704, 141208, 171712, 202216 | 11344 | AHZ40586 | 25375 | 55879 | 86383, 116887, 147391, 177895, 208399 |
| 5162 | ADK90357 | 19193 | 49697 | 80201, 110705, 141209, 171713, 202217 | 11345 | AHZ40598 | 25376 | 55880 | 86384, 116888, 147392, 177896, 208400 |
| 5163 | ADK90361 | 19194 | 49698 | 80202, 110706, 141210, 171714, 202218 | 11346 | AHZ40609 | 25377 | 55881 | 86385, 116889, 147393, 177897, 208401 |
| 5164 | ADK90365 | 19195 | 49699 | 80203, 110707, 141211, 171715, 202219 | 11347 | AHZ40629 | 25378 | 55882 | 86386, 116890, 147394, 177898, 208402 |
| 5165 | ADK90369 | 19196 | 49700 | 80204, 110708, 141212, 171716, 202220 | 11348 | AHZ40641 | 25379 | 55883 | 86387, 116891, 147395, 177899, 208403 |
| 5166 | ADK90373 | 19197 | 49701 | 80205, 110709, 141213, 171717, 202221 | 11349 | AHZ40653 | 25380 | 55884 | 86388, 116892, 147396, 177900, 208404 |
| 5167 | ADK90377 | 19198 | 49702 | 80206, 110710, 141214, 171718, 202222 | 11350 | AHZ40665 | 25381 | 55885 | 86389, 116893, 147397, 177901, 208405 |
| 5168 | ADK90381 | 19199 | 49703 | 80207, 110711, 141215, 171719, 202223 | 11351 | AHZ40677 | 25382 | 55886 | 86390, 116894, 147398, 177902, 208406 |
| 5169 | ADK90385 | 19200 | 49704 | 80208, 110712, 141216, 171720, 202224 | 11352 | AHZ40689 | 25383 | 55887 | 86391, 116895, 147399, 177903, 208407 |
| 5170 | ADK90389 | 19201 | 49705 | 80209, 110713, 141217, 171721, 202225 | 11353 | AHZ40713 | 25384 | 55888 | 86392, 116896, 147400, 177904, 208408 |
| 5171 | ADK90393 | 19202 | 49706 | 80210, 110714, 141218, 171722, 202226 | 11354 | AHZ40725 | 25385 | 55889 | 86393, 116897, 147401, 177905, 208409 |
| 5172 | ADK90397 | 19203 | 49707 | 80211, 110715, 141219, 171723, 202227 | 11355 | AHZ40737 | 25386 | 55890 | 86394, 116898, 147402, 177906, 208410 |
| 5173 | ADK90401 | 19204 | 49708 | 80212, 110716, 141220, 171724, 202228 | 11356 | AHZ40749 | 25387 | 55891 | 86395, 116899, 147403, 177907, 208411 |
| 5174 | ADK90405 | 19205 | 49709 | 80213, 110717, 141221, 171725, 202229 | 11357 | AHZ40761 | 25388 | 55892 | 86396, 116900, 147404, 177908, 208412 |
| 5175 | ADK90409 | 19206 | 49710 | 80214, 110718, 141222, 171726, 202230 | 11358 | AHZ40773 | 25389 | 55893 | 86397, 116901, 147405, 177909, 208413 |
| 5176 | ADK90413 | 19207 | 49711 | 80215, 110719, 141223, 171727, 202231 | 11359 | AHZ40785 | 25390 | 55894 | 86398, 116902, 147406, 177910, 208414 |
| 5177 | ADK90417 | 19208 | 49712 | 80216, 110720, 141224, 171728, 202232 | 11360 | AHZ40796 | 25391 | 55895 | 86399, 116903, 147407, 177911, 208415 |

FIG. 3 continued

| | | | | | | | | | |
|---|---|---|---|---|---|---|---|---|---|
| 5178 | ADK90421 | 19209 | 49713 | 80217, 110721, 141225, 171729, 202233 | 11361 | AHZ40807 | 25392 | 55896 | 86400, 116904, 147408, 177912, 208416 |
| 5179 | ADK90425 | 19210 | 49714 | 80218, 110722, 141226, 171730, 202234 | 11362 | AHZ40818 | 25393 | 55897 | 86401, 116905, 147409, 177913, 208417 |
| 5180 | ADK90429 | 19211 | 49715 | 80219, 110723, 141227, 171731, 202235 | 11363 | AHZ40829 | 25394 | 55898 | 86402, 116906, 147410, 177914, 208418 |
| 5181 | ADK94194 | 19212 | 49716 | 80220, 110724, 141228, 171732, 202236 | 11364 | AHZ40840 | 25395 | 55899 | 86403, 116907, 147411, 177915, 208419 |
| 5182 | ADK94205 | 19213 | 49717 | 80221, 110725, 141229, 171733, 202237 | 11365 | AHZ40851 | 25396 | 55900 | 86404, 116908, 147412, 177916, 208420 |
| 5183 | ADK94216 | 19214 | 49718 | 80222, 110726, 141230, 171734, 202238 | 11366 | AHZ40862 | 25397 | 55901 | 86405, 116909, 147413, 177917, 208421 |
| 5184 | ADK94227 | 19215 | 49719 | 80223, 110727, 141231, 171735, 202239 | 11367 | AHZ40873 | 25398 | 55902 | 86406, 116910, 147414, 177918, 208422 |
| 5185 | ADK94238 | 19216 | 49720 | 80224, 110728, 141232, 171736, 202240 | 11368 | AHZ40884 | 25399 | 55903 | 86407, 116911, 147415, 177919, 208423 |
| 5186 | ADK94260 | 19217 | 49721 | 80225, 110729, 141233, 171737, 202241 | 11369 | AHZ40895 | 25400 | 55904 | 86408, 116912, 147416, 177920, 208424 |
| 5187 | ADK94271 | 19218 | 49722 | 80226, 110730, 141234, 171738, 202242 | 11370 | AHZ40906 | 25401 | 55905 | 86409, 116913, 147417, 177921, 208425 |
| 5188 | ADK94293 | 19219 | 49723 | 80227, 110731, 141235, 171739, 202243 | 11371 | AHZ40917 | 25402 | 55906 | 86410, 116914, 147418, 177922, 208426 |
| 5189 | ADK94304 | 19220 | 49724 | 80228, 110732, 141236, 171740, 202244 | 11372 | AHZ40928 | 25403 | 55907 | 86411, 116915, 147419, 177923, 208427 |
| 5190 | ADK94326 | 19221 | 49725 | 80229, 110733, 141237, 171741, 202245 | 11373 | AHZ40939 | 25404 | 55908 | 86412, 116916, 147420, 177924, 208428 |
| 5191 | ADK94337 | 19222 | 49726 | 80230, 110734, 141238, 171742, 202246 | 11374 | AHZ40950 | 25405 | 55909 | 86413, 116917, 147421, 177925, 208429 |
| 5192 | ADK94444 | 19223 | 49727 | 80231, 110735, 141239, 171743, 202247 | 11375 | AHZ40961 | 25406 | 55910 | 86414, 116918, 147422, 177926, 208430 |
| 5193 | ADK94479 | 19224 | 49728 | 80232, 110736, 141240, 171744, 202248 | 11376 | AHZ40972 | 25407 | 55911 | 86415, 116919, 147423, 177927, 208431 |
| 5194 | ADK94490 | 19225 | 49729 | 80233, 110737, 141241, 171745, 202249 | 11377 | AHZ40983 | 25408 | 55912 | 86416, 116920, 147424, 177928, 208432 |
| 5195 | ADK94501 | 19226 | 49730 | 80234, 110738, 141242, 171746, 202250 | 11378 | AHZ40994 | 25409 | 55913 | 86417, 116921, 147425, 177929, 208433 |

FIG. 3 continued

| | | | | | | | | | |
|---|---|---|---|---|---|---|---|---|---|
| 5196 | ADK94512 | 19227 | 49731 | 80235, 110739, 141243, 171747, 202251 | 11379 | AHZ41005 | 25410 | 55914 | 86418, 116922, 147426, 177930, 208434 |
| 5197 | ADK94534 | 19228 | 49732 | 80236, 110740, 141244, 171748, 202252 | 11380 | AHZ41016 | 25411 | 55915 | 86419, 116923, 147427, 177931, 208435 |
| 5198 | ADK94556 | 19229 | 49733 | 80237, 110741, 141245, 171749, 202253 | 11381 | AHZ41027 | 25412 | 55916 | 86420, 116924, 147428, 177932, 208436 |
| 5199 | ADK94567 | 19230 | 49734 | 80238, 110742, 141246, 171750, 202254 | 11382 | AHZ41049 | 25413 | 55917 | 86421, 116925, 147429, 177933, 208437 |
| 5200 | ADK94578 | 19231 | 49735 | 80239, 110743, 141247, 171751, 202255 | 11383 | AHZ41060 | 25414 | 55918 | 86422, 116926, 147430, 177934, 208438 |
| 5201 | ADK94589 | 19232 | 49736 | 80240, 110744, 141248, 171752, 202256 | 11384 | AHZ41071 | 25415 | 55919 | 86423, 116927, 147431, 177935, 208439 |
| 5202 | ADK98504 | 19233 | 49737 | 80241, 110745, 141249, 171753, 202257 | 11385 | AHZ41082 | 25416 | 55920 | 86424, 116928, 147432, 177936, 208440 |
| 5203 | ADK98506 | 19234 | 49738 | 80242, 110746, 141250, 171754, 202258 | 11386 | AHZ41093 | 25417 | 55921 | 86425, 116929, 147433, 177937, 208441 |
| 5204 | ADK98626 | 19235 | 49739 | 80243, 110747, 141251, 171755, 202259 | 11387 | AHZ41104 | 25418 | 55922 | 86426, 116930, 147434, 177938, 208442 |
| 5205 | ADK98637 | 19236 | 49740 | 80244, 110748, 141252, 171756, 202260 | 11388 | AHZ41115 | 25419 | 55923 | 86427, 116931, 147435, 177939, 208443 |
| 5206 | ADK98648 | 19237 | 49741 | 80245, 110749, 141253, 171757, 202261 | 11389 | AHZ41126 | 25420 | 55924 | 86428, 116932, 147436, 177940, 208444 |
| 5207 | ADK98659 | 19238 | 49742 | 80246, 110750, 141254, 171758, 202262 | 11390 | AHZ41137 | 25421 | 55925 | 86429, 116933, 147437, 177941, 208445 |
| 5208 | ADK98670 | 19239 | 49743 | 80247, 110751, 141255, 171759, 202263 | 11391 | AHZ41148 | 25422 | 55926 | 86430, 116934, 147438, 177942, 208446 |
| 5209 | ADK98681 | 19240 | 49744 | 80248, 110752, 141256, 171760, 202264 | 11392 | AHZ41159 | 25423 | 55927 | 86431, 116935, 147439, 177943, 208447 |
| 5210 | ADK98703 | 19241 | 49745 | 80249, 110753, 141257, 171761, 202265 | 11393 | AHZ41170 | 25424 | 55928 | 86432, 116936, 147440, 177944, 208448 |
| 5211 | ADK98725 | 19242 | 49746 | 80250, 110754, 141258, 171762, 202266 | 11394 | AHZ41181 | 25425 | 55929 | 86433, 116937, 147441, 177945, 208449 |
| 5212 | ADK98736 | 19243 | 49747 | 80251, 110755, 141259, 171763, 202267 | 11395 | AHZ41205 | 25426 | 55930 | 86434, 116938, 147442, 177946, 208450 |
| 5213 | ADK98747 | 19244 | 49748 | 80252, 110756, 141260, 171764, 202268 | 11396 | AHZ41251 | 25427 | 55931 | 86435, 116939, 147443, 177947, 208451 |

FIG. 3 continued

| | | | | | | | | | |
|---|---|---|---|---|---|---|---|---|---|
| 5214 | ADK98758 | 19245 | 49749 | 80253, 110757, 141261, 171765, 202269 | 11397 | AHZ41266 | 25428 | 55932 | 86436, 116940, 147444, 177948, 208452 |
| 5215 | ADK98769 | 19246 | 49750 | 80254, 110758, 141262, 171766, 202270 | 11398 | AHZ41284 | 25429 | 55933 | 86437, 116941, 147445, 177949, 208453 |
| 5216 | ADK98780 | 19247 | 49751 | 80255, 110759, 141263, 171767, 202271 | 11399 | AHZ41295 | 25430 | 55934 | 86438, 116942, 147446, 177950, 208454 |
| 5217 | ADK98791 | 19248 | 49752 | 80256, 110760, 141264, 171768, 202272 | 11400 | AHZ41306 | 25431 | 55935 | 86439, 116943, 147447, 177951, 208455 |
| 5218 | ADK98802 | 19249 | 49753 | 80257, 110761, 141265, 171769, 202273 | 11401 | AHZ41317 | 25432 | 55936 | 86440, 116944, 147448, 177952, 208456 |
| 5219 | ADK98813 | 19250 | 49754 | 80258, 110762, 141266, 171770, 202274 | 11402 | AHZ41328 | 25433 | 55937 | 86441, 116945, 147449, 177953, 208457 |
| 5220 | ADK98824 | 19251 | 49755 | 80259, 110763, 141267, 171771, 202275 | 11403 | AHZ41339 | 25434 | 55938 | 86442, 116946, 147450, 177954, 208458 |
| 5221 | ADK98835 | 19252 | 49756 | 80260, 110764, 141268, 171772, 202276 | 11404 | AHZ41350 | 25435 | 55939 | 86443, 116947, 147451, 177955, 208459 |
| 5222 | ADK98846 | 19253 | 49757 | 80261, 110765, 141269, 171773, 202277 | 11405 | AHZ41369 | 25436 | 55940 | 86444, 116948, 147452, 177956, 208460 |
| 5223 | ADK98857 | 19254 | 49758 | 80262, 110766, 141270, 171774, 202278 | 11406 | AHZ41380 | 25437 | 55941 | 86445, 116949, 147453, 177957, 208461 |
| 5224 | ADK98868 | 19255 | 49759 | 80263, 110767, 141271, 171775, 202279 | 11407 | AHZ41391 | 25438 | 55942 | 86446, 116950, 147454, 177958, 208462 |
| 5225 | ADK98879 | 19256 | 49760 | 80264, 110768, 141272, 171776, 202280 | 11408 | AHZ41402 | 25439 | 55943 | 86447, 116951, 147455, 177959, 208463 |
| 5226 | ADK98890 | 19257 | 49761 | 80265, 110769, 141273, 171777, 202281 | 11409 | AHZ41413 | 25440 | 55944 | 86448, 116952, 147456, 177960, 208464 |
| 5227 | ADK98901 | 19258 | 49762 | 80266, 110770, 141274, 171778, 202282 | 11410 | AHZ41444 | 25441 | 55945 | 86449, 116953, 147457, 177961, 208465 |
| 5228 | ADK98912 | 19259 | 49763 | 80267, 110771, 141275, 171779, 202283 | 11411 | AHZ41455 | 25442 | 55946 | 86450, 116954, 147458, 177962, 208466 |
| 5229 | ADK98923 | 19260 | 49764 | 80268, 110772, 141276, 171780, 202284 | 11412 | AHZ41476 | 25443 | 55947 | 86451, 116955, 147459, 177963, 208467 |
| 5230 | ADK98945 | 19261 | 49765 | 80269, 110773, 141277, 171781, 202285 | 11413 | AHZ41487 | 25444 | 55948 | 86452, 116956, 147460, 177964, 208468 |
| 5231 | ADK98956 | 19262 | 49766 | 80270, 110774, 141278, 171782, 202286 | 11414 | AHZ41498 | 25445 | 55949 | 86453, 116957, 147461, 177965, 208469 |

FIG. 3 continued

| | | | | | | | | | |
|---|---|---|---|---|---|---|---|---|---|
| 5232 | ADK98967 | 19263 | 49767 | 80271, 110775, 141279, 171783, 202287 | 11415 | AHZ41509 | 25446 | 55950 | 86454, 116958, 147462, 177966, 208470 |
| 5233 | ADK98978 | 19264 | 49768 | 80272, 110776, 141280, 171784, 202288 | 11416 | AHZ41520 | 25447 | 55951 | 86455, 116959, 147463, 177967, 208471 |
| 5234 | ADK98989 | 19265 | 49769 | 80273, 110777, 141281, 171785, 202289 | 11417 | AHZ41531 | 25448 | 55952 | 86456, 116960, 147464, 177968, 208472 |
| 5235 | ADK99000 | 19266 | 49770 | 80274, 110778, 141282, 171786, 202290 | 11418 | AHZ41542 | 25449 | 55953 | 86457, 116961, 147465, 177969, 208473 |
| 5236 | ADK99011 | 19267 | 49771 | 80275, 110779, 141283, 171787, 202291 | 11419 | AHZ41553 | 25450 | 55954 | 86458, 116962, 147466, 177970, 208474 |
| 5237 | ADK99022 | 19268 | 49772 | 80276, 110780, 141284, 171788, 202292 | 11420 | AHZ41564 | 25451 | 55955 | 86459, 116963, 147467, 177971, 208475 |
| 5238 | ADK99033 | 19269 | 49773 | 80277, 110781, 141285, 171789, 202293 | 11421 | AHZ41586 | 25452 | 55956 | 86460, 116964, 147468, 177972, 208476 |
| 5239 | ADK99044 | 19270 | 49774 | 80278, 110782, 141286, 171790, 202294 | 11422 | AHZ41597 | 25453 | 55957 | 86461, 116965, 147469, 177973, 208477 |
| 5240 | ADK99055 | 19271 | 49775 | 80279, 110783, 141287, 171791, 202295 | 11423 | AHZ41608 | 25454 | 55958 | 86462, 116966, 147470, 177974, 208478 |
| 5241 | ADK99066 | 19272 | 49776 | 80280, 110784, 141288, 171792, 202296 | 11424 | AHZ41619 | 25455 | 55959 | 86463, 116967, 147471, 177975, 208479 |
| 5242 | ADK99077 | 19273 | 49777 | 80281, 110785, 141289, 171793, 202297 | 11425 | AHZ41630 | 25456 | 55960 | 86464, 116968, 147472, 177976, 208480 |
| 5243 | ADK99088 | 19274 | 49778 | 80282, 110786, 141290, 171794, 202298 | 11426 | AHZ41641 | 25457 | 55961 | 86465, 116969, 147473, 177977, 208481 |
| 5244 | ADK99099 | 19275 | 49779 | 80283, 110787, 141291, 171795, 202299 | 11427 | AHZ41652 | 25458 | 55962 | 86466, 116970, 147474, 177978, 208482 |
| 5245 | ADK99110 | 19276 | 49780 | 80284, 110788, 141292, 171796, 202300 | 11428 | AHZ41663 | 25459 | 55963 | 86467, 116971, 147475, 177979, 208483 |
| 5246 | ADK99121 | 19277 | 49781 | 80285, 110789, 141293, 171797, 202301 | 11429 | AHZ41674 | 25460 | 55964 | 86468, 116972, 147476, 177980, 208484 |
| 5247 | ADK99132 | 19278 | 49782 | 80286, 110790, 141294, 171798, 202302 | 11430 | AHZ41685 | 25461 | 55965 | 86469, 116973, 147477, 177981, 208485 |
| 5248 | ADK99143 | 19279 | 49783 | 80287, 110791, 141295, 171799, 202303 | 11431 | AHZ41696 | 25462 | 55966 | 86470, 116974, 147478, 177982, 208486 |
| 5249 | ADK99154 | 19280 | 49784 | 80288, 110792, 141296, 171800, 202304 | 11432 | AHZ41707 | 25463 | 55967 | 86471, 116975, 147479, 177983, 208487 |

FIG. 3 continued

| | | | | | | | | | |
|---|---|---|---|---|---|---|---|---|---|
| 5250 | ADK99176 | 19281 | 49785 | 80289, 110793, 141297, 171801, 202305 | 11433 | AHZ41718 | 25464 | 55968 | 86472, 116976, 147480, 177984, 208488 |
| 5251 | ADK99187 | 19282 | 49786 | 80290, 110794, 141298, 171802, 202306 | 11434 | AHZ41729 | 25465 | 55969 | 86473, 116977, 147481, 177985, 208489 |
| 5252 | ADK99198 | 19283 | 49787 | 80291, 110795, 141299, 171803, 202307 | 11435 | AHZ41740 | 25466 | 55970 | 86474, 116978, 147482, 177986, 208490 |
| 5253 | ADK99220 | 19284 | 49788 | 80292, 110796, 141300, 171804, 202308 | 11436 | AHZ41751 | 25467 | 55971 | 86475, 116979, 147483, 177987, 208491 |
| 5254 | ADK99231 | 19285 | 49789 | 80293, 110797, 141301, 171805, 202309 | 11437 | AHZ41762 | 25468 | 55972 | 86476, 116980, 147484, 177988, 208492 |
| 5255 | ADK99242 | 19286 | 49790 | 80294, 110798, 141302, 171806, 202310 | 11438 | AHZ42564 | 25469 | 55973 | 86477, 116981, 147485, 177989, 208493 |
| 5256 | ADK99253 | 19287 | 49791 | 80295, 110799, 141303, 171807, 202311 | 11439 | AHZ42575 | 25470 | 55974 | 86478, 116982, 147486, 177990, 208494 |
| 5257 | ADK99264 | 19288 | 49792 | 80296, 110800, 141304, 171808, 202312 | 11440 | AHZ42587 | 25471 | 55975 | 86479, 116983, 147487, 177991, 208495 |
| 5258 | ADK99275 | 19289 | 49793 | 80297, 110801, 141305, 171809, 202313 | 11441 | AHZ42599 | 25472 | 55976 | 86480, 116984, 147488, 177992, 208496 |
| 5259 | ADK99286 | 19290 | 49794 | 80298, 110802, 141306, 171810, 202314 | 11442 | AHZ42611 | 25473 | 55977 | 86481, 116985, 147489, 177993, 208497 |
| 5260 | ADK99297 | 19291 | 49795 | 80299, 110803, 141307, 171811, 202315 | 11443 | AHZ42622 | 25474 | 55978 | 86482, 116986, 147490, 177994, 208498 |
| 5261 | ADK99308 | 19292 | 49796 | 80300, 110804, 141308, 171812, 202316 | 11444 | AHZ42634 | 25475 | 55979 | 86483, 116987, 147491, 177995, 208499 |
| 5262 | ADL14590 | 19293 | 49797 | 80301, 110805, 141309, 171813, 202317 | 11445 | AHZ42646 | 25476 | 55980 | 86484, 116988, 147492, 177996, 208500 |
| 5263 | ADL27992 | 19294 | 49798 | 80302, 110806, 141310, 171814, 202318 | 11446 | AHZ42657 | 25477 | 55981 | 86485, 116989, 147493, 177997, 208501 |
| 5264 | ADL28003 | 19295 | 49799 | 80303, 110807, 141311, 171815, 202319 | 11447 | AHZ42669 | 25478 | 55982 | 86486, 116990, 147494, 177998, 208502 |
| 5265 | ADL28014 | 19296 | 49800 | 80304, 110808, 141312, 171816, 202320 | 11448 | AHZ42681 | 25479 | 55983 | 86487, 116991, 147495, 177999, 208503 |
| 5266 | ADL28025 | 19297 | 49801 | 80305, 110809, 141313, 171817, 202321 | 11449 | AHZ42693 | 25480 | 55984 | 86488, 116992, 147496, 178000, 208504 |
| 5267 | ADL28036 | 19298 | 49802 | 80306, 110810, 141314, 171818, 202322 | 11450 | AHZ42704 | 25481 | 55985 | 86489, 116993, 147497, 178001, 208505 |

FIG. 3 continued

| | | | | | | | | | |
|---|---|---|---|---|---|---|---|---|---|
| 5268 | ADL28047 | 19299 | 49803 | 80307, 110811, 141315, 171819, 202323 | 11451 | AHZ42716 | 25482 | 55986 | 86490, 116994, 147498, 178002, 208506 |
| 5269 | ADL28058 | 19300 | 49804 | 80308, 110812, 141316, 171820, 202324 | 11452 | AHZ42728 | 25483 | 55987 | 86491, 116995, 147499, 178003, 208507 |
| 5270 | ADL28069 | 19301 | 49805 | 80309, 110813, 141317, 171821, 202325 | 11453 | AHZ42740 | 25484 | 55988 | 86492, 116996, 147500, 178004, 208508 |
| 5271 | ADL28080 | 19302 | 49806 | 80310, 110814, 141318, 171822, 202326 | 11454 | AHZ42751 | 25485 | 55989 | 86493, 116997, 147501, 178005, 208509 |
| 5272 | ADL28091 | 19303 | 49807 | 80311, 110815, 141319, 171823, 202327 | 11455 | AHZ42763 | 25486 | 55990 | 86494, 116998, 147502, 178006, 208510 |
| 5273 | ADL28102 | 19304 | 49808 | 80312, 110816, 141320, 171824, 202328 | 11456 | AHZ42775 | 25487 | 55991 | 86495, 116999, 147503, 178007, 208511 |
| 5274 | ADL28113 | 19305 | 49809 | 80313, 110817, 141321, 171825, 202329 | 11457 | AHZ42787 | 25488 | 55992 | 86496, 117000, 147504, 178008, 208512 |
| 5275 | ADL28129 | 19306 | 49810 | 80314, 110818, 141322, 171826, 202330 | 11458 | AHZ42799 | 25489 | 55993 | 86497, 117001, 147505, 178009, 208513 |
| 5276 | ADL28140 | 19307 | 49811 | 80315, 110819, 141323, 171827, 202331 | 11459 | AHZ42811 | 25490 | 55994 | 86498, 117002, 147506, 178010, 208514 |
| 5277 | ADL28151 | 19308 | 49812 | 80316, 110820, 141324, 171828, 202332 | 11460 | AHZ42823 | 25491 | 55995 | 86499, 117003, 147507, 178011, 208515 |
| 5278 | ADL28162 | 19309 | 49813 | 80317, 110821, 141325, 171829, 202333 | 11461 | AHZ42834 | 25492 | 55996 | 86500, 117004, 147508, 178012, 208516 |
| 5279 | ADL28173 | 19310 | 49814 | 80318, 110822, 141326, 171830, 202334 | 11462 | AHZ42846 | 25493 | 55997 | 86501, 117005, 147509, 178013, 208517 |
| 5280 | ADL28184 | 19311 | 49815 | 80319, 110823, 141327, 171831, 202335 | 11463 | AHZ42858 | 25494 | 55998 | 86502, 117006, 147510, 178014, 208518 |
| 5281 | ADL28195 | 19312 | 49816 | 80320, 110824, 141328, 171832, 202336 | 11464 | AHZ42870 | 25495 | 55999 | 86503, 117007, 147511, 178015, 208519 |
| 5282 | ADL28206 | 19313 | 49817 | 80321, 110825, 141329, 171833, 202337 | 11465 | AHZ42882 | 25496 | 56000 | 86504, 117008, 147512, 178016, 208520 |
| 5283 | ADL28217 | 19314 | 49818 | 80322, 110826, 141330, 171834, 202338 | 11466 | AHZ42894 | 25497 | 56001 | 86505, 117009, 147513, 178017, 208521 |
| 5284 | ADL28228 | 19315 | 49819 | 80323, 110827, 141331, 171835, 202339 | 11467 | AHZ42906 | 25498 | 56002 | 86506, 117010, 147514, 178018, 208522 |
| 5285 | ADL28239 | 19316 | 49820 | 80324, 110828, 141332, 171836, 202340 | 11468 | AHZ42918 | 25499 | 56003 | 86507, 117011, 147515, 178019, 208523 |

FIG. 3 continued

| | | | | | | | | | |
|---|---|---|---|---|---|---|---|---|---|
| 5286 | ADL28250 | 19317 | 49821 | 80325, 110829, 141333, 171837, 202341 | 11469 | AHZ59750 | 25500 | 56004 | 86508, 117012, 147516, 178020, 208524 |
| 5287 | ADL28261 | 19318 | 49822 | 80326, 110830, 141334, 171838, 202342 | 11470 | AHZ59762 | 25501 | 56005 | 86509, 117013, 147517, 178021, 208525 |
| 5288 | ADL28373 | 19319 | 49823 | 80327, 110831, 141335, 171839, 202343 | 11471 | AHZ59774 | 25502 | 56006 | 86510, 117014, 147518, 178022, 208526 |
| 5289 | ADL28387 | 19320 | 49824 | 80328, 110832, 141336, 171840, 202344 | 11472 | AHZ59786 | 25503 | 56007 | 86511, 117015, 147519, 178023, 208527 |
| 5290 | ADL28391 | 19321 | 49825 | 80329, 110833, 141337, 171841, 202345 | 11473 | AHZ59798 | 25504 | 56008 | 86512, 117016, 147520, 178024, 208528 |
| 5291 | ADL28395 | 19322 | 49826 | 80330, 110834, 141338, 171842, 202346 | 11474 | AHZ59810 | 25505 | 56009 | 86513, 117017, 147521, 178025, 208529 |
| 5292 | ADL29675 | 19323 | 49827 | 80331, 110835, 141339, 171843, 202347 | 11475 | AHZ59822 | 25506 | 56010 | 86514, 117018, 147522, 178026, 208530 |
| 5293 | ADL29685 | 19324 | 49828 | 80332, 110836, 141340, 171844, 202348 | 11476 | AHZ59834 | 25507 | 56011 | 86515, 117019, 147523, 178027, 208531 |
| 5294 | ADL29695 | 19325 | 49829 | 80333, 110837, 141341, 171845, 202349 | 11477 | AHZ59846 | 25508 | 56012 | 86516, 117020, 147524, 178028, 208532 |
| 5295 | ADL29705 | 19326 | 49830 | 80334, 110838, 141342, 171846, 202350 | 11478 | AHZ59858 | 25509 | 56013 | 86517, 117021, 147525, 178029, 208533 |
| 5296 | ADL29733 | 19327 | 49831 | 80335, 110839, 141343, 171847, 202351 | 11479 | AHZ59870 | 25510 | 56014 | 86518, 117022, 147526, 178030, 208534 |
| 5297 | ADL29743 | 19328 | 49832 | 80336, 110840, 141344, 171848, 202352 | 11480 | AHZ59882 | 25511 | 56015 | 86519, 117023, 147527, 178031, 208535 |
| 5298 | ADL29753 | 19329 | 49833 | 80337, 110841, 141345, 171849, 202353 | 11481 | AHZ59918 | 25512 | 56016 | 86520, 117024, 147528, 178032, 208536 |
| 5299 | ADL29763 | 19330 | 49834 | 80338, 110842, 141346, 171850, 202354 | 11482 | AHZ59930 | 25513 | 56017 | 86521, 117025, 147529, 178033, 208537 |
| 5300 | ADL29773 | 19331 | 49835 | 80339, 110843, 141347, 171851, 202355 | 11483 | AHZ59942 | 25514 | 56018 | 86522, 117026, 147530, 178034, 208538 |
| 5301 | ADL29783 | 19332 | 49836 | 80340, 110844, 141348, 171852, 202356 | 11484 | AHZ59954 | 25515 | 56019 | 86523, 117027, 147531, 178035, 208539 |
| 5302 | ADL29882 | 19333 | 49837 | 80341, 110845, 141349, 171853, 202357 | 11485 | AHZ59966 | 25516 | 56020 | 86524, 117028, 147532, 178036, 208540 |
| 5303 | ADL32020 | 19334 | 49838 | 80342, 110846, 141350, 171854, 202358 | 11486 | AHZ59991 | 25517 | 56021 | 86525, 117029, 147533, 178037, 208541 |

FIG. 3 continued

| | | | | | | | | | |
|---|---|---|---|---|---|---|---|---|---|
| 5304 | ADL32030 | 19335 | 49839 | 80343, 110847, 141351, 171855, 202359 | 11487 | AHZ60003 | 25518 | 56022 | 86526, 117030, 147534, 178038, 208542 |
| 5305 | ADL32040 | 19336 | 49840 | 80344, 110848, 141352, 171856, 202360 | 11488 | AHZ60015 | 25519 | 56023 | 86527, 117031, 147535, 178039, 208543 |
| 5306 | ADL32050 | 19337 | 49841 | 80345, 110849, 141353, 171857, 202361 | 11489 | AHZ60027 | 25520 | 56024 | 86528, 117032, 147536, 178040, 208544 |
| 5307 | ADL32060 | 19338 | 49842 | 80346, 110850, 141354, 171858, 202362 | 11490 | AHZ60039 | 25521 | 56025 | 86529, 117033, 147537, 178041, 208545 |
| 5308 | ADL32093 | 19339 | 49843 | 80347, 110851, 141355, 171859, 202363 | 11491 | AHZ60051 | 25522 | 56026 | 86530, 117034, 147538, 178042, 208546 |
| 5309 | ADL32117 | 19340 | 49844 | 80348, 110852, 141356, 171860, 202364 | 11492 | AHZ60063 | 25523 | 56027 | 86531, 117035, 147539, 178043, 208547 |
| 5310 | ADL32347 | 19341 | 49845 | 80349, 110853, 141357, 171861, 202365 | 11493 | AHZ60075 | 25524 | 56028 | 86532, 117036, 147540, 178044, 208548 |
| 5311 | ADL32357 | 19342 | 49846 | 80350, 110854, 141358, 171862, 202366 | 11494 | AHZ60087 | 25525 | 56029 | 86533, 117037, 147541, 178045, 208549 |
| 5312 | ADL32367 | 19343 | 49847 | 80351, 110855, 141359, 171863, 202367 | 11495 | AHZ60099 | 25526 | 56030 | 86534, 117038, 147542, 178046, 208550 |
| 5313 | ADL32377 | 19344 | 49848 | 80352, 110856, 141360, 171864, 202368 | 11496 | AHZ60111 | 25527 | 56031 | 86535, 117039, 147543, 178047, 208551 |
| 5314 | ADL32387 | 19345 | 49849 | 80353, 110857, 141361, 171865, 202369 | 11497 | AIA26299 | 25528 | 56032 | 86536, 117040, 147544, 178048, 208552 |
| 5315 | ADL32397 | 19346 | 49850 | 80354, 110858, 141362, 171866, 202370 | 11498 | AIC64891 | 25529 | 56033 | 86537, 117041, 147545, 178049, 208553 |
| 5316 | ADL32407 | 19347 | 49851 | 80355, 110859, 141363, 171867, 202371 | 11499 | AID48084 | 25530 | 56034 | 86538, 117042, 147546, 178050, 208554 |
| 5317 | ADL32417 | 19348 | 49852 | 80356, 110860, 141364, 171868, 202372 | 11500 | AID70507 | 25531 | 56035 | 86539, 117043, 147547, 178051, 208555 |
| 5318 | ADL32427 | 19349 | 49853 | 80357, 110861, 141365, 171869, 202373 | 11501 | AID70508 | 25532 | 56036 | 86540, 117044, 147548, 178052, 208556 |
| 5319 | ADL32447 | 19350 | 49854 | 80358, 110862, 141366, 171870, 202374 | 11502 | AID70509 | 25533 | 56037 | 86541, 117045, 147549, 178053, 208557 |
| 5320 | ADL32457 | 19351 | 49855 | 80359, 110863, 141367, 171871, 202375 | 11503 | AID70510 | 25534 | 56038 | 86542, 117046, 147550, 178054, 208558 |
| 5321 | ADL32487 | 19352 | 49856 | 80360, 110864, 141368, 171872, 202376 | 11504 | AID70511 | 25535 | 56039 | 86543, 117047, 147551, 178055, 208559 |

FIG. 3 continued

| | | | | | | | | | |
|---|---|---|---|---|---|---|---|---|---|
| 5322 | ADL32497 | 19353 | 49857 | 80361, 110865, 141369, 171873, 202377 | 11505 | AID70512 | 25536 | 56040 | 86544, 117048, 147552, 178056, 208560 |
| 5323 | ADL32507 | 19354 | 49858 | 80362, 110866, 141370, 171874, 202378 | 11506 | AID70514 | 25537 | 56041 | 86545, 117049, 147553, 178057, 208561 |
| 5324 | ADL32517 | 19355 | 49859 | 80363, 110867, 141371, 171875, 202379 | 11507 | AID70515 | 25538 | 56042 | 86546, 117050, 147554, 178058, 208562 |
| 5325 | ADL32527 | 19356 | 49860 | 80364, 110868, 141372, 171876, 202380 | 11508 | AID70516 | 25539 | 56043 | 86547, 117051, 147555, 178059, 208563 |
| 5326 | ADL32537 | 19357 | 49861 | 80365, 110869, 141373, 171877, 202381 | 11509 | AID70517 | 25540 | 56044 | 86548, 117052, 147556, 178060, 208564 |
| 5327 | ADL32547 | 19358 | 49862 | 80366, 110870, 141374, 171878, 202382 | 11510 | AID70518 | 25541 | 56045 | 86549, 117053, 147557, 178061, 208565 |
| 5328 | ADL32673 | 19359 | 49863 | 80367, 110871, 141375, 171879, 202383 | 11511 | AID70519 | 25542 | 56046 | 86550, 117054, 147558, 178062, 208566 |
| 5329 | ADL32683 | 19360 | 49864 | 80368, 110872, 141376, 171880, 202384 | 11512 | AID70520 | 25543 | 56047 | 86551, 117055, 147559, 178063, 208567 |
| 5330 | ADL32693 | 19361 | 49865 | 80369, 110873, 141377, 171881, 202385 | 11513 | AID70521 | 25544 | 56048 | 86552, 117056, 147560, 178064, 208568 |
| 5331 | ADL32703 | 19362 | 49866 | 80370, 110874, 141378, 171882, 202386 | 11514 | AID70522 | 25545 | 56049 | 86553, 117057, 147561, 178065, 208569 |
| 5332 | ADL32713 | 19363 | 49867 | 80371, 110875, 141379, 171883, 202387 | 11515 | AID70523 | 25546 | 56050 | 86554, 117058, 147562, 178066, 208570 |
| 5333 | ADL32723 | 19364 | 49868 | 80372, 110876, 141380, 171884, 202388 | 11516 | AID70524 | 25547 | 56051 | 86555, 117059, 147563, 178067, 208571 |
| 5334 | ADL32733 | 19365 | 49869 | 80373, 110877, 141381, 171885, 202389 | 11517 | AID70525 | 25548 | 56052 | 86556, 117060, 147564, 178068, 208572 |
| 5335 | ADL32743 | 19366 | 49870 | 80374, 110878, 141382, 171886, 202390 | 11518 | AID70526 | 25549 | 56053 | 86557, 117061, 147565, 178069, 208573 |
| 5336 | ADL39139 | 19367 | 49871 | 80375, 110879, 141383, 171887, 202391 | 11519 | AID70527 | 25550 | 56054 | 86558, 117062, 147566, 178070, 208574 |
| 5337 | ADL39150 | 19368 | 49872 | 80376, 110880, 141384, 171888, 202392 | 11520 | AID70528 | 25551 | 56055 | 86559, 117063, 147567, 178071, 208575 |
| 5338 | ADL39172 | 19369 | 49873 | 80377, 110881, 141385, 171889, 202393 | 11521 | AID70529 | 25552 | 56056 | 86560, 117064, 147568, 178072, 208576 |
| 5339 | ADL39183 | 19370 | 49874 | 80378, 110882, 141386, 171890, 202394 | 11522 | AID70530 | 25553 | 56057 | 86561, 117065, 147569, 178073, 208577 |

FIG. 3 continued

| | | | | | | | | | |
|---|---|---|---|---|---|---|---|---|---|
| 5340 | ADL39194 | 19371 | 49875 | 80379, 110883, 141387, 171891, 202395 | 11523 | AID70531 | 25554 | 56058 | 86562, 117066, 147570, 178074, 208578 |
| 5341 | ADL39205 | 19372 | 49876 | 80380, 110884, 141388, 171892, 202396 | 11524 | AID70532 | 25555 | 56059 | 86563, 117067, 147571, 178075, 208579 |
| 5342 | ADL39227 | 19373 | 49877 | 80381, 110885, 141389, 171893, 202397 | 11525 | AID70533 | 25556 | 56060 | 86564, 117068, 147572, 178076, 208580 |
| 5343 | ADL39238 | 19374 | 49878 | 80382, 110886, 141390, 171894, 202398 | 11526 | AID70534 | 25557 | 56061 | 86565, 117069, 147573, 178077, 208581 |
| 5344 | ADL39249 | 19375 | 49879 | 80383, 110887, 141391, 171895, 202399 | 11527 | AID70535 | 25558 | 56062 | 86566, 117070, 147574, 178078, 208582 |
| 5345 | ADL39260 | 19376 | 49880 | 80384, 110888, 141392, 171896, 202400 | 11528 | AID70536 | 25559 | 56063 | 86567, 117071, 147575, 178079, 208583 |
| 5346 | ADL39282 | 19377 | 49881 | 80385, 110889, 141393, 171897, 202401 | 11529 | AID70537 | 25560 | 56064 | 86568, 117072, 147576, 178080, 208584 |
| 5347 | ADL39293 | 19378 | 49882 | 80386, 110890, 141394, 171898, 202402 | 11530 | AID70538 | 25561 | 56065 | 86569, 117073, 147577, 178081, 208585 |
| 5348 | ADL39304 | 19379 | 49883 | 80387, 110891, 141395, 171899, 202403 | 11531 | AID70539 | 25562 | 56066 | 86570, 117074, 147578, 178082, 208586 |
| 5349 | ADL39326 | 19380 | 49884 | 80388, 110892, 141396, 171900, 202404 | 11532 | AID70540 | 25563 | 56067 | 86571, 117075, 147579, 178083, 208587 |
| 5350 | ADL39392 | 19381 | 49885 | 80389, 110893, 141397, 171901, 202405 | 11533 | AID70541 | 25564 | 56068 | 86572, 117076, 147580, 178084, 208588 |
| 5351 | ADL39403 | 19382 | 49886 | 80390, 110894, 141398, 171902, 202406 | 11534 | AID70633 | 25565 | 56069 | 86573, 117077, 147581, 178085, 208589 |
| 5352 | ADL39425 | 19383 | 49887 | 80391, 110895, 141399, 171903, 202407 | 11535 | AID70635 | 25566 | 56070 | 86574, 117078, 147582, 178086, 208590 |
| 5353 | ADL39447 | 19384 | 49888 | 80392, 110896, 141400, 171904, 202408 | 11536 | AIG44695 | 25567 | 56071 | 86575, 117079, 147583, 178087, 208591 |
| 5354 | ADL39458 | 19385 | 49889 | 80393, 110897, 141401, 171905, 202409 | 11537 | AIJ10793 | 25568 | 56072 | 86576, 117080, 147584, 178088, 208592 |
| 5355 | ADL39469 | 19386 | 49890 | 80394, 110898, 141402, 171906, 202410 | 11538 | AIJ10794 | 25569 | 56073 | 86577, 117081, 147585, 178089, 208593 |
| 5356 | ADL39480 | 19387 | 49891 | 80395, 110899, 141403, 171907, 202411 | 11539 | AIJ10795 | 25570 | 56074 | 86578, 117082, 147586, 178090, 208594 |
| 5357 | ADL39491 | 19388 | 49892 | 80396, 110900, 141404, 171908, 202412 | 11540 | AIJ10796 | 25571 | 56075 | 86579, 117083, 147587, 178091, 208595 |

FIG. 3 continued

| | | | | | | | | | |
|---|---|---|---|---|---|---|---|---|---|
| 5358 | ADL41165 | 19389 | 49893 | 80397, 110901, 141405, 171909, 202413 | 11541 | AIJ10797 | 25572 | 56076 | 86580, 117084, 147588, 178092, 208596 |
| 5359 | ADL41175 | 19390 | 49894 | 80398, 110902, 141406, 171910, 202414 | 11542 | AIJ10798 | 25573 | 56077 | 86581, 117085, 147589, 178093, 208597 |
| 5360 | ADL60255 | 19391 | 49895 | 80399, 110903, 141407, 171911, 202415 | 11543 | AIJ10799 | 25574 | 56078 | 86582, 117086, 147590, 178094, 208598 |
| 5361 | ADL60277 | 19392 | 49896 | 80400, 110904, 141408, 171912, 202416 | 11544 | AIJ10800 | 25575 | 56079 | 86583, 117087, 147591, 178095, 208599 |
| 5362 | ADL60288 | 19393 | 49897 | 80401, 110905, 141409, 171913, 202417 | 11545 | AIJ10801 | 25576 | 56080 | 86584, 117088, 147592, 178096, 208600 |
| 5363 | ADL60299 | 19394 | 49898 | 80402, 110906, 141410, 171914, 202418 | 11546 | AIJ10803 | 25577 | 56081 | 86585, 117089, 147593, 178097, 208601 |
| 5364 | ADL60310 | 19395 | 49899 | 80403, 110907, 141411, 171915, 202419 | 11547 | AIJ10804 | 25578 | 56082 | 86586, 117090, 147594, 178098, 208602 |
| 5365 | ADL60321 | 19396 | 49900 | 80404, 110908, 141412, 171916, 202420 | 11548 | AIJ10805 | 25579 | 56083 | 86587, 117091, 147595, 178099, 208603 |
| 5366 | ADL60332 | 19397 | 49901 | 80405, 110909, 141413, 171917, 202421 | 11549 | AIJ10806 | 25580 | 56084 | 86588, 117092, 147596, 178100, 208604 |
| 5367 | ADL60343 | 19398 | 49902 | 80406, 110910, 141414, 171918, 202422 | 11550 | AIJ10807 | 25581 | 56085 | 86589, 117093, 147597, 178101, 208605 |
| 5368 | ADL60354 | 19399 | 49903 | 80407, 110911, 141415, 171919, 202423 | 11551 | AIJ10808 | 25582 | 56086 | 86590, 117094, 147598, 178102, 208606 |
| 5369 | ADL60365 | 19400 | 49904 | 80408, 110912, 141416, 171920, 202424 | 11552 | AIJ10809 | 25583 | 56087 | 86591, 117095, 147599, 178103, 208607 |
| 5370 | ADL60376 | 19401 | 49905 | 80409, 110913, 141417, 171921, 202425 | 11553 | AIJ10810 | 25584 | 56088 | 86592, 117096, 147600, 178104, 208608 |
| 5371 | ADM07137 | 19402 | 49906 | 80410, 110914, 141418, 171922, 202426 | 11554 | AIJ10812 | 25585 | 56089 | 86593, 117097, 147601, 178105, 208609 |
| 5372 | ADM07146 | 19403 | 49907 | 80411, 110915, 141419, 171923, 202427 | 11555 | AIJ10813 | 25586 | 56090 | 86594, 117098, 147602, 178106, 208610 |
| 5373 | ADM07156 | 19404 | 49908 | 80412, 110916, 141420, 171924, 202428 | 11556 | AIJ10814 | 25587 | 56091 | 86595, 117099, 147603, 178107, 208611 |
| 5374 | ADM07165 | 19405 | 49909 | 80413, 110917, 141421, 171925, 202429 | 11557 | AIJ10815 | 25588 | 56092 | 86596, 117100, 147604, 178108, 208612 |
| 5375 | ADM07474 | 19406 | 49910 | 80414, 110918, 141422, 171926, 202430 | 11558 | AIJ10816 | 25589 | 56093 | 86597, 117101, 147605, 178109, 208613 |

FIG. 3 continued

| | | | | | | | | | |
|---|---|---|---|---|---|---|---|---|---|
| 5376 | ADM07485 | 19407 | 49911 | 80415, 110919, 141423, 171927, 202431 | 11559 | AIJ10817 | 25590 | 56094 | 86598, 117102, 147606, 178110, 208614 |
| 5377 | ADM07496 | 19408 | 49912 | 80416, 110920, 141424, 171928, 202432 | 11560 | AIJ10818 | 25591 | 56095 | 86599, 117103, 147607, 178111, 208615 |
| 5378 | ADM07507 | 19409 | 49913 | 80417, 110921, 141425, 171929, 202433 | 11561 | AIJ10819 | 25592 | 56096 | 86600, 117104, 147608, 178112, 208616 |
| 5379 | ADM12820 | 19410 | 49914 | 80418, 110922, 141426, 171930, 202434 | 11562 | AIJ10820 | 25593 | 56097 | 86601, 117105, 147609, 178113, 208617 |
| 5380 | ADM12831 | 19411 | 49915 | 80419, 110923, 141427, 171931, 202435 | 11563 | AIJ10821 | 25594 | 56098 | 86602, 117106, 147610, 178114, 208618 |
| 5381 | ADM12842 | 19412 | 49916 | 80420, 110924, 141428, 171932, 202436 | 11564 | AIJ10822 | 25595 | 56099 | 86603, 117107, 147611, 178115, 208619 |
| 5382 | ADM12853 | 19413 | 49917 | 80421, 110925, 141429, 171933, 202437 | 11565 | AIJ10823 | 25596 | 56100 | 86604, 117108, 147612, 178116, 208620 |
| 5383 | ADM12864 | 19414 | 49918 | 80422, 110926, 141430, 171934, 202438 | 11566 | AIJ10824 | 25597 | 56101 | 86605, 117109, 147613, 178117, 208621 |
| 5384 | ADM12874 | 19415 | 49919 | 80423, 110927, 141431, 171935, 202439 | 11567 | AIJ10827 | 25598 | 56102 | 86606, 117110, 147614, 178118, 208622 |
| 5385 | ADM12884 | 19416 | 49920 | 80424, 110928, 141432, 171936, 202440 | 11568 | AIJ10828 | 25599 | 56103 | 86607, 117111, 147615, 178119, 208623 |
| 5386 | ADM12894 | 19417 | 49921 | 80425, 110929, 141433, 171937, 202441 | 11569 | AIJ10829 | 25600 | 56104 | 86608, 117112, 147616, 178120, 208624 |
| 5387 | ADM12904 | 19418 | 49922 | 80426, 110930, 141434, 171938, 202442 | 11570 | AIJ10830 | 25601 | 56105 | 86609, 117113, 147617, 178121, 208625 |
| 5388 | ADM12914 | 19419 | 49923 | 80427, 110931, 141435, 171939, 202443 | 11571 | AIJ10831 | 25602 | 56106 | 86610, 117114, 147618, 178122, 208626 |
| 5389 | ADM12924 | 19420 | 49924 | 80428, 110932, 141436, 171940, 202444 | 11572 | AIJ10832 | 25603 | 56107 | 86611, 117115, 147619, 178123, 208627 |
| 5390 | ADM12934 | 19421 | 49925 | 80429, 110933, 141437, 171941, 202445 | 11573 | AIJ10834 | 25604 | 56108 | 86612, 117116, 147620, 178124, 208628 |
| 5391 | ADM12944 | 19422 | 49926 | 80430, 110934, 141438, 171942, 202446 | 11574 | AIJ10835 | 25605 | 56109 | 86613, 117117, 147621, 178125, 208629 |
| 5392 | ADM12954 | 19423 | 49927 | 80431, 110935, 141439, 171943, 202447 | 11575 | AIJ10836 | 25606 | 56110 | 86614, 117118, 147622, 178126, 208630 |
| 5393 | ADM12964 | 19424 | 49928 | 80432, 110936, 141440, 171944, 202448 | 11576 | AIJ10837 | 25607 | 56111 | 86615, 117119, 147623, 178127, 208631 |

FIG. 3 continued

| | | | | | | | | | |
|---|---|---|---|---|---|---|---|---|---|
| 5394 | ADMI2974 | 19425 | 49929 | 80433, 110937, 141441, 171945, 202449 | 11577 | AIJI0838 | 25608 | 56112 | 86616, 117120, 147624, 178128, 208632 |
| 5395 | ADMI2984 | 19426 | 49930 | 80434, 110938, 141442, 171946, 202450 | 11578 | AIJI0841 | 25609 | 56113 | 86617, 117121, 147625, 178129, 208633 |
| 5396 | ADMI2994 | 19427 | 49931 | 80435, 110939, 141443, 171947, 202451 | 11579 | AIJI0842 | 25610 | 56114 | 86618, 117122, 147626, 178130, 208634 |
| 5397 | ADMI3004 | 19428 | 49932 | 80436, 110940, 141444, 171948, 202452 | 11580 | AIJI0843 | 25611 | 56115 | 86619, 117123, 147627, 178131, 208635 |
| 5398 | ADMI3014 | 19429 | 49933 | 80437, 110941, 141445, 171949, 202453 | 11581 | AIJI0844 | 25612 | 56116 | 86620, 117124, 147628, 178132, 208636 |
| 5399 | ADMI3034 | 19430 | 49934 | 80438, 110942, 141446, 171950, 202454 | 11582 | AIJI0845 | 25613 | 56117 | 86621, 117125, 147629, 178133, 208637 |
| 5400 | ADMI3044 | 19431 | 49935 | 80439, 110943, 141447, 171951, 202455 | 11583 | AIJI0847 | 25614 | 56118 | 86622, 117126, 147630, 178134, 208638 |
| 5401 | ADMI3054 | 19432 | 49936 | 80440, 110944, 141448, 171952, 202456 | 11584 | AIJI0848 | 25615 | 56119 | 86623, 117127, 147631, 178135, 208639 |
| 5402 | ADMI3064 | 19433 | 49937 | 80441, 110945, 141449, 171953, 202457 | 11585 | AIJI0849 | 25616 | 56120 | 86624, 117128, 147632, 178136, 208640 |
| 5403 | ADMI3074 | 19434 | 49938 | 80442, 110946, 141450, 171954, 202458 | 11586 | AIJI0851 | 25617 | 56121 | 86625, 117129, 147633, 178137, 208641 |
| 5404 | ADMI3084 | 19435 | 49939 | 80443, 110947, 141451, 171955, 202459 | 11587 | AIJI0852 | 25618 | 56122 | 86626, 117130, 147634, 178138, 208642 |
| 5405 | ADMI3094 | 19436 | 49940 | 80444, 110948, 141452, 171956, 202460 | 11588 | AIJI0853 | 25619 | 56123 | 86627, 117131, 147635, 178139, 208643 |
| 5406 | ADMI3104 | 19437 | 49941 | 80445, 110949, 141453, 171957, 202461 | 11589 | AIJI0854 | 25620 | 56124 | 86628, 117132, 147636, 178140, 208644 |
| 5407 | ADMI3124 | 19438 | 49942 | 80446, 110950, 141454, 171958, 202462 | 11590 | AIJI0855 | 25621 | 56125 | 86629, 117133, 147637, 178141, 208645 |
| 5408 | ADMI3134 | 19439 | 49943 | 80447, 110951, 141455, 171959, 202463 | 11591 | AIJI0856 | 25622 | 56126 | 86630, 117134, 147638, 178142, 208646 |
| 5409 | ADMI3154 | 19440 | 49944 | 80448, 110952, 141456, 171960, 202464 | 11592 | AIJI0857 | 25623 | 56127 | 86631, 117135, 147639, 178143, 208647 |
| 5410 | ADMI3164 | 19441 | 49945 | 80449, 110953, 141457, 171961, 202465 | 11593 | AIJ29348 | 25624 | 56128 | 86632, 117136, 147640, 178144, 208648 |
| 5411 | ADMI3174 | 19442 | 49946 | 80450, 110954, 141458, 171962, 202466 | 11594 | AIJ29350 | 25625 | 56129 | 86633, 117137, 147641, 178145, 208649 |

FIG. 3 continued

| | | | | | | | | | |
|---|---|---|---|---|---|---|---|---|---|
| 5412 | ADMI3184 | 19443 | 49947 | 80451, 110955, 141459, 171963, 202467 | 11595 | AIJ29352 | 25626 | 56130 | 86634, 117138, 147642, 178146, 208650 |
| 5413 | ADMI3194 | 19444 | 49948 | 80452, 110956, 141460, 171964, 202468 | 11596 | AIJ29354 | 25627 | 56131 | 86635, 117139, 147643, 178147, 208651 |
| 5414 | ADMI3204 | 19445 | 49949 | 80453, 110957, 141461, 171965, 202469 | 11597 | AIJ29356 | 25628 | 56132 | 86636, 117140, 147644, 178148, 208652 |
| 5415 | ADMI3214 | 19446 | 49950 | 80454, 110958, 141462, 171966, 202470 | 11598 | AIJ29358 | 25629 | 56133 | 86637, 117141, 147645, 178149, 208653 |
| 5416 | ADMI3224 | 19447 | 49951 | 80455, 110959, 141463, 171967, 202471 | 11599 | AIJ29360 | 25630 | 56134 | 86638, 117142, 147646, 178150, 208654 |
| 5417 | ADMI3234 | 19448 | 49952 | 80456, 110960, 141464, 171968, 202472 | 11600 | AIJ29362 | 25631 | 56135 | 86639, 117143, 147647, 178151, 208655 |
| 5418 | ADMI3244 | 19449 | 49953 | 80457, 110961, 141465, 171969, 202473 | 11601 | AIL93626 | 25632 | 56136 | 86640, 117144, 147648, 178152, 208656 |
| 5419 | ADMI3254 | 19450 | 49954 | 80458, 110962, 141466, 171970, 202474 | 11602 | AIL93648 | 25633 | 56137 | 86641, 117145, 147649, 178153, 208657 |
| 5420 | ADMI3264 | 19451 | 49955 | 80459, 110963, 141467, 171971, 202475 | 11603 | AIL93660 | 25634 | 56138 | 86642, 117146, 147650, 178154, 208658 |
| 5421 | ADMI3274 | 19452 | 49956 | 80460, 110964, 141468, 171972, 202476 | 11604 | AIL93672 | 25635 | 56139 | 86643, 117147, 147651, 178155, 208659 |
| 5422 | ADMI3284 | 19453 | 49957 | 80461, 110965, 141469, 171973, 202477 | 11605 | AIL93684 | 25636 | 56140 | 86644, 117148, 147652, 178156, 208660 |
| 5423 | ADMI3294 | 19454 | 49958 | 80462, 110966, 141470, 171974, 202478 | 11606 | AIL93719 | 25637 | 56141 | 86645, 117149, 147653, 178157, 208661 |
| 5424 | ADMI3304 | 19455 | 49959 | 80463, 110967, 141471, 171975, 202479 | 11607 | AIL93743 | 25638 | 56142 | 86646, 117150, 147654, 178158, 208662 |
| 5425 | ADMI3314 | 19456 | 49960 | 80464, 110968, 141472, 171976, 202480 | 11608 | AIL93755 | 25639 | 56143 | 86647, 117151, 147655, 178159, 208663 |
| 5426 | ADMI3324 | 19457 | 49961 | 80465, 110969, 141473, 171977, 202481 | 11609 | AIL93767 | 25640 | 56144 | 86648, 117152, 147656, 178160, 208664 |
| 5427 | ADMI3344 | 19458 | 49962 | 80466, 110970, 141474, 171978, 202482 | 11610 | AIL93779 | 25641 | 56145 | 86649, 117153, 147657, 178161, 208665 |
| 5428 | ADMI3354 | 19459 | 49963 | 80467, 110971, 141475, 171979, 202483 | 11611 | AIL93791 | 25642 | 56146 | 86650, 117154, 147658, 178162, 208666 |
| 5429 | ADMI3363 | 19460 | 49964 | 80468, 110972, 141476, 171980, 202484 | 11612 | AIL93803 | 25643 | 56147 | 86651, 117155, 147659, 178163, 208667 |

FIG. 3 continued

| | | | | | | | | | |
|---|---|---|---|---|---|---|---|---|---|
| 5430 | ADMI3464 | 19461 | 49965 | 80469, 110973, 141477, 171981, 202485 | 11613 | AIL93815 | 25644 | 56148 | 86652, 117156, 147660, 178164, 208668 |
| 5431 | ADMI3465 | 19462 | 49966 | 80470, 110974, 141478, 171982, 202486 | 11614 | AIL93827 | 25645 | 56149 | 86653, 117157, 147661, 178165, 208669 |
| 5432 | ADMI3466 | 19463 | 49967 | 80471, 110975, 141479, 171983, 202487 | 11615 | AIL93839 | 25646 | 56150 | 86654, 117158, 147662, 178166, 208670 |
| 5433 | ADMI3467 | 19464 | 49968 | 80472, 110976, 141480, 171984, 202488 | 11616 | AIL93850 | 25647 | 56151 | 86655, 117159, 147663, 178167, 208671 |
| 5434 | ADMI3468 | 19465 | 49969 | 80473, 110977, 141481, 171985, 202489 | 11617 | AIL93861 | 25648 | 56152 | 86656, 117160, 147664, 178168, 208672 |
| 5435 | ADMI3469 | 19466 | 49970 | 80474, 110978, 141482, 171986, 202490 | 11618 | AIL93885 | 25649 | 56153 | 86657, 117161, 147665, 178169, 208673 |
| 5436 | ADMI3470 | 19467 | 49971 | 80475, 110979, 141483, 171987, 202491 | 11619 | AIL93897 | 25650 | 56154 | 86658, 117162, 147666, 178170, 208674 |
| 5437 | ADMI3471 | 19468 | 49972 | 80476, 110980, 141484, 171988, 202492 | 11620 | AIL93909 | 25651 | 56155 | 86659, 117163, 147667, 178171, 208675 |
| 5438 | ADMI3472 | 19469 | 49973 | 80477, 110981, 141485, 171989, 202493 | 11621 | AIL93920 | 25652 | 56156 | 86660, 117164, 147668, 178172, 208676 |
| 5439 | ADMI3473 | 19470 | 49974 | 80478, 110982, 141486, 171990, 202494 | 11622 | AIL93943 | 25653 | 56157 | 86661, 117165, 147669, 178173, 208677 |
| 5440 | ADMI3474 | 19471 | 49975 | 80479, 110983, 141487, 171991, 202495 | 11623 | AIL93954 | 25654 | 56158 | 86662, 117166, 147670, 178174, 208678 |
| 5441 | ADMI4469 | 19472 | 49976 | 80480, 110984, 141488, 171992, 202496 | 11624 | AIL93966 | 25655 | 56159 | 86663, 117167, 147671, 178175, 208679 |
| 5442 | ADMI4479 | 19473 | 49977 | 80481, 110985, 141489, 171993, 202497 | 11625 | AIL93978 | 25656 | 56160 | 86664, 117168, 147672, 178176, 208680 |
| 5443 | ADMI4499 | 19474 | 49978 | 80482, 110986, 141490, 171994, 202498 | 11626 | AIL93990 | 25657 | 56161 | 86665, 117169, 147673, 178177, 208681 |
| 5444 | ADMI4518 | 19475 | 49979 | 80483, 110987, 141491, 171995, 202499 | 11627 | AIL94001 | 25658 | 56162 | 86666, 117170, 147674, 178178, 208682 |
| 5445 | ADMI4527 | 19476 | 49980 | 80484, 110988, 141492, 171996, 202500 | 11628 | AIL94013 | 25659 | 56163 | 86667, 117171, 147675, 178179, 208683 |
| 5446 | ADMI4537 | 19477 | 49981 | 80485, 110989, 141493, 171997, 202501 | 11629 | AIL94025 | 25660 | 56164 | 86668, 117172, 147676, 178180, 208684 |
| 5447 | ADMI4546 | 19478 | 49982 | 80486, 110990, 141494, 171998, 202502 | 11630 | AIL94037 | 25661 | 56165 | 86669, 117173, 147677, 178181, 208685 |

FIG. 3 continued

| | | | | | | | | | |
|---|---|---|---|---|---|---|---|---|---|
| 5448 | ADMI4555 | 19479 | 49983 | 80487, 110991, 141495, 171999, 202503 | 11631 | AIL94049 | 25662 | 56166 | 86670, 117174, 147678, 178182, 208686 |
| 5449 | ADMI4573 | 19480 | 49984 | 80488, 110992, 141496, 172000, 202504 | 11632 | AIL94061 | 25663 | 56167 | 86671, 117175, 147679, 178183, 208687 |
| 5450 | ADMI4582 | 19481 | 49985 | 80489, 110993, 141497, 172001, 202505 | 11633 | AIL94072 | 25664 | 56168 | 86672, 117176, 147680, 178184, 208688 |
| 5451 | ADMI4591 | 19482 | 49986 | 80490, 110994, 141498, 172002, 202506 | 11634 | AIL94083 | 25665 | 56169 | 86673, 117177, 147681, 178185, 208689 |
| 5452 | ADMI4601 | 19483 | 49987 | 80491, 110995, 141499, 172003, 202507 | 11635 | AIL94238 | 25666 | 56170 | 86674, 117178, 147682, 178186, 208690 |
| 5453 | ADMI4611 | 19484 | 49988 | 80492, 110996, 141500, 172004, 202508 | 11636 | AIL94250 | 25667 | 56171 | 86675, 117179, 147683, 178187, 208691 |
| 5454 | ADMI4620 | 19485 | 49989 | 80493, 110997, 141501, 172005, 202509 | 11637 | AIL94261 | 25668 | 56172 | 86676, 117180, 147684, 178188, 208692 |
| 5455 | ADMI4629 | 19486 | 49990 | 80494, 110998, 141502, 172006, 202510 | 11638 | AIL94273 | 25669 | 56173 | 86677, 117181, 147685, 178189, 208693 |
| 5456 | ADMI4639 | 19487 | 49991 | 80495, 110999, 141503, 172007, 202511 | 11639 | AIL94285 | 25670 | 56174 | 86678, 117182, 147686, 178190, 208694 |
| 5457 | ADMI4657 | 19488 | 49992 | 80496, 111000, 141504, 172008, 202512 | 11640 | AIL94297 | 25671 | 56175 | 86679, 117183, 147687, 178191, 208695 |
| 5458 | ADMI4666 | 19489 | 49993 | 80497, 111001, 141505, 172009, 202513 | 11641 | AIL94309 | 25672 | 56176 | 86680, 117184, 147688, 178192, 208696 |
| 5459 | ADMI4684 | 19490 | 49994 | 80498, 111002, 141506, 172010, 202514 | 11642 | AIL94321 | 25673 | 56177 | 86681, 117185, 147689, 178193, 208697 |
| 5460 | ADMI4693 | 19491 | 49995 | 80499, 111003, 141507, 172011, 202515 | 11643 | AIL94368 | 25674 | 56178 | 86682, 117186, 147690, 178194, 208698 |
| 5461 | ADMI4702 | 19492 | 49996 | 80500, 111004, 141508, 172012, 202516 | 11644 | AIL94380 | 25675 | 56179 | 86683, 117187, 147691, 178195, 208699 |
| 5462 | ADMI4711 | 19493 | 49997 | 80501, 111005, 141509, 172013, 202517 | 11645 | AIL94392 | 25676 | 56180 | 86684, 117188, 147692, 178196, 208700 |
| 5463 | ADMI4720 | 19494 | 49998 | 80502, 111006, 141510, 172014, 202518 | 11646 | AIL94403 | 25677 | 56181 | 86685, 117189, 147693, 178197, 208701 |
| 5464 | ADMI4730 | 19495 | 49999 | 80503, 111007, 141511, 172015, 202519 | 11647 | AIL94426 | 25678 | 56182 | 86686, 117190, 147694, 178198, 208702 |
| 5465 | ADMI4748 | 19496 | 50000 | 80504, 111008, 141512, 172016, 202520 | 11648 | AIL94438 | 25679 | 56183 | 86687, 117191, 147695, 178199, 208703 |

FIG. 3 continued

| | | | | | | | | | |
|---|---|---|---|---|---|---|---|---|---|
| 5466 | ADMI4758 | 19497 | 50001 | 80505, 111009, 141513, 172017, 202521 | 11649 | AIL94449 | 25680 | 56184 | 86688, 117192, 147696, 178200, 208704 |
| 5467 | ADMI4767 | 19498 | 50002 | 80506, 111010, 141514, 172018, 202522 | 11650 | AIL94461 | 25681 | 56185 | 86689, 117193, 147697, 178201, 208705 |
| 5468 | ADMI4777 | 19499 | 50003 | 80507, 111011, 141515, 172019, 202523 | 11651 | AIL94473 | 25682 | 56186 | 86690, 117194, 147698, 178202, 208706 |
| 5469 | ADMI4814 | 19500 | 50004 | 80508, 111012, 141516, 172020, 202524 | 11652 | AIL94484 | 25683 | 56187 | 86691, 117195, 147699, 178203, 208707 |
| 5470 | ADMI4823 | 19501 | 50005 | 80509, 111013, 141517, 172021, 202525 | 11653 | AIL94507 | 25684 | 56188 | 86692, 117196, 147700, 178204, 208708 |
| 5471 | ADMI4841 | 19502 | 50006 | 80510, 111014, 141518, 172022, 202526 | 11654 | AIL94518 | 25685 | 56189 | 86693, 117197, 147701, 178205, 208709 |
| 5472 | ADMI4859 | 19503 | 50007 | 80511, 111015, 141519, 172023, 202527 | 11655 | AIL94530 | 25686 | 56190 | 86694, 117198, 147702, 178206, 208710 |
| 5473 | ADMI4868 | 19504 | 50008 | 80512, 111016, 141520, 172024, 202528 | 11656 | AIL94542 | 25687 | 56191 | 86695, 117199, 147703, 178207, 208711 |
| 5474 | ADMI4878 | 19505 | 50009 | 80513, 111017, 141521, 172025, 202529 | 11657 | AIL94553 | 25688 | 56192 | 86696, 117200, 147704, 178208, 208712 |
| 5475 | ADMI4887 | 19506 | 50010 | 80514, 111018, 141522, 172026, 202530 | 11658 | AIL94564 | 25689 | 56193 | 86697, 117201, 147705, 178209, 208713 |
| 5476 | ADMI4896 | 19507 | 50011 | 80515, 111019, 141523, 172027, 202531 | 11659 | AIL94576 | 25690 | 56194 | 86698, 117202, 147706, 178210, 208714 |
| 5477 | ADMI4905 | 19508 | 50012 | 80516, 111020, 141524, 172028, 202532 | 11660 | AIL94587 | 25691 | 56195 | 86699, 117203, 147707, 178211, 208715 |
| 5478 | ADMI4923 | 19509 | 50013 | 80517, 111021, 141525, 172029, 202533 | 11661 | AIL94598 | 25692 | 56196 | 86700, 117204, 147708, 178212, 208716 |
| 5479 | ADMI4932 | 19510 | 50014 | 80518, 111022, 141526, 172030, 202534 | 11662 | AIL94609 | 25693 | 56197 | 86701, 117205, 147709, 178213, 208717 |
| 5480 | ADMI4950 | 19511 | 50015 | 80519, 111023, 141527, 172031, 202535 | 11663 | AIL94621 | 25694 | 56198 | 86702, 117206, 147710, 178214, 208718 |
| 5481 | ADMI4959 | 19512 | 50016 | 80520, 111024, 141528, 172032, 202536 | 11664 | AIL94632 | 25695 | 56199 | 86703, 117207, 147711, 178215, 208719 |
| 5482 | ADMI4977 | 19513 | 50017 | 80521, 111025, 141529, 172033, 202537 | 11665 | AIL94643 | 25696 | 56200 | 86704, 117208, 147712, 178216, 208720 |
| 5483 | ADMI4987 | 19514 | 50018 | 80522, 111026, 141530, 172034, 202538 | 11666 | AIL94655 | 25697 | 56201 | 86705, 117209, 147713, 178217, 208721 |

FIG. 3 continued

| | | | | | | | | | |
|---|---|---|---|---|---|---|---|---|---|
| 5484 | ADM26787 | 19515 | 50019 | 80523, 111027, 141531, 172035, 202539 | 11667 | AIL94677 | 25698 | 56202 | 86706, 117210, 147714, 178218, 208722 |
| 5485 | ADM26798 | 19516 | 50020 | 80524, 111028, 141532, 172036, 202540 | 11668 | AIL94688 | 25699 | 56203 | 86707, 117211, 147715, 178219, 208723 |
| 5486 | ADM26809 | 19517 | 50021 | 80525, 111029, 141533, 172037, 202541 | 11669 | AIL94700 | 25700 | 56204 | 86708, 117212, 147716, 178220, 208724 |
| 5487 | ADM26820 | 19518 | 50022 | 80526, 111030, 141534, 172038, 202542 | 11670 | AIL94712 | 25701 | 56205 | 86709, 117213, 147717, 178221, 208725 |
| 5488 | ADM31427 | 19519 | 50023 | 80527, 111031, 141535, 172039, 202543 | 11671 | AIL94723 | 25702 | 56206 | 86710, 117214, 147718, 178222, 208726 |
| 5489 | ADM31481 | 19520 | 50024 | 80528, 111032, 141536, 172040, 202544 | 11672 | AIL94734 | 25703 | 56207 | 86711, 117215, 147719, 178223, 208727 |
| 5490 | ADM31491 | 19521 | 50025 | 80529, 111033, 141537, 172041, 202545 | 11673 | AIL94746 | 25704 | 56208 | 86712, 117216, 147720, 178224, 208728 |
| 5491 | ADM31501 | 19522 | 50026 | 80530, 111034, 141538, 172042, 202546 | 11674 | AIL94757 | 25705 | 56209 | 86713, 117217, 147721, 178225, 208729 |
| 5492 | ADM31511 | 19523 | 50027 | 80531, 111035, 141539, 172043, 202547 | 11675 | AIL94768 | 25706 | 56210 | 86714, 117218, 147722, 178226, 208730 |
| 5493 | ADM31521 | 19524 | 50028 | 80532, 111036, 141540, 172044, 202548 | 11676 | AIL94780 | 25707 | 56211 | 86715, 117219, 147723, 178227, 208731 |
| 5494 | ADM31531 | 19525 | 50029 | 80533, 111037, 141541, 172045, 202549 | 11677 | AIL94803 | 25708 | 56212 | 86716, 117220, 147724, 178228, 208732 |
| 5495 | ADM31541 | 19526 | 50030 | 80534, 111038, 141542, 172046, 202550 | 11678 | AIL94814 | 25709 | 56213 | 86717, 117221, 147725, 178229, 208733 |
| 5496 | ADM31551 | 19527 | 50031 | 80535, 111039, 141543, 172047, 202551 | 11679 | AIL94826 | 25710 | 56214 | 86718, 117222, 147726, 178230, 208734 |
| 5497 | ADM31561 | 19528 | 50032 | 80536, 111040, 141544, 172048, 202552 | 11680 | AIL94850 | 25711 | 56215 | 86719, 117223, 147727, 178231, 208735 |
| 5498 | ADM31571 | 19529 | 50033 | 80537, 111041, 141545, 172049, 202553 | 11681 | AIL94862 | 25712 | 56216 | 86720, 117224, 147728, 178232, 208736 |
| 5499 | ADM31581 | 19530 | 50034 | 80538, 111042, 141546, 172050, 202554 | 11682 | AIL94874 | 25713 | 56217 | 86721, 117225, 147729, 178233, 208737 |
| 5500 | ADM31601 | 19531 | 50035 | 80539, 111043, 141547, 172051, 202555 | 11683 | AIL94886 | 25714 | 56218 | 86722, 117226, 147730, 178234, 208738 |
| 5501 | ADM31611 | 19532 | 50036 | 80540, 111044, 141548, 172052, 202556 | 11684 | AIL94897 | 25715 | 56219 | 86723, 117227, 147731, 178235, 208739 |

FIG. 3 continued

| | | | | | | | | | |
|---|---|---|---|---|---|---|---|---|---|
| 5502 | ADM31621 | 19533 | 50037 | 80541, 111045, 141549, 172053, 202557 | 11685 | AIL94909 | 25716 | 56220 | 86724, 117228, 147732, 178236, 208740 |
| 5503 | ADM31631 | 19534 | 50038 | 80542, 111046, 141550, 172054, 202558 | 11686 | AIL94921 | 25717 | 56221 | 86725, 117229, 147733, 178237, 208741 |
| 5504 | ADM31641 | 19535 | 50039 | 80543, 111047, 141551, 172055, 202559 | 11687 | AIL94933 | 25718 | 56222 | 86726, 117230, 147734, 178238, 208742 |
| 5505 | ADM31651 | 19536 | 50040 | 80544, 111048, 141552, 172056, 202560 | 11688 | AIL94945 | 25719 | 56223 | 86727, 117231, 147735, 178239, 208743 |
| 5506 | ADM31661 | 19537 | 50041 | 80545, 111049, 141553, 172057, 202561 | 11689 | AIL94957 | 25720 | 56224 | 86728, 117232, 147736, 178240, 208744 |
| 5507 | ADM31671 | 19538 | 50042 | 80546, 111050, 141554, 172058, 202562 | 11690 | AIL94968 | 25721 | 56225 | 86729, 117233, 147737, 178241, 208745 |
| 5508 | ADM31681 | 19539 | 50043 | 80547, 111051, 141555, 172059, 202563 | 11691 | AIM55840 | 25722 | 56226 | 86730, 117234, 147738, 178242, 208746 |
| 5509 | ADM31691 | 19540 | 50044 | 80548, 111052, 141556, 172060, 202564 | 11692 | AIM55851 | 25723 | 56227 | 86731, 117235, 147739, 178243, 208747 |
| 5510 | ADM31701 | 19541 | 50045 | 80549, 111053, 141557, 172061, 202565 | 11693 | AIM55862 | 25724 | 56228 | 86732, 117236, 147740, 178244, 208748 |
| 5511 | ADM31711 | 19542 | 50046 | 80550, 111054, 141558, 172062, 202566 | 11694 | AIM55873 | 25725 | 56229 | 86733, 117237, 147741, 178245, 208749 |
| 5512 | ADM31721 | 19543 | 50047 | 80551, 111055, 141559, 172063, 202567 | 11695 | AIM55884 | 25726 | 56230 | 86734, 117238, 147742, 178246, 208750 |
| 5513 | ADM31731 | 19544 | 50048 | 80552, 111056, 141560, 172064, 202568 | 11696 | AIM55918 | 25727 | 56231 | 86735, 117239, 147743, 178247, 208751 |
| 5514 | ADM31741 | 19545 | 50049 | 80553, 111057, 141561, 172065, 202569 | 11697 | AIM55929 | 25728 | 56232 | 86736, 117240, 147744, 178248, 208752 |
| 5515 | ADM31751 | 19546 | 50050 | 80554, 111058, 141562, 172066, 202570 | 11698 | AIM55940 | 25729 | 56233 | 86737, 117241, 147745, 178249, 208753 |
| 5516 | ADM31761 | 19547 | 50051 | 80555, 111059, 141563, 172067, 202571 | 11699 | AIM55965 | 25730 | 56234 | 86738, 117242, 147746, 178250, 208754 |
| 5517 | ADM31771 | 19548 | 50052 | 80556, 111060, 141564, 172068, 202572 | 11700 | AIM55976 | 25731 | 56235 | 86739, 117243, 147747, 178251, 208755 |
| 5518 | ADM31801 | 19549 | 50053 | 80557, 111061, 141565, 172069, 202573 | 11701 | AIM55987 | 25732 | 56236 | 86740, 117244, 147748, 178252, 208756 |
| 5519 | ADM31811 | 19550 | 50054 | 80558, 111062, 141566, 172070, 202574 | 11702 | AIM55998 | 25733 | 56237 | 86741, 117245, 147749, 178253, 208757 |

FIG. 3 continued

| | | | | | | | | | |
|---|---|---|---|---|---|---|---|---|---|
| 5520 | ADM31821 | 19551 | 50055 | 80559, 111063, 141567, 172071, 202575 | 11703 | AIM56009 | 25734 | 56238 | 86742, 117246, 147750, 178254, 208758 |
| 5521 | ADM31831 | 19552 | 50056 | 80560, 111064, 141568, 172072, 202576 | 11704 | AIM56020 | 25735 | 56239 | 86743, 117247, 147751, 178255, 208759 |
| 5522 | ADM31841 | 19553 | 50057 | 80561, 111065, 141569, 172073, 202577 | 11705 | AIM56031 | 25736 | 56240 | 86744, 117248, 147752, 178256, 208760 |
| 5523 | ADM31851 | 19554 | 50058 | 80562, 111066, 141570, 172074, 202578 | 11706 | AIM56042 | 25737 | 56241 | 86745, 117249, 147753, 178257, 208761 |
| 5524 | ADM31861 | 19555 | 50059 | 80563, 111067, 141571, 172075, 202579 | 11707 | AIM56053 | 25738 | 56242 | 86746, 117250, 147754, 178258, 208762 |
| 5525 | ADM31871 | 19556 | 50060 | 80564, 111068, 141572, 172076, 202580 | 11708 | AIM56064 | 25739 | 56243 | 86747, 117251, 147755, 178259, 208763 |
| 5526 | ADM31881 | 19557 | 50061 | 80565, 111069, 141573, 172077, 202581 | 11709 | AIM56086 | 25740 | 56244 | 86748, 117252, 147756, 178260, 208764 |
| 5527 | ADM31891 | 19558 | 50062 | 80566, 111070, 141574, 172078, 202582 | 11710 | AIM56097 | 25741 | 56245 | 86749, 117253, 147757, 178261, 208765 |
| 5528 | ADM31901 | 19559 | 50063 | 80567, 111071, 141575, 172079, 202583 | 11711 | AIM56108 | 25742 | 56246 | 86750, 117254, 147758, 178262, 208766 |
| 5529 | ADM31911 | 19560 | 50064 | 80568, 111072, 141576, 172080, 202584 | 11712 | AIM56119 | 25743 | 56247 | 86751, 117255, 147759, 178263, 208767 |
| 5530 | ADM31921 | 19561 | 50065 | 80569, 111073, 141577, 172081, 202585 | 11713 | AIM56130 | 25744 | 56248 | 86752, 117256, 147760, 178264, 208768 |
| 5531 | ADM31931 | 19562 | 50066 | 80570, 111074, 141578, 172082, 202586 | 11714 | AIM56141 | 25745 | 56249 | 86753, 117257, 147761, 178265, 208769 |
| 5532 | ADM31941 | 19563 | 50067 | 80571, 111075, 141579, 172083, 202587 | 11715 | AIM56152 | 25746 | 56250 | 86754, 117258, 147762, 178266, 208770 |
| 5533 | ADM31951 | 19564 | 50068 | 80572, 111076, 141580, 172084, 202588 | 11716 | AIM56163 | 25747 | 56251 | 86755, 117259, 147763, 178267, 208771 |
| 5534 | ADM31961 | 19565 | 50069 | 80573, 111077, 141581, 172085, 202589 | 11717 | AIM56174 | 25748 | 56252 | 86756, 117260, 147764, 178268, 208772 |
| 5535 | ADM31971 | 19566 | 50070 | 80574, 111078, 141582, 172086, 202590 | 11718 | AIM56185 | 25749 | 56253 | 86757, 117261, 147765, 178269, 208773 |
| 5536 | ADM31981 | 19567 | 50071 | 80575, 111079, 141583, 172087, 202591 | 11719 | AIM56196 | 25750 | 56254 | 86758, 117262, 147766, 178270, 208774 |
| 5537 | ADM31991 | 19568 | 50072 | 80576, 111080, 141584, 172088, 202592 | 11720 | AIM56207 | 25751 | 56255 | 86759, 117263, 147767, 178271, 208775 |

FIG. 3 continued

| | | | | | | | | | |
|---|---|---|---|---|---|---|---|---|---|
| 5538 | ADM32001 | 19569 | 50073 | 80577, 111081, 141585, 172089, 202593 | 11721 | AIM56229 | 25752 | 56256 | 86760, 117264, 147768, 178272, 208776 |
| 5539 | ADM32011 | 19570 | 50074 | 80578, 111082, 141586, 172090, 202594 | 11722 | AIM56240 | 25753 | 56257 | 86761, 117265, 147769, 178273, 208777 |
| 5540 | ADM32021 | 19571 | 50075 | 80579, 111083, 141587, 172091, 202595 | 11723 | AIM56251 | 25754 | 56258 | 86762, 117266, 147770, 178274, 208778 |
| 5541 | ADM32031 | 19572 | 50076 | 80580, 111084, 141588, 172092, 202596 | 11724 | AIM56262 | 25755 | 56259 | 86763, 117267, 147771, 178275, 208779 |
| 5542 | ADM32051 | 19573 | 50077 | 80581, 111085, 141589, 172093, 202597 | 11725 | AIM56273 | 25756 | 56260 | 86764, 117268, 147772, 178276, 208780 |
| 5543 | ADM32061 | 19574 | 50078 | 80582, 111086, 141590, 172094, 202598 | 11726 | AIM56284 | 25757 | 56261 | 86765, 117269, 147773, 178277, 208781 |
| 5544 | ADM32071 | 19575 | 50079 | 80583, 111087, 141591, 172095, 202599 | 11727 | AIM56295 | 25758 | 56262 | 86766, 117270, 147774, 178278, 208782 |
| 5545 | ADM32081 | 19576 | 50080 | 80584, 111088, 141592, 172096, 202600 | 11728 | AIM56306 | 25759 | 56263 | 86767, 117271, 147775, 178279, 208783 |
| 5546 | ADM32091 | 19577 | 50081 | 80585, 111089, 141593, 172097, 202601 | 11729 | AIM56317 | 25760 | 56264 | 86768, 117272, 147776, 178280, 208784 |
| 5547 | ADM32101 | 19578 | 50082 | 80586, 111090, 141594, 172098, 202602 | 11730 | AIM56339 | 25761 | 56265 | 86769, 117273, 147777, 178281, 208785 |
| 5548 | ADM32111 | 19579 | 50083 | 80587, 111091, 141595, 172099, 202603 | 11731 | AIM56350 | 25762 | 56266 | 86770, 117274, 147778, 178282, 208786 |
| 5549 | ADM32554 | 19580 | 50084 | 80588, 111092, 141596, 172100, 202604 | 11732 | AIM56361 | 25763 | 56267 | 86771, 117275, 147779, 178283, 208787 |
| 5550 | ADM32564 | 19581 | 50085 | 80589, 111093, 141597, 172101, 202605 | 11733 | AIM56372 | 25764 | 56268 | 86772, 117276, 147780, 178284, 208788 |
| 5551 | ADM32574 | 19582 | 50086 | 80590, 111094, 141598, 172102, 202606 | 11734 | AIM56383 | 25765 | 56269 | 86773, 117277, 147781, 178285, 208789 |
| 5552 | ADM32584 | 19583 | 50087 | 80591, 111095, 141599, 172103, 202607 | 11735 | AIM56394 | 25766 | 56270 | 86774, 117278, 147782, 178286, 208790 |
| 5553 | ADM32594 | 19584 | 50088 | 80592, 111096, 141600, 172104, 202608 | 11736 | AIM56405 | 25767 | 56271 | 86775, 117279, 147783, 178287, 208791 |
| 5554 | ADM32604 | 19585 | 50089 | 80593, 111097, 141601, 172105, 202609 | 11737 | AIM56416 | 25768 | 56272 | 86776, 117280, 147784, 178288, 208792 |
| 5555 | ADM32614 | 19586 | 50090 | 80594, 111098, 141602, 172106, 202610 | 11738 | AIM56428 | 25769 | 56273 | 86777, 117281, 147785, 178289, 208793 |

FIG. 3 continued

| | | | | | | | | | |
|---|---|---|---|---|---|---|---|---|---|
| 5556 | ADM32624 | 19587 | 50091 | 80595, 111099, 141603, 172107, 202611 | 11739 | AIM56439 | 25770 | 56274 | 86778, 117282, 147786, 178290, 208794 |
| 5557 | ADM32634 | 19588 | 50092 | 80596, 111100, 141604, 172108, 202612 | 11740 | AIM56450 | 25771 | 56275 | 86779, 117283, 147787, 178291, 208795 |
| 5558 | ADM32644 | 19589 | 50093 | 80597, 111101, 141605, 172109, 202613 | 11741 | AIM56461 | 25772 | 56276 | 86780, 117284, 147788, 178292, 208796 |
| 5559 | ADM32664 | 19590 | 50094 | 80598, 111102, 141606, 172110, 202614 | 11742 | AIM56472 | 25773 | 56277 | 86781, 117285, 147789, 178293, 208797 |
| 5560 | ADM32674 | 19591 | 50095 | 80599, 111103, 141607, 172111, 202615 | 11743 | AIM56483 | 25774 | 56278 | 86782, 117286, 147790, 178294, 208798 |
| 5561 | ADM32684 | 19592 | 50096 | 80600, 111104, 141608, 172112, 202616 | 11744 | AIM56494 | 25775 | 56279 | 86783, 117287, 147791, 178295, 208799 |
| 5562 | ADM32694 | 19593 | 50097 | 80601, 111105, 141609, 172113, 202617 | 11745 | AIM56505 | 25776 | 56280 | 86784, 117288, 147792, 178296, 208800 |
| 5563 | ADM32704 | 19594 | 50098 | 80602, 111106, 141610, 172114, 202618 | 11746 | AIM56516 | 25777 | 56281 | 86785, 117289, 147793, 178297, 208801 |
| 5564 | ADM32714 | 19595 | 50099 | 80603, 111107, 141611, 172115, 202619 | 11747 | AIM56527 | 25778 | 56282 | 86786, 117290, 147794, 178298, 208802 |
| 5565 | ADM32724 | 19596 | 50100 | 80604, 111108, 141612, 172116, 202620 | 11748 | AIM56538 | 25779 | 56283 | 86787, 117291, 147795, 178299, 208803 |
| 5566 | ADM32734 | 19597 | 50101 | 80605, 111109, 141613, 172117, 202621 | 11749 | AIM56549 | 25780 | 56284 | 86788, 117292, 147796, 178300, 208804 |
| 5567 | ADM32744 | 19598 | 50102 | 80606, 111110, 141614, 172118, 202622 | 11750 | AIM56560 | 25781 | 56285 | 86789, 117293, 147797, 178301, 208805 |
| 5568 | ADM32754 | 19599 | 50103 | 80607, 111111, 141615, 172119, 202623 | 11751 | AIM56571 | 25782 | 56286 | 86790, 117294, 147798, 178302, 208806 |
| 5569 | ADM32764 | 19600 | 50104 | 80608, 111112, 141616, 172120, 202624 | 11752 | AIM56582 | 25783 | 56287 | 86791, 117295, 147799, 178303, 208807 |
| 5570 | ADM32774 | 19601 | 50105 | 80609, 111113, 141617, 172121, 202625 | 11753 | AIM56593 | 25784 | 56288 | 86792, 117296, 147800, 178304, 208808 |
| 5571 | ADM32784 | 19602 | 50106 | 80610, 111114, 141618, 172122, 202626 | 11754 | AIM56604 | 25785 | 56289 | 86793, 117297, 147801, 178305, 208809 |
| 5572 | ADM32794 | 19603 | 50107 | 80611, 111115, 141619, 172123, 202627 | 11755 | AIM56615 | 25786 | 56290 | 86794, 117298, 147802, 178306, 208810 |
| 5573 | ADM32804 | 19604 | 50108 | 80612, 111116, 141620, 172124, 202628 | 11756 | AIM56626 | 25787 | 56291 | 86795, 117299, 147803, 178307, 208811 |

FIG. 3 continued

| | | | | | | | | | |
|---|---|---|---|---|---|---|---|---|---|
| 5574 | ADM32814 | 19605 | 50109 | 80613, 111117, 141621, 172125, 202629 | 11757 | AIM56637 | 25788 | 56292 | 86796, 117300, 147804, 178308, 208812 |
| 5575 | ADM32824 | 19606 | 50110 | 80614, 111118, 141622, 172126, 202630 | 11758 | AIM56648 | 25789 | 56293 | 86797, 117301, 147805, 178309, 208813 |
| 5576 | ADM32834 | 19607 | 50111 | 80615, 111119, 141623, 172127, 202631 | 11759 | AIM56659 | 25790 | 56294 | 86798, 117302, 147806, 178310, 208814 |
| 5577 | ADM32844 | 19608 | 50112 | 80616, 111120, 141624, 172128, 202632 | 11760 | AIM56670 | 25791 | 56295 | 86799, 117303, 147807, 178311, 208815 |
| 5578 | ADM32854 | 19609 | 50113 | 80617, 111121, 141625, 172129, 202633 | 11761 | AIM56703 | 25792 | 56296 | 86800, 117304, 147808, 178312, 208816 |
| 5579 | ADM32864 | 19610 | 50114 | 80618, 111122, 141626, 172130, 202634 | 11762 | AIM56714 | 25793 | 56297 | 86801, 117305, 147809, 178313, 208817 |
| 5580 | ADM32874 | 19611 | 50115 | 80619, 111123, 141627, 172131, 202635 | 11763 | AIM56725 | 25794 | 56298 | 86802, 117306, 147810, 178314, 208818 |
| 5581 | ADM32884 | 19612 | 50116 | 80620, 111124, 141628, 172132, 202636 | 11764 | AIM56736 | 25795 | 56299 | 86803, 117307, 147811, 178315, 208819 |
| 5582 | ADM32921 | 19613 | 50117 | 80621, 111125, 141629, 172133, 202637 | 11765 | AIM56747 | 25796 | 56300 | 86804, 117308, 147812, 178316, 208820 |
| 5583 | ADM32931 | 19614 | 50118 | 80622, 111126, 141630, 172134, 202638 | 11766 | AIM56758 | 25797 | 56301 | 86805, 117309, 147813, 178317, 208821 |
| 5584 | ADM32941 | 19615 | 50119 | 80623, 111127, 141631, 172135, 202639 | 11767 | AIM56769 | 25798 | 56302 | 86806, 117310, 147814, 178318, 208822 |
| 5585 | ADM32951 | 19616 | 50120 | 80624, 111128, 141632, 172136, 202640 | 11768 | AIM56780 | 25799 | 56303 | 86807, 117311, 147815, 178319, 208823 |
| 5586 | ADM32960 | 19617 | 50121 | 80625, 111129, 141633, 172137, 202641 | 11769 | AIM56791 | 25800 | 56304 | 86808, 117312, 147816, 178320, 208824 |
| 5587 | ADM32969 | 19618 | 50122 | 80626, 111130, 141634, 172138, 202642 | 11770 | AIM56813 | 25801 | 56305 | 86809, 117313, 147817, 178321, 208825 |
| 5588 | ADM32979 | 19619 | 50123 | 80627, 111131, 141635, 172139, 202643 | 11771 | AIM56824 | 25802 | 56306 | 86810, 117314, 147818, 178322, 208826 |
| 5589 | ADM32988 | 19620 | 50124 | 80628, 111132, 141636, 172140, 202644 | 11772 | AIN76385 | 25803 | 56307 | 86811, 117315, 147819, 178323, 208827 |
| 5590 | ADM32997 | 19621 | 50125 | 80629, 111133, 141637, 172141, 202645 | 11773 | AIP93105 | 25804 | 56308 | 86812, 117316, 147820, 178324, 208828 |
| 5591 | ADM33006 | 19622 | 50126 | 80630, 111134, 141638, 172142, 202646 | 11774 | AIP93117 | 25805 | 56309 | 86813, 117317, 147821, 178325, 208829 |

FIG. 3 continued

| | | | | | | | | | |
|---|---|---|---|---|---|---|---|---|---|
| 5592 | ADM33015 | 19623 | 50127 | 80631, 111135, 141639, 172143, 202647 | 11775 | AIR93973 | 25806 | 56310 | 86814, 117318, 147822, 178326, 208830 |
| 5593 | ADM33025 | 19624 | 50128 | 80632, 111136, 141640, 172144, 202648 | 11776 | AIR93984 | 25807 | 56311 | 86815, 117319, 147823, 178327, 208831 |
| 5594 | ADM33042 | 19625 | 50129 | 80633, 111137, 141641, 172145, 202649 | 11777 | AIR93995 | 25808 | 56312 | 86816, 117320, 147824, 178328, 208832 |
| 5595 | ADM33062 | 19626 | 50130 | 80634, 111138, 141642, 172146, 202650 | 11778 | AIR94118 | 25809 | 56313 | 86817, 117321, 147825, 178329, 208833 |
| 5596 | ADM33071 | 19627 | 50131 | 80635, 111139, 141643, 172147, 202651 | 11779 | AIT38335 | 25810 | 56314 | 86818, 117322, 147826, 178330, 208834 |
| 5597 | ADM33081 | 19628 | 50132 | 80636, 111140, 141644, 172148, 202652 | 11780 | AIT38346 | 25811 | 56315 | 86819, 117323, 147827, 178331, 208835 |
| 5598 | ADM33091 | 19629 | 50133 | 80637, 111141, 141645, 172149, 202653 | 11781 | AIT38361 | 25812 | 56316 | 86820, 117324, 147828, 178332, 208836 |
| 5599 | ADM33101 | 19630 | 50134 | 80638, 111142, 141646, 172150, 202654 | 11782 | AIT38375 | 25813 | 56317 | 86821, 117325, 147829, 178333, 208837 |
| 5600 | ADM33111 | 19631 | 50135 | 80639, 111143, 141647, 172151, 202655 | 11783 | AIT93148 | 25814 | 56318 | 86822, 117326, 147830, 178334, 208838 |
| 5601 | ADM33121 | 19632 | 50136 | 80640, 111144, 141648, 172152, 202656 | 11784 | AIU39701 | 25815 | 56319 | 86823, 117327, 147831, 178335, 208839 |
| 5602 | ADM33130 | 19633 | 50137 | 80641, 111145, 141649, 172153, 202657 | 11785 | AIU39703 | 25816 | 56320 | 86824, 117328, 147832, 178336, 208840 |
| 5603 | ADM33139 | 19634 | 50138 | 80642, 111146, 141650, 172154, 202658 | 11786 | AIU39705 | 25817 | 56321 | 86825, 117329, 147833, 178337, 208841 |
| 5604 | ADM33149 | 19635 | 50139 | 80643, 111147, 141651, 172155, 202659 | 11787 | AIU46611 | 25818 | 56322 | 86826, 117330, 147834, 178338, 208842 |
| 5605 | ADM33159 | 19636 | 50140 | 80644, 111148, 141652, 172156, 202660 | 11788 | AIV09221 | 25819 | 56323 | 86827, 117331, 147835, 178339, 208843 |
| 5606 | ADM33169 | 19637 | 50141 | 80645, 111149, 141653, 172157, 202661 | 11789 | AIW60703 | 25820 | 56324 | 86828, 117332, 147836, 178340, 208844 |
| 5607 | ADM33179 | 19638 | 50142 | 80646, 111150, 141654, 172158, 202662 | 11790 | AIW60704 | 25821 | 56325 | 86829, 117333, 147837, 178341, 208845 |
| 5608 | ADM33188 | 19639 | 50143 | 80647, 111151, 141655, 172159, 202663 | 11791 | AIW60705 | 25822 | 56326 | 86830, 117334, 147838, 178342, 208846 |
| 5609 | ADM33197 | 19640 | 50144 | 80648, 111152, 141656, 172160, 202664 | 11792 | AIW60706 | 25823 | 56327 | 86831, 117335, 147839, 178343, 208847 |

FIG. 3 continued

| | | | | | | | | | |
|---|---|---|---|---|---|---|---|---|---|
| 5610 | ADM33206 | 19641 | 50145 | 80649, 111153, 141657, 172161, 202665 | 11793 | AIW60708 | 25824 | 56328 | 86832, 117336, 147840, 178344, 208848 |
| 5611 | ADM33215 | 19642 | 50146 | 80650, 111154, 141658, 172162, 202666 | 11794 | AIW60710 | 25825 | 56329 | 86833, 117337, 147841, 178345, 208849 |
| 5612 | ADM33224 | 19643 | 50147 | 80651, 111155, 141659, 172163, 202667 | 11795 | AIW60711 | 25826 | 56330 | 86834, 117338, 147842, 178346, 208850 |
| 5613 | ADM33234 | 19644 | 50148 | 80652, 111156, 141660, 172164, 202668 | 11796 | AIW60712 | 25827 | 56331 | 86835, 117339, 147843, 178347, 208851 |
| 5614 | ADM33243 | 19645 | 50149 | 80653, 111157, 141661, 172165, 202669 | 11797 | AIW60713 | 25828 | 56332 | 86836, 117340, 147844, 178348, 208852 |
| 5615 | ADM33253 | 19646 | 50150 | 80654, 111158, 141662, 172166, 202670 | 11798 | AIW60714 | 25829 | 56333 | 86837, 117341, 147845, 178349, 208853 |
| 5616 | ADM33262 | 19647 | 50151 | 80655, 111159, 141663, 172167, 202671 | 11799 | AIW60715 | 25830 | 56334 | 86838, 117342, 147846, 178350, 208854 |
| 5617 | ADM33272 | 19648 | 50152 | 80656, 111160, 141664, 172168, 202672 | 11800 | AIW60716 | 25831 | 56335 | 86839, 117343, 147847, 178351, 208855 |
| 5618 | ADM33282 | 19649 | 50153 | 80657, 111161, 141665, 172169, 202673 | 11801 | AIY54970 | 25832 | 56336 | 86840, 117344, 147848, 178352, 208856 |
| 5619 | ADM33292 | 19650 | 50154 | 80658, 111162, 141666, 172170, 202674 | 11802 | AIY54974 | 25833 | 56337 | 86841, 117345, 147849, 178353, 208857 |
| 5620 | ADM33302 | 19651 | 50155 | 80659, 111163, 141667, 172171, 202675 | 11803 | AIY54982 | 25834 | 56338 | 86842, 117346, 147850, 178354, 208858 |
| 5621 | ADM33312 | 19652 | 50156 | 80660, 111164, 141668, 172172, 202676 | 11804 | AIY54990 | 25835 | 56339 | 86843, 117347, 147851, 178355, 208859 |
| 5622 | ADM33322 | 19653 | 50157 | 80661, 111165, 141669, 172173, 202677 | 11805 | AJD78177 | 25836 | 56340 | 86844, 117348, 147852, 178356, 208860 |
| 5623 | ADM33332 | 19654 | 50158 | 80662, 111166, 141670, 172174, 202678 | 11806 | AJD78189 | 25837 | 56341 | 86845, 117349, 147853, 178357, 208861 |
| 5624 | ADM33342 | 19655 | 50159 | 80663, 111167, 141671, 172175, 202679 | 11807 | AJD78201 | 25838 | 56342 | 86846, 117350, 147854, 178358, 208862 |
| 5625 | ADM33367 | 19656 | 50160 | 80664, 111168, 141672, 172176, 202680 | 11808 | AJD78213 | 25839 | 56343 | 86847, 117351, 147855, 178359, 208863 |
| 5626 | ADM33377 | 19657 | 50161 | 80665, 111169, 141673, 172177, 202681 | 11809 | AJI80140 | 25840 | 56344 | 86848, 117352, 147856, 178360, 208864 |
| 5627 | ADM33387 | 19658 | 50162 | 80666, 111170, 141674, 172178, 202682 | 11810 | AJI80152 | 25841 | 56345 | 86849, 117353, 147857, 178361, 208865 |

FIG. 3 continued

| | | | | | | | | | |
|---|---|---|---|---|---|---|---|---|---|
| 5628 | ADM33397 | 19659 | 50163 | 80667, 111171, 141675, 172179, 202683 | 11811 | AJI80164 | 25842 | 56346 | 86850, 117354, 147858, 178362, 208866 |
| 5629 | ADM33407 | 19660 | 50164 | 80668, 111172, 141676, 172180, 202684 | 11812 | AJI80175 | 25843 | 56347 | 86851, 117355, 147859, 178363, 208867 |
| 5630 | ADM33417 | 19661 | 50165 | 80669, 111173, 141677, 172181, 202685 | 11813 | AJI80187 | 25844 | 56348 | 86852, 117356, 147860, 178364, 208868 |
| 5631 | ADM33427 | 19662 | 50166 | 80670, 111174, 141678, 172182, 202686 | 11814 | AJI80199 | 25845 | 56349 | 86853, 117357, 147861, 178365, 208869 |
| 5632 | ADM33437 | 19663 | 50167 | 80671, 111175, 141679, 172183, 202687 | 11815 | AJI80211 | 25846 | 56350 | 86854, 117358, 147862, 178366, 208870 |
| 5633 | ADM33443 | 19664 | 50168 | 80672, 111176, 141680, 172184, 202688 | 11816 | AJI80223 | 25847 | 56351 | 86855, 117359, 147863, 178367, 208871 |
| 5634 | ADM52446 | 19665 | 50169 | 80673, 111177, 141681, 172185, 202689 | 11817 | AJI80235 | 25848 | 56352 | 86856, 117360, 147864, 178368, 208872 |
| 5635 | ADM52456 | 19666 | 50170 | 80674, 111178, 141682, 172186, 202690 | 11818 | AJI80247 | 25849 | 56353 | 86857, 117361, 147865, 178369, 208873 |
| 5636 | ADM52466 | 19667 | 50171 | 80675, 111179, 141683, 172187, 202691 | 11819 | AJI80259 | 25850 | 56354 | 86858, 117362, 147866, 178370, 208874 |
| 5637 | ADM52486 | 19668 | 50172 | 80676, 111180, 141684, 172188, 202692 | 11820 | AJI80271 | 25851 | 56355 | 86859, 117363, 147867, 178371, 208875 |
| 5638 | ADM52496 | 19669 | 50173 | 80677, 111181, 141685, 172189, 202693 | 11821 | AJI80283 | 25852 | 56356 | 86860, 117364, 147868, 178372, 208876 |
| 5639 | ADM52506 | 19670 | 50174 | 80678, 111182, 141686, 172190, 202694 | 11822 | AJI80306 | 25853 | 56357 | 86861, 117365, 147869, 178373, 208877 |
| 5640 | ADM52516 | 19671 | 50175 | 80679, 111183, 141687, 172191, 202695 | 11823 | AJI80318 | 25854 | 56358 | 86862, 117366, 147870, 178374, 208878 |
| 5641 | ADM52527 | 19672 | 50176 | 80680, 111184, 141688, 172192, 202696 | 11824 | AJI80329 | 25855 | 56359 | 86863, 117367, 147871, 178375, 208879 |
| 5642 | ADM52537 | 19673 | 50177 | 80681, 111185, 141689, 172193, 202697 | 11825 | AJI80340 | 25856 | 56360 | 86864, 117368, 147872, 178376, 208880 |
| 5643 | ADM52547 | 19674 | 50178 | 80682, 111186, 141690, 172194, 202698 | 11826 | AJI80351 | 25857 | 56361 | 86865, 117369, 147873, 178377, 208881 |
| 5644 | ADM52557 | 19675 | 50179 | 80683, 111187, 141691, 172195, 202699 | 11827 | AJI80363 | 25858 | 56362 | 86866, 117370, 147874, 178378, 208882 |
| 5645 | ADM52567 | 19676 | 50180 | 80684, 111188, 141692, 172196, 202700 | 11828 | AJI80375 | 25859 | 56363 | 86867, 117371, 147875, 178379, 208883 |

FIG. 3 continued

| | | | | | | | | | |
|---|---|---|---|---|---|---|---|---|---|
| 5646 | ADM52577 | 19677 | 50181 | 80685, 111189, 141693, 172197, 202701 | 11829 | AJI80387 | 25860 | 56364 | 86868, 117372, 147876, 178380, 208884 |
| 5647 | ADM52587 | 19678 | 50182 | 80686, 111190, 141694, 172198, 202702 | 11830 | AJI80398 | 25861 | 56365 | 86869, 117373, 147877, 178381, 208885 |
| 5648 | ADM52597 | 19679 | 50183 | 80687, 111191, 141695, 172199, 202703 | 11831 | AJI80409 | 25862 | 56366 | 86870, 117374, 147878, 178382, 208886 |
| 5649 | ADM52607 | 19680 | 50184 | 80688, 111192, 141696, 172200, 202704 | 11832 | AJI80420 | 25863 | 56367 | 86871, 117375, 147879, 178383, 208887 |
| 5650 | ADM52617 | 19681 | 50185 | 80689, 111193, 141697, 172201, 202705 | 11833 | AJI80431 | 25864 | 56368 | 86872, 117376, 147880, 178384, 208888 |
| 5651 | ADM52627 | 19682 | 50186 | 80690, 111194, 141698, 172202, 202706 | 11834 | AJI80442 | 25865 | 56369 | 86873, 117377, 147881, 178385, 208889 |
| 5652 | ADM52637 | 19683 | 50187 | 80691, 111195, 141699, 172203, 202707 | 11835 | AJI80454 | 25866 | 56370 | 86874, 117378, 147882, 178386, 208890 |
| 5653 | ADM52647 | 19684 | 50188 | 80692, 111196, 141700, 172204, 202708 | 11836 | AJI80465 | 25867 | 56371 | 86875, 117379, 147883, 178387, 208891 |
| 5654 | ADM52657 | 19685 | 50189 | 80693, 111197, 141701, 172205, 202709 | 11837 | AJI80477 | 25868 | 56372 | 86876, 117380, 147884, 178388, 208892 |
| 5655 | ADM52667 | 19686 | 50190 | 80694, 111198, 141702, 172206, 202710 | 11838 | AJI80488 | 25869 | 56373 | 86877, 117381, 147885, 178389, 208893 |
| 5656 | ADM52687 | 19687 | 50191 | 80695, 111199, 141703, 172207, 202711 | 11839 | AJI80499 | 25870 | 56374 | 86878, 117382, 147886, 178390, 208894 |
| 5657 | ADM52697 | 19688 | 50192 | 80696, 111200, 141704, 172208, 202712 | 11840 | AJI80510 | 25871 | 56375 | 86879, 117383, 147887, 178391, 208895 |
| 5658 | ADM52707 | 19689 | 50193 | 80697, 111201, 141705, 172209, 202713 | 11841 | AJI80521 | 25872 | 56376 | 86880, 117384, 147888, 178392, 208896 |
| 5659 | ADM52717 | 19690 | 50194 | 80698, 111202, 141706, 172210, 202714 | 11842 | AJJ98767 | 25873 | 56377 | 86881, 117385, 147889, 178393, 208897 |
| 5660 | ADM86402 | 19691 | 50195 | 80699, 111203, 141707, 172211, 202715 | 11843 | AJJ98779 | 25874 | 56378 | 86882, 117386, 147890, 178394, 208898 |
| 5661 | ADM86412 | 19692 | 50196 | 80700, 111204, 141708, 172212, 202716 | 11844 | AJJ98791 | 25875 | 56379 | 86883, 117387, 147891, 178395, 208899 |
| 5662 | ADM86422 | 19693 | 50197 | 80701, 111205, 141709, 172213, 202717 | 11845 | AJJ98803 | 25876 | 56380 | 86884, 117388, 147892, 178396, 208900 |
| 5663 | ADM86432 | 19694 | 50198 | 80702, 111206, 141710, 172214, 202718 | 11846 | AJJ98815 | 25877 | 56381 | 86885, 117389, 147893, 178397, 208901 |

FIG. 3 continued

| | | | | | | | | | |
|---|---|---|---|---|---|---|---|---|---|
| 5664 | ADM86443 | 19695 | 50199 | 80703, 111207, 141711, 172215, 202719 | 11847 | AJJ98827 | 25878 | 56382 | 86886, 117390, 147894, 178398, 208902 |
| 5665 | ADM86453 | 19696 | 50200 | 80704, 111208, 141712, 172216, 202720 | 11848 | AJJ98839 | 25879 | 56383 | 86887, 117391, 147895, 178399, 208903 |
| 5666 | ADM95377 | 19697 | 50201 | 80705, 111209, 141713, 172217, 202721 | 11849 | AJJ98851 | 25880 | 56384 | 86888, 117392, 147896, 178400, 208904 |
| 5667 | ADM95650 | 19698 | 50202 | 80706, 111210, 141714, 172218, 202722 | 11850 | AJJ98863 | 25881 | 56385 | 86889, 117393, 147897, 178401, 208905 |
| 5668 | ADM95651 | 19699 | 50203 | 80707, 111211, 141715, 172219, 202723 | 11851 | AJJ98875 | 25882 | 56386 | 86890, 117394, 147898, 178402, 208906 |
| 5669 | ADM95652 | 19700 | 50204 | 80708, 111212, 141716, 172220, 202724 | 11852 | AJJ98887 | 25883 | 56387 | 86891, 117395, 147899, 178403, 208907 |
| 5670 | ADM95654 | 19701 | 50205 | 80709, 111213, 141717, 172221, 202725 | 11853 | AJJ98899 | 25884 | 56388 | 86892, 117396, 147900, 178404, 208908 |
| 5671 | ADM95655 | 19702 | 50206 | 80710, 111214, 141718, 172222, 202726 | 11854 | AJJ98911 | 25885 | 56389 | 86893, 117397, 147901, 178405, 208909 |
| 5672 | ADM95656 | 19703 | 50207 | 80711, 111215, 141719, 172223, 202727 | 11855 | AJJ98923 | 25886 | 56390 | 86894, 117398, 147902, 178406, 208910 |
| 5673 | ADM95658 | 19704 | 50208 | 80712, 111216, 141720, 172224, 202728 | 11856 | AJJ98935 | 25887 | 56391 | 86895, 117399, 147903, 178407, 208911 |
| 5674 | ADM95659 | 19705 | 50209 | 80713, 111217, 141721, 172225, 202729 | 11857 | AJJ98947 | 25888 | 56392 | 86896, 117400, 147904, 178408, 208912 |
| 5675 | ADM95660 | 19706 | 50210 | 80714, 111218, 141722, 172226, 202730 | 11858 | AJJ98971 | 25889 | 56393 | 86897, 117401, 147905, 178409, 208913 |
| 5676 | ADM95661 | 19707 | 50211 | 80715, 111219, 141723, 172227, 202731 | 11859 | AJJ98995 | 25890 | 56394 | 86898, 117402, 147906, 178410, 208914 |
| 5677 | ADM95662 | 19708 | 50212 | 80716, 111220, 141724, 172228, 202732 | 11860 | AJJ99007 | 25891 | 56395 | 86899, 117403, 147907, 178411, 208915 |
| 5678 | ADM95663 | 19709 | 50213 | 80717, 111221, 141725, 172229, 202733 | 11861 | AJJ99019 | 25892 | 56396 | 86900, 117404, 147908, 178412, 208916 |
| 5679 | ADM95664 | 19710 | 50214 | 80718, 111222, 141726, 172230, 202734 | 11862 | AJJ99031 | 25893 | 56397 | 86901, 117405, 147909, 178413, 208917 |
| 5680 | ADM95665 | 19711 | 50215 | 80719, 111223, 141727, 172231, 202735 | 11863 | AJJ99043 | 25894 | 56398 | 86902, 117406, 147910, 178414, 208918 |
| 5681 | ADM95666 | 19712 | 50216 | 80720, 111224, 141728, 172232, 202736 | 11864 | AJJ99067 | 25895 | 56399 | 86903, 117407, 147911, 178415, 208919 |

FIG. 3 continued

| | | | | | | | | | |
|---|---|---|---|---|---|---|---|---|---|
| 5682 | ADM95667 | 19713 | 50217 | 80721, 111225, 141729, 172233, 202737 | 11865 | AJJ99079 | 25896 | 56400 | 86904, 117408, 147912, 178416, 208920 |
| 5683 | ADM95668 | 19714 | 50218 | 80722, 111226, 141730, 172234, 202738 | 11866 | AJJ99091 | 25897 | 56401 | 86905, 117409, 147913, 178417, 208921 |
| 5684 | ADM95669 | 19715 | 50219 | 80723, 111227, 141731, 172235, 202739 | 11867 | AJJ99103 | 25898 | 56402 | 86906, 117410, 147914, 178418, 208922 |
| 5685 | ADM95670 | 19716 | 50220 | 80724, 111228, 141732, 172236, 202740 | 11868 | AJJ99115 | 25899 | 56403 | 86907, 117411, 147915, 178419, 208923 |
| 5686 | ADM95672 | 19717 | 50221 | 80725, 111229, 141733, 172237, 202741 | 11869 | AJJ99127 | 25900 | 56404 | 86908, 117412, 147916, 178420, 208924 |
| 5687 | ADM95673 | 19718 | 50222 | 80726, 111230, 141734, 172238, 202742 | 11870 | AJJ99139 | 25901 | 56405 | 86909, 117413, 147917, 178421, 208925 |
| 5688 | ADM95674 | 19719 | 50223 | 80727, 111231, 141735, 172239, 202743 | 11871 | AJJ99151 | 25902 | 56406 | 86910, 117414, 147918, 178422, 208926 |
| 5689 | ADM95675 | 19720 | 50224 | 80728, 111232, 141736, 172240, 202744 | 11872 | AJJ99163 | 25903 | 56407 | 86911, 117415, 147919, 178423, 208927 |
| 5690 | ADM95677 | 19721 | 50225 | 80729, 111233, 141737, 172241, 202745 | 11873 | AJJ99175 | 25904 | 56408 | 86912, 117416, 147920, 178424, 208928 |
| 5691 | ADM95678 | 19722 | 50226 | 80730, 111234, 141738, 172242, 202746 | 11874 | AJJ99199 | 25905 | 56409 | 86913, 117417, 147921, 178425, 208929 |
| 5692 | ADM95679 | 19723 | 50227 | 80731, 111235, 141739, 172243, 202747 | 11875 | AJJ99211 | 25906 | 56410 | 86914, 117418, 147922, 178426, 208930 |
| 5693 | ADM95680 | 19724 | 50228 | 80732, 111236, 141740, 172244, 202748 | 11876 | AJJ99223 | 25907 | 56411 | 86915, 117419, 147923, 178427, 208931 |
| 5694 | ADM95681 | 19725 | 50229 | 80733, 111237, 141741, 172245, 202749 | 11877 | AJJ99235 | 25908 | 56412 | 86916, 117420, 147924, 178428, 208932 |
| 5695 | ADM95682 | 19726 | 50230 | 80734, 111238, 141742, 172246, 202750 | 11878 | AJJ99246 | 25909 | 56413 | 86917, 117421, 147925, 178429, 208933 |
| 5696 | ADM95683 | 19727 | 50231 | 80735, 111239, 141743, 172247, 202751 | 11879 | AJJ99257 | 25910 | 56414 | 86918, 117422, 147926, 178430, 208934 |
| 5697 | ADM95684 | 19728 | 50232 | 80736, 111240, 141744, 172248, 202752 | 11880 | AJJ99269 | 25911 | 56415 | 86919, 117423, 147927, 178431, 208935 |
| 5698 | ADM95685 | 19729 | 50233 | 80737, 111241, 141745, 172249, 202753 | 11881 | AJJ99280 | 25912 | 56416 | 86920, 117424, 147928, 178432, 208936 |
| 5699 | ADM95686 | 19730 | 50234 | 80738, 111242, 141746, 172250, 202754 | 11882 | AJJ99291 | 25913 | 56417 | 86921, 117425, 147929, 178433, 208937 |

FIG. 3 continued

| | | | | | | | | | |
|---|---|---|---|---|---|---|---|---|---|
| 5700 | ADM95687 | 19731 | 50235 | 80739, 111243, 141747, 172251, 202755 | 11883 | AJJ99303 | 25914 | 56418 | 86922, 117426, 147930, 178434, 208938 |
| 5701 | ADM95688 | 19732 | 50236 | 80740, 111244, 141748, 172252, 202756 | 11884 | AJJ99314 | 25915 | 56419 | 86923, 117427, 147931, 178435, 208939 |
| 5702 | ADM95689 | 19733 | 50237 | 80741, 111245, 141749, 172253, 202757 | 11885 | AJJ99326 | 25916 | 56420 | 86924, 117428, 147932, 178436, 208940 |
| 5703 | ADM95690 | 19734 | 50238 | 80742, 111246, 141750, 172254, 202758 | 11886 | AJJ99337 | 25917 | 56421 | 86925, 117429, 147933, 178437, 208941 |
| 5704 | ADM95691 | 19735 | 50239 | 80743, 111247, 141751, 172255, 202759 | 11887 | AJJ99348 | 25918 | 56422 | 86926, 117430, 147934, 178438, 208942 |
| 5705 | ADM95692 | 19736 | 50240 | 80744, 111248, 141752, 172256, 202760 | 11888 | AJJ99359 | 25919 | 56423 | 86927, 117431, 147935, 178439, 208943 |
| 5706 | ADM95693 | 19737 | 50241 | 80745, 111249, 141753, 172257, 202761 | 11889 | AJJ99370 | 25920 | 56424 | 86928, 117432, 147936, 178440, 208944 |
| 5707 | ADM95694 | 19738 | 50242 | 80746, 111250, 141754, 172258, 202762 | 11890 | AJJ99381 | 25921 | 56425 | 86929, 117433, 147937, 178441, 208945 |
| 5708 | ADM95695 | 19739 | 50243 | 80747, 111251, 141755, 172259, 202763 | 11891 | AJJ99392 | 25922 | 56426 | 86930, 117434, 147938, 178442, 208946 |
| 5709 | ADM95696 | 19740 | 50244 | 80748, 111252, 141756, 172260, 202764 | 11892 | AJJ99403 | 25923 | 56427 | 86931, 117435, 147939, 178443, 208947 |
| 5710 | ADM95697 | 19741 | 50245 | 80749, 111253, 141757, 172261, 202765 | 11893 | AJJ99415 | 25924 | 56428 | 86932, 117436, 147940, 178444, 208948 |
| 5711 | ADM95698 | 19742 | 50246 | 80750, 111254, 141758, 172262, 202766 | 11894 | AJJ99427 | 25925 | 56429 | 86933, 117437, 147941, 178445, 208949 |
| 5712 | ADM95699 | 19743 | 50247 | 80751, 111255, 141759, 172263, 202767 | 11895 | AJJ99439 | 25926 | 56430 | 86934, 117438, 147942, 178446, 208950 |
| 5713 | ADM95701 | 19744 | 50248 | 80752, 111256, 141760, 172264, 202768 | 11896 | AJJ99451 | 25927 | 56431 | 86935, 117439, 147943, 178447, 208951 |
| 5714 | ADM95702 | 19745 | 50249 | 80753, 111257, 141761, 172265, 202769 | 11897 | AJJ99463 | 25928 | 56432 | 86936, 117440, 147944, 178448, 208952 |
| 5715 | ADM95704 | 19746 | 50250 | 80754, 111258, 141762, 172266, 202770 | 11898 | AJJ99474 | 25929 | 56433 | 86937, 117441, 147945, 178449, 208953 |
| 5716 | ADM95705 | 19747 | 50251 | 80755, 111259, 141763, 172267, 202771 | 11899 | AJJ99496 | 25930 | 56434 | 86938, 117442, 147946, 178450, 208954 |
| 5717 | ADM95706 | 19748 | 50252 | 80756, 111260, 141764, 172268, 202772 | 11900 | AJJ99507 | 25931 | 56435 | 86939, 117443, 147947, 178451, 208955 |

FIG. 3 continued

| | | | | | | | | | |
|---|---|---|---|---|---|---|---|---|---|
| 5718 | ADM95707 | 19749 | 50253 | 80757, 111261, 141765, 172269, 202773 | 11901 | AJJ99518 | 25932 | 56436 | 86940, 117444, 147948, 178452, 208956 |
| 5719 | ADM95708 | 19750 | 50254 | 80758, 111262, 141766, 172270, 202774 | 11902 | AJJ99529 | 25933 | 56437 | 86941, 117445, 147949, 178453, 208957 |
| 5720 | ADM95710 | 19751 | 50255 | 80759, 111263, 141767, 172271, 202775 | 11903 | AJJ99540 | 25934 | 56438 | 86942, 117446, 147950, 178454, 208958 |
| 5721 | ADM95711 | 19752 | 50256 | 80760, 111264, 141768, 172272, 202776 | 11904 | AJJ99551 | 25935 | 56439 | 86943, 117447, 147951, 178455, 208959 |
| 5722 | ADM95712 | 19753 | 50257 | 80761, 111265, 141769, 172273, 202777 | 11905 | AJJ99562 | 25936 | 56440 | 86944, 117448, 147952, 178456, 208960 |
| 5723 | ADM95713 | 19754 | 50258 | 80762, 111266, 141770, 172274, 202778 | 11906 | AJJ99573 | 25937 | 56441 | 86945, 117449, 147953, 178457, 208961 |
| 5724 | ADM95714 | 19755 | 50259 | 80763, 111267, 141771, 172275, 202779 | 11907 | AJJ99584 | 25938 | 56442 | 86946, 117450, 147954, 178458, 208962 |
| 5725 | ADM95715 | 19756 | 50260 | 80764, 111268, 141772, 172276, 202780 | 11908 | AJJ99595 | 25939 | 56443 | 86947, 117451, 147955, 178459, 208963 |
| 5726 | ADM95716 | 19757 | 50261 | 80765, 111269, 141773, 172277, 202781 | 11909 | AJJ99606 | 25940 | 56444 | 86948, 117452, 147956, 178460, 208964 |
| 5727 | ADM95717 | 19758 | 50262 | 80766, 111270, 141774, 172278, 202782 | 11910 | AJJ99618 | 25941 | 56445 | 86949, 117453, 147957, 178461, 208965 |
| 5728 | ADM95718 | 19759 | 50263 | 80767, 111271, 141775, 172279, 202783 | 11911 | AJJ99630 | 25942 | 56446 | 86950, 117454, 147958, 178462, 208966 |
| 5729 | ADM95719 | 19760 | 50264 | 80768, 111272, 141776, 172280, 202784 | 11912 | AJJ99642 | 25943 | 56447 | 86951, 117455, 147959, 178463, 208967 |
| 5730 | ADM95720 | 19761 | 50265 | 80769, 111273, 141777, 172281, 202785 | 11913 | AJJ99654 | 25944 | 56448 | 86952, 117456, 147960, 178464, 208968 |
| 5731 | ADM95721 | 19762 | 50266 | 80770, 111274, 141778, 172282, 202786 | 11914 | AJJ99666 | 25945 | 56449 | 86953, 117457, 147961, 178465, 208969 |
| 5732 | ADM95723 | 19763 | 50267 | 80771, 111275, 141779, 172283, 202787 | 11915 | AJJ99677 | 25946 | 56450 | 86954, 117458, 147962, 178466, 208970 |
| 5733 | ADM95724 | 19764 | 50268 | 80772, 111276, 141780, 172284, 202788 | 11916 | AJJ99688 | 25947 | 56451 | 86955, 117459, 147963, 178467, 208971 |
| 5734 | ADM95725 | 19765 | 50269 | 80773, 111277, 141781, 172285, 202789 | 11917 | AJJ99710 | 25948 | 56452 | 86956, 117460, 147964, 178468, 208972 |
| 5735 | ADM95726 | 19766 | 50270 | 80774, 111278, 141782, 172286, 202790 | 11918 | AJJ99721 | 25949 | 56453 | 86957, 117461, 147965, 178469, 208973 |

FIG. 3 continued

| | | | | | | | | | |
|---|---|---|---|---|---|---|---|---|---|
| 5736 | ADM95727 | 19767 | 50271 | 80775, 111279, 141783, 172287, 202791 | 11919 | AJJ99732 | 25950 | 56454 | 86958, 117462, 147966, 178470, 208974 |
| 5737 | ADM95728 | 19768 | 50272 | 80776, 111280, 141784, 172288, 202792 | 11920 | AJJ99743 | 25951 | 56455 | 86959, 117463, 147967, 178471, 208975 |
| 5738 | ADM95729 | 19769 | 50273 | 80777, 111281, 141785, 172289, 202793 | 11921 | AJJ99754 | 25952 | 56456 | 86960, 117464, 147968, 178472, 208976 |
| 5739 | ADM95730 | 19770 | 50274 | 80778, 111282, 141786, 172290, 202794 | 11922 | AJJ99765 | 25953 | 56457 | 86961, 117465, 147969, 178473, 208977 |
| 5740 | ADM95732 | 19771 | 50275 | 80779, 111283, 141787, 172291, 202795 | 11923 | AJJ99777 | 25954 | 56458 | 86962, 117466, 147970, 178474, 208978 |
| 5741 | ADM95733 | 19772 | 50276 | 80780, 111284, 141788, 172292, 202796 | 11924 | AJJ99788 | 25955 | 56459 | 86963, 117467, 147971, 178475, 208979 |
| 5742 | ADM95734 | 19773 | 50277 | 80781, 111285, 141789, 172293, 202797 | 11925 | AJJ99800 | 25956 | 56460 | 86964, 117468, 147972, 178476, 208980 |
| 5743 | ADM95735 | 19774 | 50278 | 80782, 111286, 141790, 172294, 202798 | 11926 | AJJ99812 | 25957 | 56461 | 86965, 117469, 147973, 178477, 208981 |
| 5744 | ADM95736 | 19775 | 50279 | 80783, 111287, 141791, 172295, 202799 | 11927 | AJJ99824 | 25958 | 56462 | 86966, 117470, 147974, 178478, 208982 |
| 5745 | ADM95737 | 19776 | 50280 | 80784, 111288, 141792, 172296, 202800 | 11928 | AJJ99835 | 25959 | 56463 | 86967, 117471, 147975, 178479, 208983 |
| 5746 | ADM95738 | 19777 | 50281 | 80785, 111289, 141793, 172297, 202801 | 11929 | AJJ99846 | 25960 | 56464 | 86968, 117472, 147976, 178480, 208984 |
| 5747 | ADM95739 | 19778 | 50282 | 80786, 111290, 141794, 172298, 202802 | 11930 | AJJ99857 | 25961 | 56465 | 86969, 117473, 147977, 178481, 208985 |
| 5748 | ADM95740 | 19779 | 50283 | 80787, 111291, 141795, 172299, 202803 | 11931 | AJJ99868 | 25962 | 56466 | 86970, 117474, 147978, 178482, 208986 |
| 5749 | ADM95741 | 19780 | 50284 | 80788, 111292, 141796, 172300, 202804 | 11932 | AJJ99879 | 25963 | 56467 | 86971, 117475, 147979, 178483, 208987 |
| 5750 | ADM95742 | 19781 | 50285 | 80789, 111293, 141797, 172301, 202805 | 11933 | AJJ99890 | 25964 | 56468 | 86972, 117476, 147980, 178484, 208988 |
| 5751 | ADM95743 | 19782 | 50286 | 80790, 111294, 141798, 172302, 202806 | 11934 | AJJ99901 | 25965 | 56469 | 86973, 117477, 147981, 178485, 208989 |
| 5752 | ADM95744 | 19783 | 50287 | 80791, 111295, 141799, 172303, 202807 | 11935 | AJJ99912 | 25966 | 56470 | 86974, 117478, 147982, 178486, 208990 |
| 5753 | ADN05229 | 19784 | 50288 | 80792, 111296, 141800, 172304, 202808 | 11936 | AJJ99923 | 25967 | 56471 | 86975, 117479, 147983, 178487, 208991 |

FIG. 3 continued

| | | | | | | | | | |
|---|---|---|---|---|---|---|---|---|---|
| 5754 | ADN06292 | 19785 | 50289 | 80793, 111297, 141801, 172305, 202809 | 11937 | AJJ99934 | 25968 | 56472 | 86976, 117480, 147984, 178488, 208992 |
| 5755 | ADN06303 | 19786 | 50290 | 80794, 111298, 141802, 172306, 202810 | 11938 | AJJ99945 | 25969 | 56473 | 86977, 117481, 147985, 178489, 208993 |
| 5756 | ADN06314 | 19787 | 50291 | 80795, 111299, 141803, 172307, 202811 | 11939 | AJJ99956 | 25970 | 56474 | 86978, 117482, 147986, 178490, 208994 |
| 5757 | ADN06325 | 19788 | 50292 | 80796, 111300, 141804, 172308, 202812 | 11940 | AJJ99967 | 25971 | 56475 | 86979, 117483, 147987, 178491, 208995 |
| 5758 | ADN06347 | 19789 | 50293 | 80797, 111301, 141805, 172309, 202813 | 11941 | AJJ99991 | 25972 | 56476 | 86980, 117484, 147988, 178492, 208996 |
| 5759 | ADN06369 | 19790 | 50294 | 80798, 111302, 141806, 172310, 202814 | 11942 | AJK00003 | 25973 | 56477 | 86981, 117485, 147989, 178493, 208997 |
| 5760 | ADN26031 | 19791 | 50295 | 80799, 111303, 141807, 172311, 202815 | 11943 | AJK00014 | 25974 | 56478 | 86982, 117486, 147990, 178494, 208998 |
| 5761 | ADN26032 | 19792 | 50296 | 80800, 111304, 141808, 172312, 202816 | 11944 | AJK00025 | 25975 | 56479 | 86983, 117487, 147991, 178495, 208999 |
| 5762 | ADN26033 | 19793 | 50297 | 80801, 111305, 141809, 172313, 202817 | 11945 | AJK00036 | 25976 | 56480 | 86984, 117488, 147992, 178496, 209000 |
| 5763 | ADN26034 | 19794 | 50298 | 80802, 111306, 141810, 172314, 202818 | 11946 | AJK00047 | 25977 | 56481 | 86985, 117489, 147993, 178497, 209001 |
| 5764 | ADN26035 | 19795 | 50299 | 80803, 111307, 141811, 172315, 202819 | 11947 | AJK00058 | 25978 | 56482 | 86986, 117490, 147994, 178498, 209002 |
| 5765 | ADN26036 | 19796 | 50300 | 80804, 111308, 141812, 172316, 202820 | 11948 | AJK00069 | 25979 | 56483 | 86987, 117491, 147995, 178499, 209003 |
| 5766 | ADN26037 | 19797 | 50301 | 80805, 111309, 141813, 172317, 202821 | 11949 | AJK00081 | 25980 | 56484 | 86988, 117492, 147996, 178500, 209004 |
| 5767 | ADN26038 | 19798 | 50302 | 80806, 111310, 141814, 172318, 202822 | 11950 | AJK00093 | 25981 | 56485 | 86989, 117493, 147997, 178501, 209005 |
| 5768 | ADN26041 | 19799 | 50303 | 80807, 111311, 141815, 172319, 202823 | 11951 | AJK00105 | 25982 | 56486 | 86990, 117494, 147998, 178502, 209006 |
| 5769 | ADN26042 | 19800 | 50304 | 80808, 111312, 141816, 172320, 202824 | 11952 | AJK00116 | 25983 | 56487 | 86991, 117495, 147999, 178503, 209007 |
| 5770 | ADN26043 | 19801 | 50305 | 80809, 111313, 141817, 172321, 202825 | 11953 | AJK00127 | 25984 | 56488 | 86992, 117496, 148000, 178504, 209008 |
| 5771 | ADN26044 | 19802 | 50306 | 80810, 111314, 141818, 172322, 202826 | 11954 | AJK00138 | 25985 | 56489 | 86993, 117497, 148001, 178505, 209009 |

FIG. 3 continued

| | | | | | | | | | |
|---|---|---|---|---|---|---|---|---|---|
| 5772 | ADN26045 | 19803 | 50307 | 80811, 111315, 141819, 172323, 202827 | 11955 | AJK00152 | 25986 | 56490 | 86994, 117498, 148002, 178506, 209010 |
| 5773 | ADN26047 | 19804 | 50308 | 80812, 111316, 141820, 172324, 202828 | 11956 | AJK00167 | 25987 | 56491 | 86995, 117499, 148003, 178507, 209011 |
| 5774 | ADN26048 | 19805 | 50309 | 80813, 111317, 141821, 172325, 202829 | 11957 | AJK00178 | 25988 | 56492 | 86996, 117500, 148004, 178508, 209012 |
| 5775 | ADN26049 | 19806 | 50310 | 80814, 111318, 141822, 172326, 202830 | 11958 | AJK00199 | 25989 | 56493 | 86997, 117501, 148005, 178509, 209013 |
| 5776 | ADN26050 | 19807 | 50311 | 80815, 111319, 141823, 172327, 202831 | 11959 | AJK00208 | 25990 | 56494 | 86998, 117502, 148006, 178510, 209014 |
| 5777 | ADN26051 | 19808 | 50312 | 80816, 111320, 141824, 172328, 202832 | 11960 | AJK00219 | 25991 | 56495 | 86999, 117503, 148007, 178511, 209015 |
| 5778 | ADN26052 | 19809 | 50313 | 80817, 111321, 141825, 172329, 202833 | 11961 | AJK00230 | 25992 | 56496 | 87000, 117504, 148008, 178512, 209016 |
| 5779 | ADN26053 | 19810 | 50314 | 80818, 111322, 141826, 172330, 202834 | 11962 | AJS18470 | 25993 | 56497 | 87001, 117505, 148009, 178513, 209017 |
| 5780 | ADN26054 | 19811 | 50315 | 80819, 111323, 141827, 172331, 202835 | 11963 | AJS18481 | 25994 | 56498 | 87002, 117506, 148010, 178514, 209018 |
| 5781 | ADN26057 | 19812 | 50316 | 80820, 111324, 141828, 172332, 202836 | 11964 | AKA59350 | 25995 | 56499 | 87003, 117507, 148011, 178515, 209019 |
| 5782 | ADN26058 | 19813 | 50317 | 80821, 111325, 141829, 172333, 202837 | 11965 | AKA59352 | 25996 | 56500 | 87004, 117508, 148012, 178516, 209020 |
| 5783 | ADN26059 | 19814 | 50318 | 80822, 111326, 141830, 172334, 202838 | 11966 | AKA59354 | 25997 | 56501 | 87005, 117509, 148013, 178517, 209021 |
| 5784 | ADN26060 | 19815 | 50319 | 80823, 111327, 141831, 172335, 202839 | 11967 | AKS48026 | 25998 | 56502 | 87006, 117510, 148014, 178518, 209022 |
| 5785 | ADN26061 | 19816 | 50320 | 80824, 111328, 141832, 172336, 202840 | 11968 | AKS48040 | 25999 | 56503 | 87007, 117511, 148015, 178519, 209023 |
| 5786 | ADN26063 | 19817 | 50321 | 80825, 111329, 141833, 172337, 202841 | 11969 | ALO75898 | 26000 | 56504 | 87008, 117512, 148016, 178520, 209024 |
| 5787 | ADN26064 | 19818 | 50322 | 80826, 111330, 141834, 172338, 202842 | 11970 | ALO75910 | 26001 | 56505 | 87009, 117513, 148017, 178521, 209025 |
| 5788 | ADN26065 | 19819 | 50323 | 80827, 111331, 141835, 172339, 202843 | 11971 | ALO75922 | 26002 | 56506 | 87010, 117514, 148018, 178522, 209026 |
| 5789 | ADN26066 | 19820 | 50324 | 80828, 111332, 141836, 172340, 202844 | 11972 | ALT20083 | 26003 | 56507 | 87011, 117515, 148019, 178523, 209027 |

FIG. 3 continued

| | | | | | | | | | |
|---|---|---|---|---|---|---|---|---|---|
| 5790 | ADN26067 | 19821 | 50325 | 80829, 111333, 141837, 172341, 202845 | 11973 | AMA65392 | 26004 | 56508 | 87012, 117516, 148020, 178524, 209028 |
| 5791 | ADN26069 | 19822 | 50326 | 80830, 111334, 141838, 172342, 202846 | 11974 | AMA65394 | 26005 | 56509 | 87013, 117517, 148021, 178525, 209029 |
| 5792 | ADN26070 | 19823 | 50327 | 80831, 111335, 141839, 172343, 202847 | 11975 | BAA00618 | 26006 | 56510 | 87014, 117518, 148022, 178526, 209030 |
| 5793 | ADN26072 | 19824 | 50328 | 80832, 111336, 141840, 172344, 202848 | 11976 | BAA00619 | 26007 | 56511 | 87015, 117519, 148023, 178527, 209031 |
| 5794 | ADN26073 | 19825 | 50329 | 80833, 111337, 141841, 172345, 202849 | 11977 | BAA00620 | 26008 | 56512 | 87016, 117520, 148024, 178528, 209032 |
| 5795 | ADN26075 | 19826 | 50330 | 80834, 111338, 141842, 172346, 202850 | 11978 | BAA00621 | 26009 | 56513 | 87017, 117521, 148025, 178529, 209033 |
| 5796 | ADN26076 | 19827 | 50331 | 80835, 111339, 141843, 172347, 202851 | 11979 | BAA06714 | 26010 | 56514 | 87018, 117522, 148026, 178530, 209034 |
| 5797 | ADN26077 | 19828 | 50332 | 80836, 111340, 141844, 172348, 202852 | 11980 | BAA06715 | 26011 | 56515 | 87019, 117523, 148027, 178531, 209035 |
| 5798 | ADN26078 | 19829 | 50333 | 80837, 111341, 141845, 172349, 202853 | 11981 | BAA06716 | 26012 | 56516 | 87020, 117524, 148028, 178532, 209036 |
| 5799 | ADN26079 | 19830 | 50334 | 80838, 111342, 141846, 172350, 202854 | 11982 | BAA06717 | 26013 | 56517 | 87021, 117525, 148029, 178533, 209037 |
| 5800 | ADN26080 | 19831 | 50335 | 80839, 111343, 141847, 172351, 202855 | 11983 | BAA06718 | 26014 | 56518 | 87022, 117526, 148030, 178534, 209038 |
| 5801 | ADN26081 | 19832 | 50336 | 80840, 111344, 141848, 172352, 202856 | 11984 | BAA06720 | 26015 | 56519 | 87023, 117527, 148031, 178535, 209039 |
| 5802 | ADN26082 | 19833 | 50337 | 80841, 111345, 141849, 172353, 202857 | 11985 | BAD16637 | 26016 | 56520 | 87024, 117528, 148032, 178536, 209040 |
| 5803 | ADN26083 | 19834 | 50338 | 80842, 111346, 141850, 172354, 202858 | 11986 | BAD16638 | 26017 | 56521 | 87025, 117529, 148033, 178537, 209041 |
| 5804 | ADN26084 | 19835 | 50339 | 80843, 111347, 141851, 172355, 202859 | 11987 | BAD16639 | 26018 | 56522 | 87026, 117530, 148034, 178538, 209042 |
| 5805 | ADN26085 | 19836 | 50340 | 80844, 111348, 141852, 172356, 202860 | 11988 | BAD16640 | 26019 | 56523 | 87027, 117531, 148035, 178539, 209043 |
| 5806 | ADN26086 | 19837 | 50341 | 80845, 111349, 141853, 172357, 202861 | 11989 | BAD16641 | 26020 | 56524 | 87028, 117532, 148036, 178540, 209044 |
| 5807 | ADN26087 | 19838 | 50342 | 80846, 111350, 141854, 172358, 202862 | 11990 | BAD16642 | 26021 | 56525 | 87029, 117533, 148037, 178541, 209045 |

FIG. 3 continued

| | | | | | | | | | |
|---|---|---|---|---|---|---|---|---|---|
| 5808 | ADN26088 | 19839 | 50343 | 80847, 111351, 141855, 172359, 202863 | 11991 | BAD16643 | 26022 | 56526 | 87030, 117534, 148038, 178542, 209046 |
| 5809 | ADN26090 | 19840 | 50344 | 80848, 111352, 141856, 172360, 202864 | 11992 | BAD16644 | 26023 | 56527 | 87031, 117535, 148039, 178543, 209047 |
| 5810 | ADN26091 | 19841 | 50345 | 80849, 111353, 141857, 172361, 202865 | 11993 | BAD16645 | 26024 | 56528 | 87032, 117536, 148040, 178544, 209048 |
| 5811 | ADN26092 | 19842 | 50346 | 80850, 111354, 141858, 172362, 202866 | 11994 | BAD16646 | 26025 | 56529 | 87033, 117537, 148041, 178545, 209049 |
| 5812 | ADN26093 | 19843 | 50347 | 80851, 111355, 141859, 172363, 202867 | 11995 | BAD16647 | 26026 | 56530 | 87034, 117538, 148042, 178546, 209050 |
| 5813 | ADN26094 | 19844 | 50348 | 80852, 111356, 141860, 172364, 202868 | 11996 | BAD16648 | 26027 | 56531 | 87035, 117539, 148043, 178547, 209051 |
| 5814 | ADN26095 | 19845 | 50349 | 80853, 111357, 141861, 172365, 202869 | 11997 | BAE07203 | 26028 | 56532 | 87036, 117540, 148044, 178548, 209052 |
| 5815 | ADN26096 | 19846 | 50350 | 80854, 111358, 141862, 172366, 202870 | 11998 | BAF46322 | 26029 | 56533 | 87037, 117541, 148045, 178549, 209053 |
| 5816 | ADN26097 | 19847 | 50351 | 80855, 111359, 141863, 172367, 202871 | 11999 | BAF46323 | 26030 | 56534 | 87038, 117542, 148046, 178550, 209054 |
| 5817 | ADN26098 | 19848 | 50352 | 80856, 111360, 141864, 172368, 202872 | 12000 | BAF46324 | 26031 | 56535 | 87039, 117543, 148047, 178551, 209055 |
| 5818 | ADN26099 | 19849 | 50353 | 80857, 111361, 141865, 172369, 202873 | 12001 | BAF46332 | 26032 | 56536 | 87040, 117544, 148048, 178552, 209056 |
| 5819 | ADN26100 | 19850 | 50354 | 80858, 111362, 141866, 172370, 202874 | 12002 | BAF46334 | 26033 | 56537 | 87041, 117545, 148049, 178553, 209057 |
| 5820 | ADN26101 | 19851 | 50355 | 80859, 111363, 141867, 172371, 202875 | 12003 | BAF46335 | 26034 | 56538 | 87042, 117546, 148050, 178554, 209058 |
| 5821 | ADN26102 | 19852 | 50356 | 80860, 111364, 141868, 172372, 202876 | 12004 | BAF46337 | 26035 | 56539 | 87043, 117547, 148051, 178555, 209059 |
| 5822 | ADN26103 | 19853 | 50357 | 80861, 111365, 141869, 172373, 202877 | 12005 | BAF46345 | 26036 | 56540 | 87044, 117548, 148052, 178556, 209060 |
| 5823 | ADN26104 | 19854 | 50358 | 80862, 111366, 141870, 172374, 202878 | 12006 | BAF46346 | 26037 | 56541 | 87045, 117549, 148053, 178557, 209061 |
| 5824 | ADN26105 | 19855 | 50359 | 80863, 111367, 141871, 172375, 202879 | 12007 | BAF46347 | 26038 | 56542 | 87046, 117550, 148054, 178558, 209062 |
| 5825 | ADN26106 | 19856 | 50360 | 80864, 111368, 141872, 172376, 202880 | 12008 | BAF46349 | 26039 | 56543 | 87047, 117551, 148055, 178559, 209063 |

FIG. 3 continued

| | | | | | | | | | |
|---|---|---|---|---|---|---|---|---|---|
| 5826 | ADN26107 | 19857 | 50361 | 80865, 111369, 141873, 172377, 202881 | 12009 | BAF46350 | 26040 | 56544 | 87048, 117552, 148056, 178560, 209064 |
| 5827 | ADN26108 | 19858 | 50362 | 80866, 111370, 141874, 172378, 202882 | 12010 | BAF46351 | 26041 | 56545 | 87049, 117553, 148057, 178561, 209065 |
| 5828 | ADN26109 | 19859 | 50363 | 80867, 111371, 141875, 172379, 202883 | 12011 | BAF46368 | 26042 | 56546 | 87050, 117554, 148058, 178562, 209066 |
| 5829 | ADN26110 | 19860 | 50364 | 80868, 111372, 141876, 172380, 202884 | 12012 | BAF46369 | 26043 | 56547 | 87051, 117555, 148059, 178563, 209067 |
| 5830 | ADN26111 | 19861 | 50365 | 80869, 111373, 141877, 172381, 202885 | 12013 | BAF46370 | 26044 | 56548 | 87052, 117556, 148060, 178564, 209068 |
| 5831 | ADN26112 | 19862 | 50366 | 80870, 111374, 141878, 172382, 202886 | 12014 | BAF46371 | 26045 | 56549 | 87053, 117557, 148061, 178565, 209069 |
| 5832 | ADN26113 | 19863 | 50367 | 80871, 111375, 141879, 172383, 202887 | 12015 | BAF46372 | 26046 | 56550 | 87054, 117558, 148062, 178566, 209070 |
| 5833 | ADN26114 | 19864 | 50368 | 80872, 111376, 141880, 172384, 202888 | 12016 | BAF46385 | 26047 | 56551 | 87055, 117559, 148063, 178567, 209071 |
| 5834 | ADN26115 | 19865 | 50369 | 80873, 111377, 141881, 172385, 202889 | 12017 | BAF46386 | 26048 | 56552 | 87056, 117560, 148064, 178568, 209072 |
| 5835 | ADN26116 | 19866 | 50370 | 80874, 111378, 141882, 172386, 202890 | 12018 | BAF46387 | 26049 | 56553 | 87057, 117561, 148065, 178569, 209073 |
| 5836 | ADN26117 | 19867 | 50371 | 80875, 111379, 141883, 172387, 202891 | 12019 | BAF46388 | 26050 | 56554 | 87058, 117562, 148066, 178570, 209074 |
| 5837 | ADN26118 | 19868 | 50372 | 80876, 111380, 141884, 172388, 202892 | 12020 | BAF47922 | 26051 | 56555 | 87059, 117563, 148067, 178571, 209075 |
| 5838 | ADN26119 | 19869 | 50373 | 80877, 111381, 141885, 172389, 202893 | 12021 | BAF47923 | 26052 | 56556 | 87060, 117564, 148068, 178572, 209076 |
| 5839 | ADN26120 | 19870 | 50374 | 80878, 111382, 141886, 172390, 202894 | 12022 | BAF47924 | 26053 | 56557 | 87061, 117565, 148069, 178573, 209077 |
| 5840 | ADN26121 | 19871 | 50375 | 80879, 111383, 141887, 172391, 202895 | 12023 | BAF47925 | 26054 | 56558 | 87062, 117566, 148070, 178574, 209078 |
| 5841 | ADN26122 | 19872 | 50376 | 80880, 111384, 141888, 172392, 202896 | 12024 | BAF47926 | 26055 | 56559 | 87063, 117567, 148071, 178575, 209079 |
| 5842 | ADN26123 | 19873 | 50377 | 80881, 111385, 141889, 172393, 202897 | 12025 | BAF47927 | 26056 | 56560 | 87064, 117568, 148072, 178576, 209080 |
| 5843 | ADN26124 | 19874 | 50378 | 80882, 111386, 141890, 172394, 202898 | 12026 | BAF47928 | 26057 | 56561 | 87065, 117569, 148073, 178577, 209081 |

FIG. 3 continued

| | | | | | | | | | |
|---|---|---|---|---|---|---|---|---|---|
| 5844 | ADN26125 | 19875 | 50379 | 80883, 111387, 141891, 172395, 202899 | 12027 | BAF47929 | 26058 | 56562 | 87066, 117570, 148074, 178578, 209082 |
| 5845 | ADN26126 | 19876 | 50380 | 80884, 111388, 141892, 172396, 202900 | 12028 | BAF47930 | 26059 | 56563 | 87067, 117571, 148075, 178579, 209083 |
| 5846 | ADN26127 | 19877 | 50381 | 80885, 111389, 141893, 172397, 202901 | 12029 | BAF47931 | 26060 | 56564 | 87068, 117572, 148076, 178580, 209084 |
| 5847 | ADN26128 | 19878 | 50382 | 80886, 111390, 141894, 172398, 202902 | 12030 | BAF47932 | 26061 | 56565 | 87069, 117573, 148077, 178581, 209085 |
| 5848 | ADN26129 | 19879 | 50383 | 80887, 111391, 141895, 172399, 202903 | 12031 | BAF47933 | 26062 | 56566 | 87070, 117574, 148078, 178582, 209086 |
| 5849 | ADN26130 | 19880 | 50384 | 80888, 111392, 141896, 172400, 202904 | 12032 | BAF47934 | 26063 | 56567 | 87071, 117575, 148079, 178583, 209087 |
| 5850 | ADN26131 | 19881 | 50385 | 80889, 111393, 141897, 172401, 202905 | 12033 | BAF47935 | 26064 | 56568 | 87072, 117576, 148080, 178584, 209088 |
| 5851 | ADN26132 | 19882 | 50386 | 80890, 111394, 141898, 172402, 202906 | 12034 | BAF47936 | 26065 | 56569 | 87073, 117577, 148081, 178585, 209089 |
| 5852 | ADN26134 | 19883 | 50387 | 80891, 111395, 141899, 172403, 202907 | 12035 | BAF47937 | 26066 | 56570 | 87074, 117578, 148082, 178586, 209090 |
| 5853 | ADN26135 | 19884 | 50388 | 80892, 111396, 141900, 172404, 202908 | 12036 | BAF47938 | 26067 | 56571 | 87075, 117579, 148083, 178587, 209091 |
| 5854 | ADN26136 | 19885 | 50389 | 80893, 111397, 141901, 172405, 202909 | 12037 | BAF47939 | 26068 | 56572 | 87076, 117580, 148084, 178588, 209092 |
| 5855 | ADN26137 | 19886 | 50390 | 80894, 111398, 141902, 172406, 202910 | 12038 | BAF47940 | 26069 | 56573 | 87077, 117581, 148085, 178589, 209093 |
| 5856 | ADN26138 | 19887 | 50391 | 80895, 111399, 141903, 172407, 202911 | 12039 | BAF47941 | 26070 | 56574 | 87078, 117582, 148086, 178590, 209094 |
| 5857 | ADN26140 | 19888 | 50392 | 80896, 111400, 141904, 172408, 202912 | 12040 | BAF47943 | 26071 | 56575 | 87079, 117583, 148087, 178591, 209095 |
| 5858 | ADN26141 | 19889 | 50393 | 80897, 111401, 141905, 172409, 202913 | 12041 | BAF47944 | 26072 | 56576 | 87080, 117584, 148088, 178592, 209096 |
| 5859 | ADN26142 | 19890 | 50394 | 80898, 111402, 141906, 172410, 202914 | 12042 | BAF47945 | 26073 | 56577 | 87081, 117585, 148089, 178593, 209097 |
| 5860 | ADN26143 | 19891 | 50395 | 80899, 111403, 141907, 172411, 202915 | 12043 | BAF47946 | 26074 | 56578 | 87082, 117586, 148090, 178594, 209098 |
| 5861 | ADN26144 | 19892 | 50396 | 80900, 111404, 141908, 172412, 202916 | 12044 | BAF47948 | 26075 | 56579 | 87083, 117587, 148091, 178595, 209099 |

FIG. 3 continued

| | | | | | | | | | |
|---|---|---|---|---|---|---|---|---|---|
| 5862 | ADN26145 | 19893 | 50397 | 80901, 111405, 141909, 172413, 202917 | 12045 | BAF47949 | 26076 | 56580 | 87084, 117588, 148092, 178596, 209100 |
| 5863 | ADN26146 | 19894 | 50398 | 80902, 111406, 141910, 172414, 202918 | 12046 | BAF47950 | 26077 | 56581 | 87085, 117589, 148093, 178597, 209101 |
| 5864 | ADN26147 | 19895 | 50399 | 80903, 111407, 141911, 172415, 202919 | 12047 | BAF47951 | 26078 | 56582 | 87086, 117590, 148094, 178598, 209102 |
| 5865 | ADN26148 | 19896 | 50400 | 80904, 111408, 141912, 172416, 202920 | 12048 | BAF47952 | 26079 | 56583 | 87087, 117591, 148095, 178599, 209103 |
| 5866 | ADN26149 | 19897 | 50401 | 80905, 111409, 141913, 172417, 202921 | 12049 | BAF47953 | 26080 | 56584 | 87088, 117592, 148096, 178600, 209104 |
| 5867 | ADN26150 | 19898 | 50402 | 80906, 111410, 141914, 172418, 202922 | 12050 | BAF47954 | 26081 | 56585 | 87089, 117593, 148097, 178601, 209105 |
| 5868 | ADN26151 | 19899 | 50403 | 80907, 111411, 141915, 172419, 202923 | 12051 | BAF47955 | 26082 | 56586 | 87090, 117594, 148098, 178602, 209106 |
| 5869 | ADN26152 | 19900 | 50404 | 80908, 111412, 141916, 172420, 202924 | 12052 | BAF47956 | 26083 | 56587 | 87091, 117595, 148099, 178603, 209107 |
| 5870 | ADN26153 | 19901 | 50405 | 80909, 111413, 141917, 172421, 202925 | 12053 | BAF47958 | 26084 | 56588 | 87092, 117596, 148100, 178604, 209108 |
| 5871 | ADN26154 | 19902 | 50406 | 80910, 111414, 141918, 172422, 202926 | 12054 | BAF47959 | 26085 | 56589 | 87093, 117597, 148101, 178605, 209109 |
| 5872 | ADN26155 | 19903 | 50407 | 80911, 111415, 141919, 172423, 202927 | 12055 | BAF47960 | 26086 | 56590 | 87094, 117598, 148102, 178606, 209110 |
| 5873 | ADN26157 | 19904 | 50408 | 80912, 111416, 141920, 172424, 202928 | 12056 | BAF47975 | 26087 | 56591 | 87095, 117599, 148103, 178607, 209111 |
| 5874 | ADN26159 | 19905 | 50409 | 80913, 111417, 141921, 172425, 202929 | 12057 | BAF47976 | 26088 | 56592 | 87096, 117600, 148104, 178608, 209112 |
| 5875 | ADN26161 | 19906 | 50410 | 80914, 111418, 141922, 172426, 202930 | 12058 | BAF47977 | 26089 | 56593 | 87097, 117601, 148105, 178609, 209113 |
| 5876 | ADN26162 | 19907 | 50411 | 80915, 111419, 141923, 172427, 202931 | 12059 | BAF47978 | 26090 | 56594 | 87098, 117602, 148106, 178610, 209114 |
| 5877 | ADN26163 | 19908 | 50412 | 80916, 111420, 141924, 172428, 202932 | 12060 | BAF47979 | 26091 | 56595 | 87099, 117603, 148107, 178611, 209115 |
| 5878 | ADN26164 | 19909 | 50413 | 80917, 111421, 141925, 172429, 202933 | 12061 | BAF47980 | 26092 | 56596 | 87100, 117604, 148108, 178612, 209116 |
| 5879 | ADN26168 | 19910 | 50414 | 80918, 111422, 141926, 172430, 202934 | 12062 | BAF47981 | 26093 | 56597 | 87101, 117605, 148109, 178613, 209117 |

FIG. 3 continued

| | | | | | | | | | |
|---|---|---|---|---|---|---|---|---|---|
| 5880 | ADN26178 | 19911 | 50415 | 80919, 111423, 141927, 172431, 202935 | 12063 | BAF47982 | 26094 | 56598 | 87102, 117606, 148110, 178614, 209118 |
| 5881 | ADN26868 | 19912 | 50416 | 80920, 111424, 141928, 172432, 202936 | 12064 | BAF47983 | 26095 | 56599 | 87103, 117607, 148111, 178615, 209119 |
| 5882 | ADN26869 | 19913 | 50417 | 80921, 111425, 141929, 172433, 202937 | 12065 | BAF47984 | 26096 | 56600 | 87104, 117608, 148112, 178616, 209120 |
| 5883 | ADN26870 | 19914 | 50418 | 80922, 111426, 141930, 172434, 202938 | 12066 | BAF47985 | 26097 | 56601 | 87105, 117609, 148113, 178617, 209121 |
| 5884 | ADN26871 | 19915 | 50419 | 80923, 111427, 141931, 172435, 202939 | 12067 | BAF47986 | 26098 | 56602 | 87106, 117610, 148114, 178618, 209122 |
| 5885 | ADN26872 | 19916 | 50420 | 80924, 111428, 141932, 172436, 202940 | 12068 | BAF47987 | 26099 | 56603 | 87107, 117611, 148115, 178619, 209123 |
| 5886 | ADN26873 | 19917 | 50421 | 80925, 111429, 141933, 172437, 202941 | 12069 | BAF47988 | 26100 | 56604 | 87108, 117612, 148116, 178620, 209124 |
| 5887 | ADN26874 | 19918 | 50422 | 80926, 111430, 141934, 172438, 202942 | 12070 | BAF47989 | 26101 | 56605 | 87109, 117613, 148117, 178621, 209125 |
| 5888 | ADN26875 | 19919 | 50423 | 80927, 111431, 141935, 172439, 202943 | 12071 | BAF47990 | 26102 | 56606 | 87110, 117614, 148118, 178622, 209126 |
| 5889 | ADN26876 | 19920 | 50424 | 80928, 111432, 141936, 172440, 202944 | 12072 | BAF47991 | 26103 | 56607 | 87111, 117615, 148119, 178623, 209127 |
| 5890 | ADN26877 | 19921 | 50425 | 80929, 111433, 141937, 172441, 202945 | 12073 | BAF47992 | 26104 | 56608 | 87112, 117616, 148120, 178624, 209128 |
| 5891 | ADN26878 | 19922 | 50426 | 80930, 111434, 141938, 172442, 202946 | 12074 | BAF47993 | 26105 | 56609 | 87113, 117617, 148121, 178625, 209129 |
| 5892 | ADN26879 | 19923 | 50427 | 80931, 111435, 141939, 172443, 202947 | 12075 | BAF47994 | 26106 | 56610 | 87114, 117618, 148122, 178626, 209130 |
| 5893 | ADN26880 | 19924 | 50428 | 80932, 111436, 141940, 172444, 202948 | 12076 | BAF47995 | 26107 | 56611 | 87115, 117619, 148123, 178627, 209131 |
| 5894 | ADN26881 | 19925 | 50429 | 80933, 111437, 141941, 172445, 202949 | 12077 | BAF47996 | 26108 | 56612 | 87116, 117620, 148124, 178628, 209132 |
| 5895 | ADN26882 | 19926 | 50430 | 80934, 111438, 141942, 172446, 202950 | 12078 | BAF47997 | 26109 | 56613 | 87117, 117621, 148125, 178629, 209133 |
| 5896 | ADN26883 | 19927 | 50431 | 80935, 111439, 141943, 172447, 202951 | 12079 | BAF57504 | 26110 | 56614 | 87118, 117622, 148126, 178630, 209134 |
| 5897 | ADN89064 | 19928 | 50432 | 80936, 111440, 141944, 172448, 202952 | 12080 | BAF57508 | 26111 | 56615 | 87119, 117623, 148127, 178631, 209135 |

FIG. 3 continued

| | | | | | | | | | |
|---|---|---|---|---|---|---|---|---|---|
| 5898 | ADN89075 | 19929 | 50433 | 80937, 111441, 141945, 172449, 202953 | 12081 | BAF57511 | 26112 | 56616 | 87120, 117624, 148128, 178632, 209136 |
| 5899 | ADN89086 | 19930 | 50434 | 80938, 111442, 141946, 172450, 202954 | 12082 | BAF57515 | 26113 | 56617 | 87121, 117625, 148129, 178633, 209137 |
| 5900 | ADN89097 | 19931 | 50435 | 80939, 111443, 141947, 172451, 202955 | 12083 | BAF57522 | 26114 | 56618 | 87122, 117626, 148130, 178634, 209138 |
| 5901 | ADN89108 | 19932 | 50436 | 80940, 111444, 141948, 172452, 202956 | 12084 | BAF57529 | 26115 | 56619 | 87123, 117627, 148131, 178635, 209139 |
| 5902 | ADN89119 | 19933 | 50437 | 80941, 111445, 141949, 172453, 202957 | 12085 | BAF57532 | 26116 | 56620 | 87124, 117628, 148132, 178636, 209140 |
| 5903 | ADN89130 | 19934 | 50438 | 80942, 111446, 141950, 172454, 202958 | 12086 | BAF57536 | 26117 | 56621 | 87125, 117629, 148133, 178637, 209141 |
| 5904 | ADN89141 | 19935 | 50439 | 80943, 111447, 141951, 172455, 202959 | 12087 | BAF57539 | 26118 | 56622 | 87126, 117630, 148134, 178638, 209142 |
| 5905 | ADN89152 | 19936 | 50440 | 80944, 111448, 141952, 172456, 202960 | 12088 | BAF57543 | 26119 | 56623 | 87127, 117631, 148135, 178639, 209143 |
| 5906 | ADN89163 | 19937 | 50441 | 80945, 111449, 141953, 172457, 202961 | 12089 | BAF57547 | 26120 | 56624 | 87128, 117632, 148136, 178640, 209144 |
| 5907 | ADN89174 | 19938 | 50442 | 80946, 111450, 141954, 172458, 202962 | 12090 | BAF57551 | 26121 | 56625 | 87129, 117633, 148137, 178641, 209145 |
| 5908 | ADN89185 | 19939 | 50443 | 80947, 111451, 141955, 172459, 202963 | 12091 | BAF57555 | 26122 | 56626 | 87130, 117634, 148138, 178642, 209146 |
| 5909 | ADN89196 | 19940 | 50444 | 80948, 111452, 141956, 172460, 202964 | 12092 | BAF57559 | 26123 | 56627 | 87131, 117635, 148139, 178643, 209147 |
| 5910 | ADN89207 | 19941 | 50445 | 80949, 111453, 141957, 172461, 202965 | 12093 | BAF57563 | 26124 | 56628 | 87132, 117636, 148140, 178644, 209148 |
| 5911 | ADN89218 | 19942 | 50446 | 80950, 111454, 141958, 172462, 202966 | 12094 | BAF57571 | 26125 | 56629 | 87133, 117637, 148141, 178645, 209149 |
| 5912 | ADN89229 | 19943 | 50447 | 80951, 111455, 141959, 172463, 202967 | 12095 | BAF57575 | 26126 | 56630 | 87134, 117638, 148142, 178646, 209150 |
| 5913 | ADN89240 | 19944 | 50448 | 80952, 111456, 141960, 172464, 202968 | 12096 | BAF57579 | 26127 | 56631 | 87135, 117639, 148143, 178647, 209151 |
| 5914 | ADN89251 | 19945 | 50449 | 80953, 111457, 141961, 172465, 202969 | 12097 | BAF57583 | 26128 | 56632 | 87136, 117640, 148144, 178648, 209152 |
| 5915 | ADN89262 | 19946 | 50450 | 80954, 111458, 141962, 172466, 202970 | 12098 | BAF57587 | 26129 | 56633 | 87137, 117641, 148145, 178649, 209153 |

FIG. 3 continued

| | | | | | | | | | |
|---|---|---|---|---|---|---|---|---|---|
| 5916 | ADN89273 | 19947 | 50451 | 80955, 111459, 141963, 172467, 202971 | 12099 | BAF57591 | 26130 | 56634 | 87138, 117642, 148146, 178650, 209154 |
| 5917 | ADN89284 | 19948 | 50452 | 80956, 111460, 141964, 172468, 202972 | 12100 | BAF57595 | 26131 | 56635 | 87139, 117643, 148147, 178651, 209155 |
| 5918 | ADN89295 | 19949 | 50453 | 80957, 111461, 141965, 172469, 202973 | 12101 | BAF57599 | 26132 | 56636 | 87140, 117644, 148148, 178652, 209156 |
| 5919 | ADN89306 | 19950 | 50454 | 80958, 111462, 141966, 172470, 202974 | 12102 | BAF57603 | 26133 | 56637 | 87141, 117645, 148149, 178653, 209157 |
| 5920 | ADN89317 | 19951 | 50455 | 80959, 111463, 141967, 172471, 202975 | 12103 | BAF62620 | 26134 | 56638 | 87142, 117646, 148150, 178654, 209158 |
| 5921 | ADN89328 | 19952 | 50456 | 80960, 111464, 141968, 172472, 202976 | 12104 | BAF63036 | 26135 | 56639 | 87143, 117647, 148151, 178655, 209159 |
| 5922 | ADN89339 | 19953 | 50457 | 80961, 111465, 141969, 172473, 202977 | 12105 | BAF63040 | 26136 | 56640 | 87144, 117648, 148152, 178656, 209160 |
| 5923 | ADN89350 | 19954 | 50458 | 80962, 111466, 141970, 172474, 202978 | 12106 | BAF63047 | 26137 | 56641 | 87145, 117649, 148153, 178657, 209161 |
| 5924 | ADN89361 | 19955 | 50459 | 80963, 111467, 141971, 172475, 202979 | 12107 | BAF63058 | 26138 | 56642 | 87146, 117650, 148154, 178658, 209162 |
| 5925 | ADN89372 | 19956 | 50460 | 80964, 111468, 141972, 172476, 202980 | 12108 | BAF63065 | 26139 | 56643 | 87147, 117651, 148155, 178659, 209163 |
| 5926 | ADN89383 | 19957 | 50461 | 80965, 111469, 141973, 172477, 202981 | 12109 | BAF63069 | 26140 | 56644 | 87148, 117652, 148156, 178660, 209164 |
| 5927 | ADN89405 | 19958 | 50462 | 80966, 111470, 141974, 172478, 202982 | 12110 | BAF63079 | 26141 | 56645 | 87149, 117653, 148157, 178661, 209165 |
| 5928 | ADN89416 | 19959 | 50463 | 80967, 111471, 141975, 172479, 202983 | 12111 | BAF63092 | 26142 | 56646 | 87150, 117654, 148158, 178662, 209166 |
| 5929 | ADN89427 | 19960 | 50464 | 80968, 111472, 141976, 172480, 202984 | 12112 | BAF63098 | 26143 | 56647 | 87151, 117655, 148159, 178663, 209167 |
| 5930 | ADN89438 | 19961 | 50465 | 80969, 111473, 141977, 172481, 202985 | 12113 | BAF63104 | 26144 | 56648 | 87152, 117656, 148160, 178664, 209168 |
| 5931 | ADN89449 | 19962 | 50466 | 80970, 111474, 141978, 172482, 202986 | 12114 | BAF63112 | 26145 | 56649 | 87153, 117657, 148161, 178665, 209169 |
| 5932 | ADN89460 | 19963 | 50467 | 80971, 111475, 141979, 172483, 202987 | 12115 | BAF63116 | 26146 | 56650 | 87154, 117658, 148162, 178666, 209170 |
| 5933 | ADN89482 | 19964 | 50468 | 80972, 111476, 141980, 172484, 202988 | 12116 | BAF63124 | 26147 | 56651 | 87155, 117659, 148163, 178667, 209171 |

FIG. 3 continued

| | | | | | | | | | |
|---|---|---|---|---|---|---|---|---|---|
| 5934 | ADN89493 | 19965 | 50469 | 80973, 111477, 141981, 172485, 202989 | 12117 | BAF63132 | 26148 | 56652 | 87156, 117660, 148164, 178668, 209172 |
| 5935 | ADN89504 | 19966 | 50470 | 80974, 111478, 141982, 172486, 202990 | 12118 | BAF63136 | 26149 | 56653 | 87157, 117661, 148165, 178669, 209173 |
| 5936 | ADN89515 | 19967 | 50471 | 80975, 111479, 141983, 172487, 202991 | 12119 | BAH24021 | 26150 | 56654 | 87158, 117662, 148166, 178670, 209174 |
| 5937 | ADN89526 | 19968 | 50472 | 80976, 111480, 141984, 172488, 202992 | 12120 | BAH95825 | 26151 | 56655 | 87159, 117663, 148167, 178671, 209175 |
| 5938 | ADN89537 | 19969 | 50473 | 80977, 111481, 141985, 172489, 202993 | 12121 | BAH95826 | 26152 | 56656 | 87160, 117664, 148168, 178672, 209176 |
| 5939 | ADN89548 | 19970 | 50474 | 80978, 111482, 141986, 172490, 202994 | 12122 | BAJ07994 | 26153 | 56657 | 87161, 117665, 148169, 178673, 209177 |
| 5940 | ADN89570 | 19971 | 50475 | 80979, 111483, 141987, 172491, 202995 | 12123 | BAK23415 | 26154 | 56658 | 87162, 117666, 148170, 178674, 209178 |
| 5941 | ADN89581 | 19972 | 50476 | 80980, 111484, 141988, 172492, 202996 | 12124 | BAK23416 | 26155 | 56659 | 87163, 117667, 148171, 178675, 209179 |
| 5942 | ADN89592 | 19973 | 50477 | 80981, 111485, 141989, 172493, 202997 | 12125 | BAK23417 | 26156 | 56660 | 87164, 117668, 148172, 178676, 209180 |
| 5943 | ADN89603 | 19974 | 50478 | 80982, 111486, 141990, 172494, 202998 | 12126 | BAK23418 | 26157 | 56661 | 87165, 117669, 148173, 178677, 209181 |
| 5944 | ADN89614 | 19975 | 50479 | 80983, 111487, 141991, 172495, 202999 | 12127 | BAK23420 | 26158 | 56662 | 87166, 117670, 148174, 178678, 209182 |
| 5945 | ADN89625 | 19976 | 50480 | 80984, 111488, 141992, 172496, 203000 | 12128 | BAK23421 | 26159 | 56663 | 87167, 117671, 148175, 178679, 209183 |
| 5946 | ADN89636 | 19977 | 50481 | 80985, 111489, 141993, 172497, 203001 | 12129 | BAK23422 | 26160 | 56664 | 87168, 117672, 148176, 178680, 209184 |
| 5947 | ADN89647 | 19978 | 50482 | 80986, 111490, 141994, 172498, 203002 | 12130 | BAK23423 | 26161 | 56665 | 87169, 117673, 148177, 178681, 209185 |
| 5948 | ADN89658 | 19979 | 50483 | 80987, 111491, 141995, 172499, 203003 | 12131 | BAK23424 | 26162 | 56666 | 87170, 117674, 148178, 178682, 209186 |
| 5949 | ADN89669 | 19980 | 50484 | 80988, 111492, 141996, 172500, 203004 | 12132 | BAK23425 | 26163 | 56667 | 87171, 117675, 148179, 178683, 209187 |
| 5950 | ADN89680 | 19981 | 50485 | 80989, 111493, 141997, 172501, 203005 | 12133 | BAK23426 | 26164 | 56668 | 87172, 117676, 148180, 178684, 209188 |
| 5951 | ADN89691 | 19982 | 50486 | 80990, 111494, 141998, 172502, 203006 | 12134 | BAK23427 | 26165 | 56669 | 87173, 117677, 148181, 178685, 209189 |

FIG. 3 continued

| | | | | | | | | | |
|---|---|---|---|---|---|---|---|---|---|
| 5952 | ADN89702 | 19983 | 50487 | 80991, 111495, 141999, 172503, 203007 | 12135 | BAK23428 | 26166 | 56670 | 87174, 117678, 148182, 178686, 209190 |
| 5953 | ADN89713 | 19984 | 50488 | 80992, 111496, 142000, 172504, 203008 | 12136 | BAK23429 | 26167 | 56671 | 87175, 117679, 148183, 178687, 209191 |
| 5954 | ADN89724 | 19985 | 50489 | 80993, 111497, 142001, 172505, 203009 | 12137 | BAK23430 | 26168 | 56672 | 87176, 117680, 148184, 178688, 209192 |
| 5955 | ADN89735 | 19986 | 50490 | 80994, 111498, 142002, 172506, 203010 | 12138 | BAK23431 | 26169 | 56673 | 87177, 117681, 148185, 178689, 209193 |
| 5956 | ADN89746 | 19987 | 50491 | 80995, 111499, 142003, 172507, 203011 | 12139 | BAK23432 | 26170 | 56674 | 87178, 117682, 148186, 178690, 209194 |
| 5957 | ADN89757 | 19988 | 50492 | 80996, 111500, 142004, 172508, 203012 | 12140 | BAK23433 | 26171 | 56675 | 87179, 117683, 148187, 178691, 209195 |
| 5958 | ADN89768 | 19989 | 50493 | 80997, 111501, 142005, 172509, 203013 | 12141 | BAM65748 | 26172 | 56676 | 87180, 117684, 148188, 178692, 209196 |
| 5959 | ADN89779 | 19990 | 50494 | 80998, 111502, 142006, 172510, 203014 | 12142 | BAM85817 | 26173 | 56677 | 87181, 117685, 148189, 178693, 209197 |
| 5960 | ADN89790 | 19991 | 50495 | 80999, 111503, 142007, 172511, 203015 | 12143 | BAM85818 | 26174 | 56678 | 87182, 117686, 148190, 178694, 209198 |
| 5961 | ADN89801 | 19992 | 50496 | 81000, 111504, 142008, 172512, 203016 | 12144 | BAM85819 | 26175 | 56679 | 87183, 117687, 148191, 178695, 209199 |
| 5962 | ADN89823 | 19993 | 50497 | 81001, 111505, 142009, 172513, 203017 | 12145 | BAM85820 | 26176 | 56680 | 87184, 117688, 148192, 178696, 209200 |
| 5963 | ADN89834 | 19994 | 50498 | 81002, 111506, 142010, 172514, 203018 | 12146 | BAM85821 | 26177 | 56681 | 87185, 117689, 148193, 178697, 209201 |
| 5964 | ADN89845 | 19995 | 50499 | 81003, 111507, 142011, 172515, 203019 | 12147 | BAM85822 | 26178 | 56682 | 87186, 117690, 148194, 178698, 209202 |
| 5965 | ADN89856 | 19996 | 50500 | 81004, 111508, 142012, 172516, 203020 | 12148 | BAM85823 | 26179 | 56683 | 87187, 117691, 148195, 178699, 209203 |
| 5966 | ADN89867 | 19997 | 50501 | 81005, 111509, 142013, 172517, 203021 | 12149 | BAM85824 | 26180 | 56684 | 87188, 117692, 148196, 178700, 209204 |
| 5967 | ADN89878 | 19998 | 50502 | 81006, 111510, 142014, 172518, 203022 | 12150 | BAM85825 | 26181 | 56685 | 87189, 117693, 148197, 178701, 209205 |
| 5968 | ADN89889 | 19999 | 50503 | 81007, 111511, 142015, 172519, 203023 | 12151 | BAM85826 | 26182 | 56686 | 87190, 117694, 148198, 178702, 209206 |
| 5969 | ADN89900 | 20000 | 50504 | 81008, 111512, 142016, 172520, 203024 | 12152 | BAM85827 | 26183 | 56687 | 87191, 117695, 148199, 178703, 209207 |

FIG. 3 continued

| | | | | | | | | | |
|---|---|---|---|---|---|---|---|---|---|
| 5970 | ADN89911 | 20001 | 50505 | 81009, 111513, 142017, 172521, 203025 | 12153 | BAM85828 | 26184 | 56688 | 87192, 117696, 148200, 178704, 209208 |
| 5971 | ADN89922 | 20002 | 50506 | 81010, 111514, 142018, 172522, 203026 | 12154 | BAM85829 | 26185 | 56689 | 87193, 117697, 148201, 178705, 209209 |
| 5972 | ADN89933 | 20003 | 50507 | 81011, 111515, 142019, 172523, 203027 | 12155 | BAM85830 | 26186 | 56690 | 87194, 117698, 148202, 178706, 209210 |
| 5973 | ADN89955 | 20004 | 50508 | 81012, 111516, 142020, 172524, 203028 | 12156 | BAM85831 | 26187 | 56691 | 87195, 117699, 148203, 178707, 209211 |
| 5974 | ADN89966 | 20005 | 50509 | 81013, 111517, 142021, 172525, 203029 | 12157 | BAM85832 | 26188 | 56692 | 87196, 117700, 148204, 178708, 209212 |
| 5975 | ADN89977 | 20006 | 50510 | 81014, 111518, 142022, 172526, 203030 | 12158 | BAM85833 | 26189 | 56693 | 87197, 117701, 148205, 178709, 209213 |
| 5976 | ADN89988 | 20007 | 50511 | 81015, 111519, 142023, 172527, 203031 | 12159 | BAM85834 | 26190 | 56694 | 87198, 117702, 148206, 178710, 209214 |
| 5977 | ADN89999 | 20008 | 50512 | 81016, 111520, 142024, 172528, 203032 | 12160 | BAM85835 | 26191 | 56695 | 87199, 117703, 148207, 178711, 209215 |
| 5978 | ADN90010 | 20009 | 50513 | 81017, 111521, 142025, 172529, 203033 | 12161 | BAM85836 | 26192 | 56696 | 87200, 117704, 148208, 178712, 209216 |
| 5979 | ADN90021 | 20010 | 50514 | 81018, 111522, 142026, 172530, 203034 | 12162 | BAO79717 | 26193 | 56697 | 87201, 117705, 148209, 178713, 209217 |
| 5980 | ADN90032 | 20011 | 50515 | 81019, 111523, 142027, 172531, 203035 | 12163 | CAA33354 | 26194 | 56698 | 87202, 117706, 148210, 178714, 209218 |
| 5981 | ADN90043 | 20012 | 50516 | 81020, 111524, 142028, 172532, 203036 | 12164 | CAB95858 | 26195 | 56699 | 87203, 117707, 148211, 178715, 209219 |
| 5982 | ADN90054 | 20013 | 50517 | 81021, 111525, 142029, 172533, 203037 | 12165 | CAB95859 | 26196 | 56700 | 87204, 117708, 148212, 178716, 209220 |
| 5983 | ADN90065 | 20014 | 50518 | 81022, 111526, 142030, 172534, 203038 | 12166 | CAC19707 | 26197 | 56701 | 87205, 117709, 148213, 178717, 209221 |
| 5984 | ADN90076 | 20015 | 50519 | 81023, 111527, 142031, 172535, 203039 | 12167 | CAD29959 | 26198 | 56702 | 87206, 117710, 148214, 178718, 209222 |
| 5985 | ADN90087 | 20016 | 50520 | 81024, 111528, 142032, 172536, 203040 | 12168 | CAD29960 | 26199 | 56703 | 87207, 117711, 148215, 178719, 209223 |
| 5986 | ADN90098 | 20017 | 50521 | 81025, 111529, 142033, 172537, 203041 | 12169 | CAD29961 | 26200 | 56704 | 87208, 117712, 148216, 178720, 209224 |
| 5987 | ADN90109 | 20018 | 50522 | 81026, 111530, 142034, 172538, 203042 | 12170 | CAD29962 | 26201 | 56705 | 87209, 117713, 148217, 178721, 209225 |

FIG. 3 continued

| | | | | | | | | | |
|---|---|---|---|---|---|---|---|---|---|
| 5988 | ADN90120 | 20019 | 50523 | 81027, 111531, 142035, 172539, 203043 | 12171 | CAD29963 | 26202 | 56706 | 87210, 117714, 148218, 178722, 209226 |
| 5989 | ADN90131 | 20020 | 50524 | 81028, 111532, 142036, 172540, 203044 | 12172 | CAD29964 | 26203 | 56707 | 87211, 117715, 148219, 178723, 209227 |
| 5990 | ADN90142 | 20021 | 50525 | 81029, 111533, 142037, 172541, 203045 | 12173 | CAD29965 | 26204 | 56708 | 87212, 117716, 148220, 178724, 209228 |
| 5991 | ADN90153 | 20022 | 50526 | 81030, 111534, 142038, 172542, 203046 | 12174 | CAD29966 | 26205 | 56709 | 87213, 117717, 148221, 178725, 209229 |
| 5992 | ADN90164 | 20023 | 50527 | 81031, 111535, 142039, 172543, 203047 | 12175 | CAD29967 | 26206 | 56710 | 87214, 117718, 148222, 178726, 209230 |
| 5993 | ADN90186 | 20024 | 50528 | 81032, 111536, 142040, 172544, 203048 | 12176 | CAD29968 | 26207 | 56711 | 87215, 117719, 148223, 178727, 209231 |
| 5994 | ADN90197 | 20025 | 50529 | 81033, 111537, 142041, 172545, 203049 | 12177 | CAD29969 | 26208 | 56712 | 87216, 117720, 148224, 178728, 209232 |
| 5995 | ADN90208 | 20026 | 50530 | 81034, 111538, 142042, 172546, 203050 | 12178 | CAD29970 | 26209 | 56713 | 87217, 117721, 148225, 178729, 209233 |
| 5996 | ADN90219 | 20027 | 50531 | 81035, 111539, 142043, 172547, 203051 | 12179 | CAD29971 | 26210 | 56714 | 87218, 117722, 148226, 178730, 209234 |
| 5997 | ADN92469 | 20028 | 50532 | 81036, 111540, 142044, 172548, 203052 | 12180 | CAD29972 | 26211 | 56715 | 87219, 117723, 148227, 178731, 209235 |
| 5998 | ADN92480 | 20029 | 50533 | 81037, 111541, 142045, 172549, 203053 | 12181 | CAD29973 | 26212 | 56716 | 87220, 117724, 148228, 178732, 209236 |
| 5999 | ADN92491 | 20030 | 50534 | 81038, 111542, 142046, 172550, 203054 | 12182 | CAD29974 | 26213 | 56717 | 87221, 117725, 148229, 178733, 209237 |
| 6000 | ADN92502 | 20031 | 50535 | 81039, 111543, 142047, 172551, 203055 | 12183 | CAD29984 | 26214 | 56718 | 87222, 117726, 148230, 178734, 209238 |
| 6001 | ADN92512 | 20032 | 50536 | 81040, 111544, 142048, 172552, 203056 | 12184 | CAD29985 | 26215 | 56719 | 87223, 117727, 148231, 178735, 209239 |
| 6002 | ADN92522 | 20033 | 50537 | 81041, 111545, 142049, 172553, 203057 | 12185 | CAD29988 | 26216 | 56720 | 87224, 117728, 148232, 178736, 209240 |
| 6003 | ADN92532 | 20034 | 50538 | 81042, 111546, 142050, 172554, 203058 | 12186 | CAD29990 | 26217 | 56721 | 87225, 117729, 148233, 178737, 209241 |
| 6004 | ADN92542 | 20035 | 50539 | 81043, 111547, 142051, 172555, 203059 | 12187 | CAD29991 | 26218 | 56722 | 87226, 117730, 148234, 178738, 209242 |
| 6005 | ADN92552 | 20036 | 50540 | 81044, 111548, 142052, 172556, 203060 | 12188 | CAD29992 | 26219 | 56723 | 87227, 117731, 148235, 178739, 209243 |

FIG. 3 continued

| | | | | | | | | | |
|---|---|---|---|---|---|---|---|---|---|
| 6006 | AD000733 | 20037 | 50541 | 81045, 111549, 142053, 172557, 203061 | 12189 | CAD29993 | 26220 | 56724 | 87228, 117732, 148236, 178740, 209244 |
| 6007 | AD000743 | 20038 | 50542 | 81046, 111550, 142054, 172558, 203062 | 12190 | CAD29994 | 26221 | 56725 | 87229, 117733, 148237, 178741, 209245 |
| 6008 | AD000753 | 20039 | 50543 | 81047, 111551, 142055, 172559, 203063 | 12191 | CAD57252 | 26222 | 56726 | 87230, 117734, 148238, 178742, 209246 |
| 6009 | AD012146 | 20040 | 50544 | 81048, 111552, 142056, 172560, 203064 | 12192 | CAD57253 | 26223 | 56727 | 87231, 117735, 148239, 178743, 209247 |
| 6010 | AD012156 | 20041 | 50545 | 81049, 111553, 142057, 172561, 203065 | 12193 | CAD57255 | 26224 | 56728 | 87232, 117736, 148240, 178744, 209248 |
| 6011 | AD012166 | 20042 | 50546 | 81050, 111554, 142058, 172562, 203066 | 12194 | CAD57256 | 26225 | 56729 | 87233, 117737, 148241, 178745, 209249 |
| 6012 | AD012176 | 20043 | 50547 | 81051, 111555, 142059, 172563, 203067 | 12195 | CAD57257 | 26226 | 56730 | 87234, 117738, 148242, 178746, 209250 |
| 6013 | AD012186 | 20044 | 50548 | 81052, 111556, 142060, 172564, 203068 | 12196 | CAD57258 | 26227 | 56731 | 87235, 117739, 148243, 178747, 209251 |
| 6014 | AD012196 | 20045 | 50549 | 81053, 111557, 142061, 172565, 203069 | 12197 | CAD57259 | 26228 | 56732 | 87236, 117740, 148244, 178748, 209252 |
| 6015 | AD012206 | 20046 | 50550 | 81054, 111558, 142062, 172566, 203070 | 12198 | CAD57264 | 26229 | 56733 | 87237, 117741, 148245, 178749, 209253 |
| 6016 | AD012216 | 20047 | 50551 | 81055, 111559, 142063, 172567, 203071 | 12199 | CBW54819 | 26230 | 56734 | 87238, 117742, 148246, 178750, 209254 |
| 6017 | AD012226 | 20048 | 50552 | 81056, 111560, 142064, 172568, 203072 | 12200 | CBW54821 | 26231 | 56735 | 87239, 117743, 148247, 178751, 209255 |
| 6018 | AD012246 | 20049 | 50553 | 81057, 111561, 142065, 172569, 203073 | 12201 | CCG47912 | 26232 | 56736 | 87240, 117744, 148248, 178752, 209256 |
| 6019 | AD012266 | 20050 | 50554 | 81058, 111562, 142066, 172570, 203074 | 12202 | AAF74321 | 26233 | 56737 | 87241, 117745, 148249, 178753, 209257 |
| 6020 | AD012276 | 20051 | 50555 | 81059, 111563, 142067, 172571, 203075 | 12203 | AAF74322 | 26234 | 56738 | 87242, 117746, 148250, 178754, 209258 |
| 6021 | AD012286 | 20052 | 50556 | 81060, 111564, 142068, 172572, 203076 | 12204 | AAF74323 | 26235 | 56739 | 87243, 117747, 148251, 178755, 209259 |
| 6022 | AD012296 | 20053 | 50557 | 81061, 111565, 142069, 172573, 203077 | 12205 | AAF74324 | 26236 | 56740 | 87244, 117748, 148252, 178756, 209260 |
| 6023 | AD012306 | 20054 | 50558 | 81062, 111566, 142070, 172574, 203078 | 12206 | AAF74325 | 26237 | 56741 | 87245, 117749, 148253, 178757, 209261 |

FIG. 3 continued

| | | | | | | | | | |
|---|---|---|---|---|---|---|---|---|---|
| 6024 | ADO12316 | 20055 | 50559 | 81063, 111567, 142071, 172575, 203079 | 12207 | EPI239900 | 26238 | 56742 | 87246, 117750, 148254, 178758, 209262 |
| 6025 | ADO12326 | 20056 | 50560 | 81064, 111568, 142072, 172576, 203080 | 12208 | EPI221062 | 26239 | 56743 | 87247, 117751, 148255, 178759, 209263 |
| 6026 | ADO12336 | 20057 | 50561 | 81065, 111569, 142073, 172577, 203081 | 12209 | EPI534079 | 26240 | 56744 | 87248, 117752, 148256, 178760, 209264 |
| 6027 | ADO12346 | 20058 | 50562 | 81066, 111570, 142074, 172578, 203082 | 12210 | AGM53851 | 26241 | 56745 | 87249, 117753, 148257, 178761, 209265 |
| 6028 | ADO12356 | 20059 | 50563 | 81067, 111571, 142075, 172579, 203083 | 12211 | EPI731464 | 26242 | 56746 | 87250, 117754, 148258, 178762, 209266 |
| 6029 | ADO12366 | 20060 | 50564 | 81068, 111572, 142076, 172580, 203084 | 12212 | EPI696973 | 26243 | 56747 | 87251, 117755, 148259, 178763, 209267 |
| 6030 | ADO12376 | 20061 | 50565 | 81069, 111573, 142077, 172581, 203085 | 12213 | EPI662593 | 26244 | 56748 | 87252, 117756, 148260, 178764, 209268 |
| 6031 | ADO12386 | 20062 | 50566 | 81070, 111574, 142078, 172582, 203086 | 12214 | EPI830229 | 26245 | 56749 | 87253, 117757, 148261, 178765, 209269 |
| 6032 | ADO12396 | 20063 | 50567 | 81071, 111575, 142079, 172583, 203087 | 12215 | AGU92879 | 26246 | 56750 | 87254, 117758, 148262, 178766, 209270 |
| 6033 | ADO12406 | 20064 | 50568 | 81072, 111576, 142080, 172584, 203088 | 12216 | AGU92857 | 26247 | 56751 | 87255, 117759, 148263, 178767, 209271 |
| 6034 | ADO12416 | 20065 | 50569 | 81073, 111577, 142081, 172585, 203089 | 12217 | AGU92846 | 26248 | 56752 | 87256, 117760, 148264, 178768, 209272 |
| 6035 | ADO12426 | 20066 | 50570 | 81074, 111578, 142082, 172586, 203090 | 12218 | AGU92835 | 26249 | 56753 | 87257, 117761, 148265, 178769, 209273 |
| 6036 | ADO12436 | 20067 | 50571 | 81075, 111579, 142083, 172587, 203091 | 12219 | AGU92703 | 26250 | 56754 | 87258, 117762, 148266, 178770, 209274 |
| 6037 | ADO12446 | 20068 | 50572 | 81076, 111580, 142084, 172588, 203092 | 12220 | EPI643117 | 26251 | 56755 | 87259, 117763, 148267, 178771, 209275 |
| 6038 | ADO12456 | 20069 | 50573 | 81077, 111581, 142085, 172589, 203093 | 12221 | EPI675797 | 26252 | 56756 | 87260, 117764, 148268, 178772, 209276 |
| 6039 | ADO12466 | 20070 | 50574 | 81078, 111582, 142086, 172590, 203094 | 12222 | EPI578429 | 26253 | 56757 | 87261, 117765, 148269, 178773, 209277 |
| 6040 | ADO12476 | 20071 | 50575 | 81079, 111583, 142087, 172591, 203095 | 12223 | EPI614405 | 26254 | 56758 | 87262, 117766, 148270, 178774, 209278 |
| 6041 | ADO12486 | 20072 | 50576 | 81080, 111584, 142088, 172592, 203096 | 12224 | AAT73329 | 26255 | 56759 | 87263, 117767, 148271, 178775, 209279 |

FIG. 3 continued

| | | | | | | | | | |
|---|---|---|---|---|---|---|---|---|---|
| 6042 | AD012496 | 20073 | 50577 | 81081, 111585, 142089, 172593, 203097 | 12225 | AAW80723 | 26256 | 56760 | 87264, 117768, 148272, 178776, 209280 |
| 6043 | AD012506 | 20074 | 50578 | 81082, 111586, 142090, 172594, 203098 | 12226 | EF541467 | 26257 | 56761 | 87265, 117769, 148273, 178777, 209281 |
| 6044 | AD012516 | 20075 | 50579 | 81083, 111587, 142091, 172595, 203099 | 12227 | EPI439509 | 26258 | 56762 | 87266, 117770, 148274, 178778, 209282 |
| 6045 | AD012526 | 20076 | 50580 | 81084, 111588, 142092, 172596, 203100 | 12228 | EPI482776 | 26259 | 56763 | 87267, 117771, 148275, 178779, 209283 |
| 6046 | AD012536 | 20077 | 50581 | 81085, 111589, 142093, 172597, 203101 | 12229 | EPI745533 | 26260 | 56764 | 87268, 117772, 148276, 178780, 209284 |
| 6047 | AD012546 | 20078 | 50582 | 81086, 111590, 142094, 172598, 203102 | 12230 | AEE69012 | 26261 | 56765 | 87269, 117773, 148277, 178781, 209285 |
| 6048 | AD012556 | 20079 | 50583 | 81087, 111591, 142095, 172599, 203103 | 12231 | EPI176609 | 26262 | 56766 | 87270, 117774, 148278, 178782, 209286 |
| 6049 | AD012566 | 20080 | 50584 | 81088, 111592, 142096, 172600, 203104 | 12232 | EPI176472 | 26263 | 56767 | 87271, 117775, 148279, 178783, 209287 |
| 6050 | AD012576 | 20081 | 50585 | 81089, 111593, 142097, 172601, 203105 | 12233 | EPI280340 | 26264 | 56768 | 87272, 117776, 148280, 178784, 209288 |
| 6051 | AD012586 | 20082 | 50586 | 81090, 111594, 142098, 172602, 203106 | 12234 | EPI240318 | 26265 | 56769 | 87273, 117777, 148281, 178785, 209289 |
| 6052 | AD012596 | 20083 | 50587 | 81091, 111595, 142099, 172603, 203107 | 12235 | EPI183133 | 26266 | 56770 | 87274, 117778, 148282, 178786, 209290 |
| 6053 | AD012606 | 20084 | 50588 | 81092, 111596, 142100, 172604, 203108 | 12236 | EPI369141 | 26267 | 56771 | 87275, 117779, 148283, 178787, 209291 |
| 6054 | AD012616 | 20085 | 50589 | 81093, 111597, 142101, 172605, 203109 | 12237 | EPI482787 | 26268 | 56772 | 87276, 117780, 148284, 178788, 209292 |
| 6055 | AD012626 | 20086 | 50590 | 81094, 111598, 142102, 172606, 203110 | 12238 | EPI482790 | 26269 | 56773 | 87277, 117781, 148285, 178789, 209293 |
| 6056 | AD014355 | 20087 | 50591 | 81095, 111599, 142103, 172607, 203111 | 12239 | EPI291797 | 26270 | 56774 | 87278, 117782, 148286, 178790, 209294 |
| 6057 | AD021028 | 20088 | 50592 | 81096, 111600, 142104, 172608, 203112 | 12240 | EPI482798 | 26271 | 56775 | 87279, 117783, 148287, 178791, 209295 |
| 6058 | AD021039 | 20089 | 50593 | 81097, 111601, 142105, 172609, 203113 | 12241 | EPI638969 | 26272 | 56776 | 87280, 117784, 148288, 178792, 209296 |
| 6059 | AD021050 | 20090 | 50594 | 81098, 111602, 142106, 172610, 203114 | 12242 | ABI19012 | 26273 | 56777 | 87281, 117785, 148289, 178793, 209297 |

FIG. 3 continued

| | | | | | | | | | |
|---|---|---|---|---|---|---|---|---|---|
| 6060 | AD025095 | 20091 | 50595 | 81099, 111603, 142107, 172611, 203115 | 12243 | EPI687791 | 26274 | 56778 | 87282, 117786, 148290, 178794, 209298 |
| 6061 | AD025105 | 20092 | 50596 | 81100, 111604, 142108, 172612, 203116 | 12244 | EPI841266 | 26275 | 56779 | 87283, 117787, 148291, 178795, 209299 |
| 6062 | AD025115 | 20093 | 50597 | 81101, 111605, 142109, 172613, 203117 | 12245 | EPI291844 | 26276 | 56780 | 87284, 117788, 148292, 178796, 209300 |
| 6063 | AD025125 | 20094 | 50598 | 81102, 111606, 142110, 172614, 203118 | 12246 | EPI558120 | 26277 | 56781 | 87285, 117789, 148293, 178797, 209301 |
| 6064 | AD025135 | 20095 | 50599 | 81103, 111607, 142111, 172615, 203119 | 12247 | EPI564138 | 26278 | 56782 | 87286, 117790, 148294, 178798, 209302 |
| 6065 | AD025145 | 20096 | 50600 | 81104, 111608, 142112, 172616, 203120 | 12248 | ANM92825 | 26279 | 56783 | 87287, 117791, 148295, 178799, 209303 |
| 6066 | AD025155 | 20097 | 50601 | 81105, 111609, 142113, 172617, 203121 | 12249 | EPI291694 | 26280 | 56784 | 87288, 117792, 148296, 178800, 209304 |
| 6067 | AD025165 | 20098 | 50602 | 81106, 111610, 142114, 172618, 203122 | 12250 | EPI241027 | 26281 | 56785 | 87289, 117793, 148297, 178801, 209305 |
| 6068 | AD025175 | 20099 | 50603 | 81107, 111611, 142115, 172619, 203123 | 12251 | EPI177405 | 26282 | 56786 | 87290, 117794, 148298, 178802, 209306 |
| 6069 | AD025185 | 20100 | 50604 | 81108, 111612, 142116, 172620, 203124 | 12252 | EPI242475 | 26283 | 56787 | 87291, 117795, 148299, 178803, 209307 |
| 6070 | AD025195 | 20101 | 50605 | 81109, 111613, 142117, 172621, 203125 | 12253 | EPI590131 | 26284 | 56788 | 87292, 117796, 148300, 178804, 209308 |
| 6071 | AD025205 | 20102 | 50606 | 81110, 111614, 142118, 172622, 203126 | 12254 | EPI68596 | 26285 | 56789 | 87293, 117797, 148301, 178805, 209309 |
| 6072 | AD025215 | 20103 | 50607 | 81111, 111615, 142119, 172623, 203127 | 12255 | EPI115409 | 26286 | 56790 | 87294, 117798, 148302, 178806, 209310 |
| 6073 | AD025225 | 20104 | 50608 | 81112, 111616, 142120, 172624, 203128 | 12256 | AB077678/ml | 26287 | 56791 | 87295, 117799, 148303, 178807, 209311 |
| 6074 | AD025235 | 20105 | 50609 | 81113, 111617, 142121, 172625, 203129 | 12257 | EPI185224 | 26288 | 56792 | 87296, 117800, 148304, 178808, 209312 |
| 6075 | AD025245 | 20106 | 50610 | 81114, 111618, 142122, 172626, 203130 | 12258 | EPI697745 | 26289 | 56793 | 87297, 117801, 148305, 178809, 209313 |
| 6076 | AD025255 | 20107 | 50611 | 81115, 111619, 142123, 172627, 203131 | 12259 | EPI768524 | 26290 | 56794 | 87298, 117802, 148306, 178810, 209314 |
| 6077 | AD025265 | 20108 | 50612 | 81116, 111620, 142124, 172628, 203132 | 12260 | EPI726929 | 26291 | 56795 | 87299, 117803, 148307, 178811, 209315 |

FIG. 3 continued

| | | | | | | | | | |
|---|---|---|---|---|---|---|---|---|---|
| 6078 | ADO25275 | 20109 | 50613 | 81117, 111621, 142125, 172629, 203133 | 12261 | EPI813816 | 26292 | 56796 | 87300, 117804, 148308, 178812, 209316 |
| 6079 | ADO25285 | 20110 | 50614 | 81118, 111622, 142126, 172630, 203134 | 12262 | EPI466627 | 26293 | 56797 | 87301, 117805, 148309, 178813, 209317 |
| 6080 | ADO27623 | 20111 | 50615 | 81119, 111623, 142127, 172631, 203135 | 12263 | EPI541965 | 26294 | 56798 | 87302, 117806, 148310, 178814, 209318 |
| 6081 | ADO30410 | 20112 | 50616 | 81120, 111624, 142128, 172632, 203136 | 12264 | EPI652004 | 26295 | 56799 | 87303, 117807, 148311, 178815, 209319 |
| 6082 | ADO30420 | 20113 | 50617 | 81121, 111625, 142129, 172633, 203137 | 12265 | EPI62526 | 26296 | 56800 | 87304, 117808, 148312, 178816, 209320 |
| 6083 | ADP95343 | 20114 | 50618 | 81122, 111626, 142130, 172634, 203138 | 12266 | EPI189183 | 26297 | 56801 | 87305, 117809, 148313, 178817, 209321 |
| 6084 | ADP95353 | 20115 | 50619 | 81123, 111627, 142131, 172635, 203139 | 12267 | EPI180576 | 26298 | 56802 | 87306, 117810, 148314, 178818, 209322 |
| 6085 | ADP95363 | 20116 | 50620 | 81124, 111628, 142132, 172636, 203140 | 12268 | EPI346918 | 26299 | 56803 | 87307, 117811, 148315, 178819, 209323 |
| 6086 | ADP95373 | 20117 | 50621 | 81125, 111629, 142133, 172637, 203141 | 12269 | EPI240976 | 26300 | 56804 | 87308, 117812, 148316, 178820, 209324 |
| 6087 | ADP95383 | 20118 | 50622 | 81126, 111630, 142134, 172638, 203142 | 12270 | EPI3165 | 26301 | 56805 | 87309, 117813, 148317, 178821, 209325 |
| 6088 | ADP95393 | 20119 | 50623 | 81127, 111631, 142135, 172639, 203143 | 12271 | EPI957 | 26302 | 56806 | 87310, 117814, 148318, 178822, 209326 |
| 6089 | ADQ43774 | 20120 | 50624 | 81128, 111632, 142136, 172640, 203144 | 12272 | EPI507593 | 26303 | 56807 | 87311, 117815, 148319, 178823, 209327 |
| 6090 | ADQ92578 | 20121 | 50625 | 81129, 111633, 142137, 172641, 203145 | 12273 | EPI461954 | 26304 | 56808 | 87312, 117816, 148320, 178824, 209328 |
| 6091 | ADR32364 | 20122 | 50626 | 81130, 111634, 142138, 172642, 203146 | 12274 | EPI461954 | 26305 | 56809 | 87313, 117817, 148321, 178825, 209329 |
| 6092 | ADT64478 | 20123 | 50627 | 81131, 111635, 142139, 172643, 203147 | 12275 | EPI668104 | 26306 | 56810 | 87314, 117818, 148322, 178826, 209330 |
| 6093 | ADT78889 | 20124 | 50628 | 81132, 111636, 142140, 172644, 203148 | 12276 | EPI578445 | 26307 | 56811 | 87315, 117819, 148323, 178827, 209331 |
| 6094 | ADT78899 | 20125 | 50629 | 81133, 111637, 142141, 172645, 203149 | 12277 | EPI551883 | 26308 | 56812 | 87316, 117820, 148324, 178828, 209332 |
| 6095 | ADT78963 | 20126 | 50630 | 81134, 111638, 142142, 172646, 203150 | 12278 | EPI344388 | 26309 | 56813 | 87317, 117821, 148325, 178829, 209333 |

FIG. 3 continued

| | | | | | | | | | |
|---|---|---|---|---|---|---|---|---|---|
| 6096 | ADT79001 | 20127 | 50631 | 81135, 111639, 142143, 172647, 203151 | 12279 | EPI347601 | 26310 | 56814 | 87318, 117822, 148326, 178830, 209334 |
| 6097 | ADT79021 | 20128 | 50632 | 81136, 111640, 142144, 172648, 203152 | 12280 | EPI642512 | 26311 | 56815 | 87319, 117823, 148327, 178831, 209335 |
| 6098 | ADT79041 | 20129 | 50633 | 81137, 111641, 142145, 172649, 203153 | 12281 | AIE52540 | 26312 | 56816 | 87320, 117824, 148328, 178832, 209336 |
| 6099 | ADT79121 | 20130 | 50634 | 81138, 111642, 142146, 172650, 203154 | 12282 | EPI465399 | 26313 | 56817 | 87321, 117825, 148329, 178833, 209337 |
| 6100 | ADT79131 | 20131 | 50635 | 81139, 111643, 142147, 172651, 203155 | 12283 | EPI328899 | 26314 | 56818 | 87322, 117826, 148330, 178834, 209338 |
| 6101 | ADT79234 | 20132 | 50636 | 81140, 111644, 142148, 172652, 203156 | 12284 | EPI328901 | 26315 | 56819 | 87323, 117827, 148331, 178835, 209339 |
| 6102 | ADT79244 | 20133 | 50637 | 81141, 111645, 142149, 172653, 203157 | 12285 | EPI574645 | 26316 | 56820 | 87324, 117828, 148332, 178836, 209340 |
| 6103 | ADU25480 | 20134 | 50638 | 81142, 111646, 142150, 172654, 203158 | 12286 | EPI563214 | 26317 | 56821 | 87325, 117829, 148333, 178837, 209341 |
| 6104 | ADU59780 | 20135 | 50639 | 81143, 111647, 142151, 172655, 203159 | 12287 | EPI553998 | 26318 | 56822 | 87326, 117830, 148334, 178838, 209342 |
| 6105 | ADU59789 | 20136 | 50640 | 81144, 111648, 142152, 172656, 203160 | 12288 | EPI551568 | 26319 | 56823 | 87327, 117831, 148335, 178839, 209343 |
| 6106 | ADU59829 | 20137 | 50641 | 81145, 111649, 142153, 172657, 203161 | 12289 | EPI629737 | 26320 | 56824 | 87328, 117832, 148336, 178840, 209344 |
| 6107 | ADU59838 | 20138 | 50642 | 81146, 111650, 142154, 172658, 203162 | 12290 | EPI631886 | 26321 | 56825 | 87329, 117833, 148337, 178841, 209345 |
| 6108 | ADU59847 | 20139 | 50643 | 81147, 111651, 142155, 172659, 203163 | 12291 | EPI577025 | 26322 | 56826 | 87330, 117834, 148338, 178842, 209346 |
| 6109 | ADU59907 | 20140 | 50644 | 81148, 111652, 142156, 172660, 203164 | 12292 | EPI404926 | 26323 | 56827 | 87331, 117835, 148339, 178843, 209347 |
| 6110 | ADU59917 | 20141 | 50645 | 81149, 111653, 142157, 172661, 203165 | 12293 | EPI492687 | 26324 | 56828 | 87332, 117836, 148340, 178844, 209348 |
| 6111 | ADU59920 | 20142 | 50646 | 81150, 111654, 142158, 172662, 203166 | 12294 | EPI530648 | 26325 | 56829 | 87333, 117837, 148341, 178845, 209349 |
| 6112 | ADU59941 | 20143 | 50647 | 81151, 111655, 142159, 172663, 203167 | 12295 | EPI684314 | 26326 | 56830 | 87334, 117838, 148342, 178846, 209350 |
| 6113 | ADU76311 | 20144 | 50648 | 81152, 111656, 142160, 172664, 203168 | 12296 | EPI614459 | 26327 | 56831 | 87335, 117839, 148343, 178847, 209351 |

FIG. 3 continued

| | | | | | | | | | |
|---|---|---|---|---|---|---|---|---|---|
| 6114 | ADU76313 | 20145 | 50649 | 81153, 111657, 142161, 172665, 203169 | 12297 | EPI541466 | 26328 | 56832 | 87336, 117840, 148344, 178848, 209352 |
| 6115 | ADU76314 | 20146 | 50650 | 81154, 111658, 142162, 172666, 203170 | 12298 | EPI696968 | 26329 | 56833 | 87337, 117841, 148345, 178849, 209353 |
| 6116 | ADU76315 | 20147 | 50651 | 81155, 111659, 142163, 172667, 203171 | 12299 | EPI674598 | 26330 | 56834 | 87338, 117842, 148346, 178850, 209354 |
| 6117 | ADU76316 | 20148 | 50652 | 81156, 111660, 142164, 172668, 203172 | 12300 | EPI530678 | 26331 | 56835 | 87339, 117843, 148347, 178851, 209355 |
| 6118 | ADU76317 | 20149 | 50653 | 81157, 111661, 142165, 172669, 203173 | 12301 | EPI530680 | 26332 | 56836 | 87340, 117844, 148348, 178852, 209356 |
| 6119 | ADU76318 | 20150 | 50654 | 81158, 111662, 142166, 172670, 203174 | 12302 | EPI7603 | 26333 | 56837 | 87341, 117845, 148349, 178853, 209357 |
| 6120 | ADU76319 | 20151 | 50655 | 81159, 111663, 142167, 172671, 203175 | 12303 | EPI814527 | 26334 | 56838 | 87342, 117846, 148350, 178854, 209358 |
| 6121 | ADU76320 | 20152 | 50656 | 81160, 111664, 142168, 172672, 203176 | 12304 | EPI674737 | 26335 | 56839 | 87343, 117847, 148351, 178855, 209359 |
| 6122 | ADU76321 | 20153 | 50657 | 81161, 111665, 142169, 172673, 203177 | 12305 | EPI614443 | 26336 | 56840 | 87344, 117848, 148352, 178856, 209360 |
| 6123 | ADU76322 | 20154 | 50658 | 81162, 111666, 142170, 172674, 203178 | 12306 | EPI551812 | 26337 | 56841 | 87345, 117849, 148353, 178857, 209361 |
| 6124 | ADU76323 | 20155 | 50659 | 81163, 111667, 142171, 172675, 203179 | 12307 | EPI696961 | 26338 | 56842 | 87346, 117850, 148354, 178858, 209362 |
| 6125 | ADU76324 | 20156 | 50660 | 81164, 111668, 142172, 172676, 203180 | 12308 | EPI740789 | 26339 | 56843 | 87347, 117851, 148355, 178859, 209363 |
| 6126 | ADU76325 | 20157 | 50661 | 81165, 111669, 142173, 172677, 203181 | 12309 | EPI377498 | 26340 | 56844 | 87348, 117852, 148356, 178860, 209364 |
| 6127 | ADU76326 | 20158 | 50662 | 81166, 111670, 142174, 172678, 203182 | 12310 | EPI377498 | 26341 | 56845 | 87349, 117853, 148357, 178861, 209365 |
| 6128 | ADU76327 | 20159 | 50663 | 81167, 111671, 142175, 172679, 203183 | 12311 | EPI391246 | 26342 | 56846 | 87350, 117854, 148358, 178862, 209366 |
| 6129 | ADU76328 | 20160 | 50664 | 81168, 111672, 142176, 172680, 203184 | 12312 | EPI407122 | 26343 | 56847 | 87351, 117855, 148359, 178863, 209367 |
| 6130 | ADU76329 | 20161 | 50665 | 81169, 111673, 142177, 172681, 203185 | 12313 | EPI407125 | 26344 | 56848 | 87352, 117856, 148360, 178864, 209368 |
| 6131 | ADU76330 | 20162 | 50666 | 81170, 111674, 142178, 172682, 203186 | 12314 | EPI562038 | 26345 | 56849 | 87353, 117857, 148361, 178865, 209369 |

FIG. 3 continued

| | | | | | | | | | |
|---|---|---|---|---|---|---|---|---|---|
| 6132 | ADU76331 | 20163 | 50667 | 81171, 111675, 142179, 172683, 203187 | 12315 | EPI562038 | 26346 | 56850 | 87354, 117858, 148362, 178866, 209370 |
| 6133 | ADU76332 | 20164 | 50668 | 81172, 111676, 142180, 172684, 203188 | 12316 | EU716525 | 26347 | 56851 | 87355, 117859, 148363, 178867, 209371 |
| 6134 | ADU76333 | 20165 | 50669 | 81173, 111677, 142181, 172685, 203189 | 12317 | EPI232422 | 26348 | 56852 | 87356, 117860, 148364, 178868, 209372 |
| 6135 | ADU76334 | 20166 | 50670 | 81174, 111678, 142182, 172686, 203190 | 12318 | EPI227593 | 26349 | 56853 | 87357, 117861, 148365, 178869, 209373 |
| 6136 | ADU76335 | 20167 | 50671 | 81175, 111679, 142183, 172687, 203191 | 12319 | EPI435658 | 26350 | 56854 | 87358, 117862, 148366, 178870, 209374 |
| 6137 | ADU76336 | 20168 | 50672 | 81176, 111680, 142184, 172688, 203192 | 12320 | EPI492513 | 26351 | 56855 | 87359, 117863, 148367, 178871, 209375 |
| 6138 | ADU76337 | 20169 | 50673 | 81177, 111681, 142185, 172689, 203193 | 12321 | EPI165066 | 26352 | 56856 | 87360, 117864, 148368, 178872, 209376 |
| 6139 | ADU76338 | 20170 | 50674 | 81178, 111682, 142186, 172690, 203194 | 12322 | EPI531308 | 26353 | 56857 | 87361, 117865, 148369, 178873, 209377 |
| 6140 | ADU76339 | 20171 | 50675 | 81179, 111683, 142187, 172691, 203195 | 12323 | EPI433308 | 26354 | 56858 | 87362, 117866, 148370, 178874, 209378 |
| 6141 | ADU76341 | 20172 | 50676 | 81180, 111684, 142188, 172692, 203196 | 12324 | EPI114974 | 26355 | 56859 | 87363, 117867, 148371, 178875, 209379 |
| 6142 | ADU76342 | 20173 | 50677 | 81181, 111685, 142189, 172693, 203197 | 12325 | EPI622495 | 26356 | 56860 | 87364, 117868, 148372, 178876, 209380 |
| 6143 | ADU76343 | 20174 | 50678 | 81182, 111686, 142190, 172694, 203198 | 12326 | EPI349847 | 26357 | 56861 | 87365, 117869, 148373, 178877, 209381 |
| 6144 | ADU76344 | 20175 | 50679 | 81183, 111687, 142191, 172695, 203199 | 12327 | EPI174804 | 26358 | 56862 | 87366, 117870, 148374, 178878, 209382 |
| 6145 | ADU76345 | 20176 | 50680 | 81184, 111688, 142192, 172696, 203200 | 12328 | EPI492441 | 26359 | 56863 | 87367, 117871, 148375, 178879, 209383 |
| 6146 | ADU76346 | 20177 | 50681 | 81185, 111689, 142193, 172697, 203201 | 12329 | EPI164142 | 26360 | 56864 | 87368, 117872, 148376, 178880, 209384 |
| 6147 | ADU76347 | 20178 | 50682 | 81186, 111690, 142194, 172698, 203202 | 12330 | EPI827076 | 26361 | 56865 | 87369, 117873, 148377, 178881, 209385 |
| 6148 | ADV17285 | 20179 | 50683 | 81187, 111691, 142195, 172699, 203203 | 12331 | EPI168491 | 26362 | 56866 | 87370, 117874, 148378, 178882, 209386 |
| 6149 | ADV17295 | 20180 | 50684 | 81188, 111692, 142196, 172700, 203204 | 12332 | EPI827078 | 26363 | 56867 | 87371, 117875, 148379, 178883, 209387 |

FIG. 3 continued

| | | | | | | | | | |
|---|---|---|---|---|---|---|---|---|---|
| 6150 | ADV17305 | 20181 | 50685 | 81189, 111693, 142197, 172701, 203205 | 12333 | EPI594521 | 26364 | 56868 | 87372, 117876, 148380, 178884, 209388 |
| 6151 | ADV17315 | 20182 | 50686 | 81190, 111694, 142198, 172702, 203206 | 12334 | EPI5787 | 26365 | 56869 | 87373, 117877, 148381, 178885, 209389 |
| 6152 | ADV17325 | 20183 | 50687 | 81191, 111695, 142199, 172703, 203207 | 12335 | EPI5787 | 26366 | 56870 | 87374, 117878, 148382, 178886, 209390 |
| 6153 | ADV17335 | 20184 | 50688 | 81192, 111696, 142200, 172704, 203208 | 12336 | EPI267031 | 26367 | 56871 | 87375, 117879, 148383, 178887, 209391 |
| 6154 | ADV19022 | 20185 | 50689 | 81193, 111697, 142201, 172705, 203209 | 12337 | EPI376539 | 26368 | 56872 | 87376, 117880, 148384, 178888, 209392 |
| 6155 | ADV41679 | 20186 | 50690 | 81194, 111698, 142202, 172706, 203210 | 12338 | EPI124069 | 26369 | 56873 | 87377, 117881, 148385, 178889, 209393 |
| 6156 | ADV76582 | 20187 | 50691 | 81195, 111699, 142203, 172707, 203211 | 12339 | EPI342499 | 26370 | 56874 | 87378, 117882, 148386, 178890, 209394 |
| 6157 | ADV76590 | 20188 | 50692 | 81196, 111700, 142204, 172708, 203212 | 12340 | EPI103069 | 26371 | 56875 | 87379, 117883, 148387, 178891, 209395 |
| 6158 | ADV76601 | 20189 | 50693 | 81197, 111701, 142205, 172709, 203213 | 12341 | EPI227595 | 26372 | 56876 | 87380, 117884, 148388, 178892, 209396 |
| 6159 | ADV76612 | 20190 | 50694 | 81198, 111702, 142206, 172710, 203214 | 12342 | EPI569385 | 26373 | 56877 | 87381, 117885, 148389, 178893, 209397 |
| 6160 | ADV76623 | 20191 | 50695 | 81199, 111703, 142207, 172711, 203215 | 12343 | EPI736916 | 26374 | 56878 | 87382, 117886, 148390, 178894, 209398 |
| 6161 | ADV76634 | 20192 | 50696 | 81200, 111704, 142208, 172712, 203216 | 12344 | EPI593891 | 26375 | 56879 | 87383, 117887, 148391, 178895, 209399 |
| 6162 | ADV76645 | 20193 | 50697 | 81201, 111705, 142209, 172713, 203217 | 12345 | EPI691380 | 26376 | 56880 | 87384, 117888, 148392, 178896, 209400 |
| 6163 | ADV76667 | 20194 | 50698 | 81202, 111706, 142210, 172714, 203218 | 12346 | EPI533584 | 26377 | 56881 | 87385, 117889, 148393, 178897, 209401 |
| 6164 | ADV76676 | 20195 | 50699 | 81203, 111707, 142211, 172715, 203219 | 12347 | EPI641400 | 26378 | 56882 | 87386, 117890, 148394, 178898, 209402 |
| 6165 | ADV76697 | 20196 | 50700 | 81204, 111708, 142212, 172716, 203220 | 12348 | EPI587620 | 26379 | 56883 | 87387, 117891, 148395, 178899, 209403 |
| 6166 | ADV76708 | 20197 | 50701 | 81205, 111709, 142213, 172717, 203221 | 12349 | EPI569392 | 26380 | 56884 | 87388, 117892, 148396, 178900, 209404 |
| 6167 | ADV76719 | 20198 | 50702 | 81206, 111710, 142214, 172718, 203222 | 12350 | EPI459857 | 26381 | 56885 | 87389, 117893, 148397, 178901, 209405 |

FIG. 3 continued

| | | | | | | | | | |
|---|---|---|---|---|---|---|---|---|---|
| 6168 | ADV76730 | 20199 | 50703 | 81207, 111711, 142215, 172719, 203223 | 12351 | EPI242204 | 26382 | 56886 | 87390, 117894, 148398, 178902, 209406 |
| 6169 | ADV78132 | 20200 | 50704 | 81208, 111712, 142216, 172720, 203224 | 12352 | EPI408029 | 26383 | 56887 | 87391, 117895, 148399, 178903, 209407 |
| 6170 | ADW09104 | 20201 | 50705 | 81209, 111713, 142217, 172721, 203225 | 12353 | EPI439509 | 26384 | 56888 | 87392, 117896, 148400, 178904, 209408 |
| 6171 | ADW09114 | 20202 | 50706 | 81210, 111714, 142218, 172722, 203226 | 12354 | EPI164223 | 26385 | 56889 | 87393, 117897, 148401, 178905, 209409 |
| 6172 | ADW09123 | 20203 | 50707 | 81211, 111715, 142219, 172723, 203227 | 12355 | EPI486493 | 26386 | 56890 | 87394, 117898, 148402, 178906, 209410 |
| 6173 | ADW09156 | 20204 | 50708 | 81212, 111716, 142220, 172724, 203228 | 12356 | EPI740737 | 26387 | 56891 | 87395, 117899, 148403, 178907, 209411 |
| 6174 | ADW09167 | 20205 | 50709 | 81213, 111717, 142221, 172725, 203229 | 12357 | EPI730494 | 26388 | 56892 | 87396, 117900, 148404, 178908, 209412 |
| 6175 | ADW09178 | 20206 | 50710 | 81214, 111718, 142222, 172726, 203230 | 12358 | EPI712925 | 26389 | 56893 | 87397, 117901, 148405, 178909, 209413 |
| 6176 | ADW09189 | 20207 | 50711 | 81215, 111719, 142223, 172727, 203231 | 12359 | EPI448938 | 26390 | 56894 | 87398, 117902, 148406, 178910, 209414 |
| 6177 | ADW09211 | 20208 | 50712 | 81216, 111720, 142224, 172728, 203232 | 12360 | EPI445995 | 26391 | 56895 | 87399, 117903, 148407, 178911, 209415 |
| 6178 | ADW09222 | 20209 | 50713 | 81217, 111721, 142225, 172729, 203233 | 12361 | EPI470861 | 26392 | 56896 | 87400, 117904, 148408, 178912, 209416 |
| 6179 | ADW09233 | 20210 | 50714 | 81218, 111722, 142226, 172730, 203234 | 12362 | EPI498036 | 26393 | 56897 | 87401, 117905, 148409, 178913, 209417 |
| 6180 | ADW09244 | 20211 | 50715 | 81219, 111723, 142227, 172731, 203235 | 12363 | EPI470902 | 26394 | 56898 | 87402, 117906, 148410, 178914, 209418 |
| 6181 | ADW09255 | 20212 | 50716 | 81220, 111724, 142228, 172732, 203236 | 12364 | EPI838241 | 26395 | 56899 | 87403, 117907, 148411, 178915, 209419 |
| 6182 | ADW09266 | 20213 | 50717 | 81221, 111725, 142229, 172733, 203237 | 12365 | EPI680525 | 26396 | 56900 | 87404, 117908, 148412, 178916, 209420 |
| 6183 | ADW09277 | 20214 | 50718 | 81222, 111726, 142230, 172734, 203238 | 12366 | EPI690481 | 26397 | 56901 | 87405, 117909, 148413, 178917, 209421 |

FIG. 3 continued

| | column 1 | column 2 | column 3 | column 4 | | column 1 | column 2 | column 3 | column 4 |
|---|---|---|---|---|---|---|---|---|---|
| Row | NCBI, Genbank or EpiFlu Accession No. | A | B | C | Row | NCBI, Genbank or EpiFlu Accession No. | A | B | C |
| 1 | AAN39743 | 28577 | 59081 | 89585, 120089, 150593, 181097, 211601 | 965 | AGX20903 | 29541 | 60045 | 90549, 121053, 151557, 182061, 212565 |
| 2 | AAN39747 | 28578 | 59082 | 89586, 120090, 150594, 181098, 211602 | 966 | AGX20914 | 29542 | 60046 | 90550, 121054, 151558, 182062, 212566 |
| 3 | AAN39749 | 28579 | 59083 | 89587, 120091, 150595, 181099, 211603 | 967 | AGX20925 | 29543 | 60047 | 90551, 121055, 151559, 182063, 212567 |
| 4 | AAN39751 | 28580 | 59084 | 89588, 120092, 150596, 181100, 211604 | 968 | AGX20936 | 29544 | 60048 | 90552, 121056, 151560, 182064, 212568 |
| 5 | AAN39753 | 28581 | 59085 | 89589, 120093, 150597, 181101, 211605 | 969 | AGX20947 | 29545 | 60049 | 90553, 121057, 151561, 182065, 212569 |
| 6 | AAN39759 | 28582 | 59086 | 89590, 120094, 150598, 181102, 211606 | 970 | AGX20958 | 29546 | 60050 | 90554, 121058, 151562, 182066, 212570 |
| 7 | AAN39761 | 28583 | 59087 | 89591, 120095, 150599, 181103, 211607 | 971 | AGX20969 | 29547 | 60051 | 90555, 121059, 151563, 182067, 212571 |
| 8 | AAN39769 | 28584 | 59088 | 89592, 120096, 150600, 181104, 211608 | 972 | AGX20980 | 29548 | 60052 | 90556, 121060, 151564, 182068, 212572 |
| 9 | AAN39771 | 28585 | 59089 | 89593, 120097, 150601, 181105, 211609 | 973 | AGX20991 | 29549 | 60053 | 90557, 121061, 151565, 182069, 212573 |
| 10 | AAN39773 | 28586 | 59090 | 89594, 120098, 150602, 181106, 211610 | 974 | AGX21002 | 29550 | 60054 | 90558, 121062, 151566, 182070, 212574 |
| 11 | AAN39775 | 28587 | 59091 | 89595, 120099, 150603, 181107, 211611 | 975 | AGX21013 | 29551 | 60055 | 90559, 121063, 151567, 182071, 212575 |

FIG. 4

| | | | | | | | | | |
|---|---|---|---|---|---|---|---|---|---|
| 12 | AAN39777 | 28588 | 59092 | 89596, 120100, 150604, 181108, 211612 | 976 | AGX21024 | 29552 | 60056 | 90560, 121064, 151568, 182072, 212576 |
| 13 | AAN39779 | 28589 | 59093 | 89597, 120101, 150605, 181109, 211613 | 977 | AGX21035 | 29553 | 60057 | 90561, 121065, 151569, 182073, 212577 |
| 14 | AAN39781 | 28590 | 59094 | 89598, 120102, 150606, 181110, 211614 | 978 | AGX21046 | 29554 | 60058 | 90562, 121066, 151570, 182074, 212578 |
| 15 | AAN39783 | 28591 | 59095 | 89599, 120103, 150607, 181111, 211615 | 979 | AGX21057 | 29555 | 60059 | 90563, 121067, 151571, 182075, 212579 |
| 16 | AAN39785 | 28592 | 59096 | 89600, 120104, 150608, 181112, 211616 | 980 | AGX21068 | 29556 | 60060 | 90564, 121068, 151572, 182076, 212580 |
| 17 | AAN39787 | 28593 | 59097 | 89601, 120105, 150609, 181113, 211617 | 981 | AGX21079 | 29557 | 60061 | 90565, 121069, 151573, 182077, 212581 |
| 18 | AAN39795 | 28594 | 59098 | 89602, 120106, 150610, 181114, 211618 | 982 | AGX21088 | 29558 | 60062 | 90566, 121070, 151574, 182078, 212582 |
| 19 | AAN39797 | 28595 | 59099 | 89603, 120107, 150611, 181115, 211619 | 983 | AGX21099 | 29559 | 60063 | 90567, 121071, 151575, 182079, 212583 |
| 20 | AAN39799 | 28596 | 59100 | 89604, 120108, 150612, 181116, 211620 | 984 | AGX21110 | 29560 | 60064 | 90568, 121072, 151576, 182080, 212584 |
| 21 | AAN39801 | 28597 | 59101 | 89605, 120109, 150613, 181117, 211621 | 985 | AGX21121 | 29561 | 60065 | 90569, 121073, 151577, 182081, 212585 |
| 22 | AAN39803 | 28598 | 59102 | 89606, 120110, 150614, 181118, 211622 | 986 | AGX21132 | 29562 | 60066 | 90570, 121074, 151578, 182082, 212586 |
| 23 | ABA02232 | 28599 | 59103 | 89607, 120111, 150615, 181119, 211623 | 987 | AGX21143 | 29563 | 60067 | 90571, 121075, 151579, 182083, 212587 |
| 24 | ABI84039 | 28600 | 59104 | 89608, 120112, 150616, 181120, 211624 | 988 | AGX21154 | 29564 | 60068 | 90572, 121076, 151580, 182084, 212588 |
| 25 | ABI84051 | 28601 | 59105 | 89609, 120113, 150617, 181121, 211625 | 989 | AGX21165 | 29565 | 60069 | 90573, 121077, 151581, 182085, 212589 |
| 26 | ABI84062 | 28602 | 59106 | 89610, 120114, 150618, 181122, 211626 | 990 | AGX21176 | 29566 | 60070 | 90574, 121078, 151582, 182086, 212590 |
| 27 | ABL76280 | 28603 | 59107 | 89611, 120115, 150619, 181123, 211627 | 991 | AGX21187 | 29567 | 60071 | 90575, 121079, 151583, 182087, 212591 |
| 28 | ABL76302 | 28604 | 59108 | 89612, 120116, 150620, 181124, 211628 | 992 | AGX21198 | 29568 | 60072 | 90576, 121080, 151584, 182088, 212592 |
| 29 | ABL76313 | 28605 | 59109 | 89613, 120117, 150621, 181125, 211629 | 993 | AGX21209 | 29569 | 60073 | 90577, 121081, 151585, 182089, 212593 |

FIG. 4 continued

| | | | | | | | | | |
|---|---|---|---|---|---|---|---|---|---|
| 30 | ABL76335 | 28606 | 59110 | 89614, 120118, 150622, 181126, 211630 | 994 | AGX21220 | 29570 | 60074 | 90578, 121082, 151586, 182090, 212594 |
| 31 | ABL76346 | 28607 | 59111 | 89615, 120119, 150623, 181127, 211631 | 995 | AGX21231 | 29571 | 60075 | 90579, 121083, 151587, 182091, 212595 |
| 32 | ABL76357 | 28608 | 59112 | 89616, 120120, 150624, 181128, 211632 | 996 | AGX21242 | 29572 | 60076 | 90580, 121084, 151588, 182092, 212596 |
| 33 | ABL76368 | 28609 | 59113 | 89617, 120121, 150625, 181129, 211633 | 997 | AGX21253 | 29573 | 60077 | 90581, 121085, 151589, 182093, 212597 |
| 34 | ABL76379 | 28610 | 59114 | 89618, 120122, 150626, 181130, 211634 | 998 | AGX21264 | 29574 | 60078 | 90582, 121086, 151590, 182094, 212598 |
| 35 | ABL76390 | 28611 | 59115 | 89619, 120123, 150627, 181131, 211635 | 999 | AGX21275 | 29575 | 60079 | 90583, 121087, 151591, 182095, 212599 |
| 36 | ABL76412 | 28612 | 59116 | 89620, 120124, 150628, 181132, 211636 | 1000 | AGX21286 | 29576 | 60080 | 90584, 121088, 151592, 182096, 212600 |
| 37 | ABL76423 | 28613 | 59117 | 89621, 120125, 150629, 181133, 211637 | 1001 | AGX21297 | 29577 | 60081 | 90585, 121089, 151593, 182097, 212601 |
| 38 | ABL76434 | 28614 | 59118 | 89622, 120126, 150630, 181134, 211638 | 1002 | AGX21308 | 29578 | 60082 | 90586, 121090, 151594, 182098, 212602 |
| 39 | ABL76456 | 28615 | 59119 | 89623, 120127, 150631, 181135, 211639 | 1003 | AGX21319 | 29579 | 60083 | 90587, 121091, 151595, 182099, 212603 |
| 40 | ABL76467 | 28616 | 59120 | 89624, 120128, 150632, 181136, 211640 | 1004 | AGX21330 | 29580 | 60084 | 90588, 121092, 151596, 182100, 212604 |
| 41 | ABL76478 | 28617 | 59121 | 89625, 120129, 150633, 181137, 211641 | 1005 | AGX21341 | 29581 | 60085 | 90589, 121093, 151597, 182101, 212605 |
| 42 | ABL76522 | 28618 | 59122 | 89626, 120130, 150634, 181138, 211642 | 1006 | AGX21352 | 29582 | 60086 | 90590, 121094, 151598, 182102, 212606 |
| 43 | ABL76533 | 28619 | 59123 | 89627, 120131, 150635, 181139, 211643 | 1007 | AGX21363 | 29583 | 60087 | 90591, 121095, 151599, 182103, 212607 |
| 44 | ABL76544 | 28620 | 59124 | 89628, 120132, 150636, 181140, 211644 | 1008 | AGX21374 | 29584 | 60088 | 90592, 121096, 151600, 182104, 212608 |
| 45 | ABL76566 | 28621 | 59125 | 89629, 120133, 150637, 181141, 211645 | 1009 | AGX21385 | 29585 | 60089 | 90593, 121097, 151601, 182105, 212609 |
| 46 | ABL76588 | 28622 | 59126 | 89630, 120134, 150638, 181142, 211646 | 1010 | AGX21396 | 29586 | 60090 | 90594, 121098, 151602, 182106, 212610 |
| 47 | ABL76599 | 28623 | 59127 | 89631, 120135, 150639, 181143, 211647 | 1011 | AGX21407 | 29587 | 60091 | 90595, 121099, 151603, 182107, 212611 |

FIG. 4 continued

| | | | | | | | | | |
|---|---|---|---|---|---|---|---|---|---|
| 48 | ABL76610 | 28624 | 59128 | 89632, 120136, 150640, 181144, 211648 | 1012 | AGX21418 | 29588 | 60092 | 90596, 121100, 151604, 182108, 212612 |
| 49 | ABL76621 | 28625 | 59129 | 89633, 120137, 150641, 181145, 211649 | 1013 | AGX21429 | 29589 | 60093 | 90597, 121101, 151605, 182109, 212613 |
| 50 | ABL76632 | 28626 | 59130 | 89634, 120138, 150642, 181146, 211650 | 1014 | AGX21440 | 29590 | 60094 | 90598, 121102, 151606, 182110, 212614 |
| 51 | ABL76643 | 28627 | 59131 | 89635, 120139, 150643, 181147, 211651 | 1015 | AGX21451 | 29591 | 60095 | 90599, 121103, 151607, 182111, 212615 |
| 52 | ABL76654 | 28628 | 59132 | 89636, 120140, 150644, 181148, 211652 | 1016 | AGX21462 | 29592 | 60096 | 90600, 121104, 151608, 182112, 212616 |
| 53 | ABL76665 | 28629 | 59133 | 89637, 120141, 150645, 181149, 211653 | 1017 | AGX21473 | 29593 | 60097 | 90601, 121105, 151609, 182113, 212617 |
| 54 | ABL76676 | 28630 | 59134 | 89638, 120142, 150646, 181150, 211654 | 1018 | AGX21484 | 29594 | 60098 | 90602, 121106, 151610, 182114, 212618 |
| 55 | ABL76687 | 28631 | 59135 | 89639, 120143, 150647, 181151, 211655 | 1019 | AGX21495 | 29595 | 60099 | 90603, 121107, 151611, 182115, 212619 |
| 56 | ABL76698 | 28632 | 59136 | 89640, 120144, 150648, 181152, 211656 | 1020 | AGX21506 | 29596 | 60100 | 90604, 121108, 151612, 182116, 212620 |
| 57 | ABL76720 | 28633 | 59137 | 89641, 120145, 150649, 181153, 211657 | 1021 | AGX21517 | 29597 | 60101 | 90605, 121109, 151613, 182117, 212621 |
| 58 | ABL76731 | 28634 | 59138 | 89642, 120146, 150650, 181154, 211658 | 1022 | AGX21528 | 29598 | 60102 | 90606, 121110, 151614, 182118, 212622 |
| 59 | ABL76742 | 28635 | 59139 | 89643, 120147, 150651, 181155, 211659 | 1023 | AGX21539 | 29599 | 60103 | 90607, 121111, 151615, 182119, 212623 |
| 60 | ABL76753 | 28636 | 59140 | 89644, 120148, 150652, 181156, 211660 | 1024 | AGX21550 | 29600 | 60104 | 90608, 121112, 151616, 182120, 212624 |
| 61 | ABL76764 | 28637 | 59141 | 89645, 120149, 150653, 181157, 211661 | 1025 | AGX21561 | 29601 | 60105 | 90609, 121113, 151617, 182121, 212625 |
| 62 | ABL76775 | 28638 | 59142 | 89646, 120150, 150654, 181158, 211662 | 1026 | AGX21572 | 29602 | 60106 | 90610, 121114, 151618, 182122, 212626 |
| 63 | ABL76797 | 28639 | 59143 | 89647, 120151, 150655, 181159, 211663 | 1027 | AGX21583 | 29603 | 60107 | 90611, 121115, 151619, 182123, 212627 |
| 64 | ABL76819 | 28640 | 59144 | 89648, 120152, 150656, 181160, 211664 | 1028 | AGX21594 | 29604 | 60108 | 90612, 121116, 151620, 182124, 212628 |
| 65 | ABL76830 | 28641 | 59145 | 89649, 120153, 150657, 181161, 211665 | 1029 | AGX21605 | 29605 | 60109 | 90613, 121117, 151621, 182125, 212629 |

FIG. 4 continued

| | | | | | | | | | |
|---|---|---|---|---|---|---|---|---|---|
| 66 | ABL76852 | 28642 | 59146 | 89650, 120154, 150658, 181162, 211666 | 1030 | AGX21615 | 29606 | 60110 | 90614, 121118, 151622, 182126, 212630 |
| 67 | ABL76863 | 28643 | 59147 | 89651, 120155, 150659, 181163, 211667 | 1031 | AGX21626 | 29607 | 60111 | 90615, 121119, 151623, 182127, 212631 |
| 68 | ABL76874 | 28644 | 59148 | 89652, 120156, 150660, 181164, 211668 | 1032 | AGX21637 | 29608 | 60112 | 90616, 121120, 151624, 182128, 212632 |
| 69 | ABL76885 | 28645 | 59149 | 89653, 120157, 150661, 181165, 211669 | 1033 | AGX21648 | 29609 | 60113 | 90617, 121121, 151625, 182129, 212633 |
| 70 | ABL76896 | 28646 | 59150 | 89654, 120158, 150662, 181166, 211670 | 1034 | AGX21659 | 29610 | 60114 | 90618, 121122, 151626, 182130, 212634 |
| 71 | ABL76918 | 28647 | 59151 | 89655, 120159, 150663, 181167, 211671 | 1035 | AGX21670 | 29611 | 60115 | 90619, 121123, 151627, 182131, 212635 |
| 72 | ABL76962 | 28648 | 59152 | 89656, 120160, 150664, 181168, 211672 | 1036 | AGX21681 | 29612 | 60116 | 90620, 121124, 151628, 182132, 212636 |
| 73 | ABL76973 | 28649 | 59153 | 89657, 120161, 150665, 181169, 211673 | 1037 | AGX21692 | 29613 | 60117 | 90621, 121125, 151629, 182133, 212637 |
| 74 | ABL76984 | 28650 | 59154 | 89658, 120162, 150666, 181170, 211674 | 1038 | AGX21703 | 29614 | 60118 | 90622, 121126, 151630, 182134, 212638 |
| 75 | ABL77006 | 28651 | 59155 | 89659, 120163, 150667, 181171, 211675 | 1039 | AGX21714 | 29615 | 60119 | 90623, 121127, 151631, 182135, 212639 |
| 76 | ABL77017 | 28652 | 59156 | 89660, 120164, 150668, 181172, 211676 | 1040 | AGX21725 | 29616 | 60120 | 90624, 121128, 151632, 182136, 212640 |
| 77 | ABL77028 | 28653 | 59157 | 89661, 120165, 150669, 181173, 211677 | 1041 | AGX21747 | 29617 | 60121 | 90625, 121129, 151633, 182137, 212641 |
| 78 | ABL77039 | 28654 | 59158 | 89662, 120166, 150670, 181174, 211678 | 1042 | AGX21758 | 29618 | 60122 | 90626, 121130, 151634, 182138, 212642 |
| 79 | ABL77050 | 28655 | 59159 | 89663, 120167, 150671, 181175, 211679 | 1043 | AGX21769 | 29619 | 60123 | 90627, 121131, 151635, 182139, 212643 |
| 80 | ABL77072 | 28656 | 59160 | 89664, 120168, 150672, 181176, 211680 | 1044 | AGX21780 | 29620 | 60124 | 90628, 121132, 151636, 182140, 212644 |
| 81 | ABL77083 | 28657 | 59161 | 89665, 120169, 150673, 181177, 211681 | 1045 | AGX21791 | 29621 | 60125 | 90629, 121133, 151637, 182141, 212645 |
| 82 | ABL77094 | 28658 | 59162 | 89666, 120170, 150674, 181178, 211682 | 1046 | AGX21802 | 29622 | 60126 | 90630, 121134, 151638, 182142, 212646 |
| 83 | ABL77105 | 28659 | 59163 | 89667, 120171, 150675, 181179, 211683 | 1047 | AGX21813 | 29623 | 60127 | 90631, 121135, 151639, 182143, 212647 |

FIG. 4 continued

| | | | | | | | | | |
|---|---|---|---|---|---|---|---|---|---|
| 84 | ABL77127 | 28660 | 59164 | 89668, 120172, 150676, 181180, 211684 | 1048 | AGX21824 | 29624 | 60128 | 90632, 121136, 151640, 182144, 212648 |
| 85 | ABL77138 | 28661 | 59165 | 89669, 120173, 150677, 181181, 211685 | 1049 | AGX21835 | 29625 | 60129 | 90633, 121137, 151641, 182145, 212649 |
| 86 | ABL77149 | 28662 | 59166 | 89670, 120174, 150678, 181182, 211686 | 1050 | AGX21846 | 29626 | 60130 | 90634, 121138, 151642, 182146, 212650 |
| 87 | ABL77160 | 28663 | 59167 | 89671, 120175, 150679, 181183, 211687 | 1051 | AGX21857 | 29627 | 60131 | 90635, 121139, 151643, 182147, 212651 |
| 88 | ABL77171 | 28664 | 59168 | 89672, 120176, 150680, 181184, 211688 | 1052 | AGX21868 | 29628 | 60132 | 90636, 121140, 151644, 182148, 212652 |
| 89 | ABL77182 | 28665 | 59169 | 89673, 120177, 150681, 181185, 211689 | 1053 | AGX21879 | 29629 | 60133 | 90637, 121141, 151645, 182149, 212653 |
| 90 | ABL77193 | 28666 | 59170 | 89674, 120178, 150682, 181186, 211690 | 1054 | AGX21890 | 29630 | 60134 | 90638, 121142, 151646, 182150, 212654 |
| 91 | ABL77204 | 28667 | 59171 | 89675, 120179, 150683, 181187, 211691 | 1055 | AGX21901 | 29631 | 60135 | 90639, 121143, 151647, 182151, 212655 |
| 92 | ABL77215 | 28668 | 59172 | 89676, 120180, 150684, 181188, 211692 | 1056 | AGX21912 | 29632 | 60136 | 90640, 121144, 151648, 182152, 212656 |
| 93 | ABL77226 | 28669 | 59173 | 89677, 120181, 150685, 181189, 211693 | 1057 | AGX21923 | 29633 | 60137 | 90641, 121145, 151649, 182153, 212657 |
| 94 | ABL77237 | 28670 | 59174 | 89678, 120182, 150686, 181190, 211694 | 1058 | AGX21934 | 29634 | 60138 | 90642, 121146, 151650, 182154, 212658 |
| 95 | ABL77248 | 28671 | 59175 | 89679, 120183, 150687, 181191, 211695 | 1059 | AGX21945 | 29635 | 60139 | 90643, 121147, 151651, 182155, 212659 |
| 96 | ABL77259 | 28672 | 59176 | 89680, 120184, 150688, 181192, 211696 | 1060 | AGX21956 | 29636 | 60140 | 90644, 121148, 151652, 182156, 212660 |
| 97 | ABL77270 | 28673 | 59177 | 89681, 120185, 150689, 181193, 211697 | 1061 | AGX21967 | 29637 | 60141 | 90645, 121149, 151653, 182157, 212661 |
| 98 | ABL77281 | 28674 | 59178 | 89682, 120186, 150690, 181194, 211698 | 1062 | AGX21978 | 29638 | 60142 | 90646, 121150, 151654, 182158, 212662 |
| 99 | ABL77292 | 28675 | 59179 | 89683, 120187, 150691, 181195, 211699 | 1063 | AGX21989 | 29639 | 60143 | 90647, 121151, 151655, 182159, 212663 |
| 100 | ABL77303 | 28676 | 59180 | 89684, 120188, 150692, 181196, 211700 | 1064 | AGX22000 | 29640 | 60144 | 90648, 121152, 151656, 182160, 212664 |
| 101 | ABL77314 | 28677 | 59181 | 89685, 120189, 150693, 181197, 211701 | 1065 | AGX22011 | 29641 | 60145 | 90649, 121153, 151657, 182161, 212665 |

FIG. 4 continued

| | | | | | | | | | |
|---|---|---|---|---|---|---|---|---|---|
| 102 | ABL77325 | 28678 | 59182 | 89686, 120190, 150694, 181198, 211702 | 1066 | AGX22033 | 29642 | 60146 | 90650, 121154, 151658, 182162, 212666 |
| 103 | ABL77336 | 28679 | 59183 | 89687, 120191, 150695, 181199, 211703 | 1067 | AGX22044 | 29643 | 60147 | 90651, 121155, 151659, 182163, 212667 |
| 104 | ABL77347 | 28680 | 59184 | 89688, 120192, 150696, 181200, 211704 | 1068 | AGX22055 | 29644 | 60148 | 90652, 121156, 151660, 182164, 212668 |
| 105 | ABL77380 | 28681 | 59185 | 89689, 120193, 150697, 181201, 211705 | 1069 | AGX22066 | 29645 | 60149 | 90653, 121157, 151661, 182165, 212669 |
| 106 | ABL77391 | 28682 | 59186 | 89690, 120194, 150698, 181202, 211706 | 1070 | AGX22077 | 29646 | 60150 | 90654, 121158, 151662, 182166, 212670 |
| 107 | ABL84344 | 28683 | 59187 | 89691, 120195, 150699, 181203, 211707 | 1071 | AGX22088 | 29647 | 60151 | 90655, 121159, 151663, 182167, 212671 |
| 108 | ABN50397 | 28684 | 59188 | 89692, 120196, 150700, 181204, 211708 | 1072 | AGX22099 | 29648 | 60152 | 90656, 121160, 151664, 182168, 212672 |
| 109 | ABN50408 | 28685 | 59189 | 89693, 120197, 150701, 181205, 211709 | 1073 | AGX22110 | 29649 | 60153 | 90657, 121161, 151665, 182169, 212673 |
| 110 | ABN50419 | 28686 | 59190 | 89694, 120198, 150702, 181206, 211710 | 1074 | AGX22132 | 29650 | 60154 | 90658, 121162, 151666, 182170, 212674 |
| 111 | ABN50430 | 28687 | 59191 | 89695, 120199, 150703, 181207, 211711 | 1075 | AGX22143 | 29651 | 60155 | 90659, 121163, 151667, 182171, 212675 |
| 112 | ABN50463 | 28688 | 59192 | 89696, 120200, 150704, 181208, 211712 | 1076 | AGX22154 | 29652 | 60156 | 90660, 121164, 151668, 182172, 212676 |
| 113 | ABN50474 | 28689 | 59193 | 89697, 120201, 150705, 181209, 211713 | 1077 | AGX22165 | 29653 | 60157 | 90661, 121165, 151669, 182173, 212677 |
| 114 | ABN50485 | 28690 | 59194 | 89698, 120202, 150706, 181210, 211714 | 1078 | AGX22176 | 29654 | 60158 | 90662, 121166, 151670, 182174, 212678 |
| 115 | ABN50496 | 28691 | 59195 | 89699, 120203, 150707, 181211, 211715 | 1079 | AGX22187 | 29655 | 60159 | 90663, 121167, 151671, 182175, 212679 |
| 116 | ABN50507 | 28692 | 59196 | 89700, 120204, 150708, 181212, 211716 | 1080 | AGX22198 | 29656 | 60160 | 90664, 121168, 151672, 182176, 212680 |
| 117 | ABN50518 | 28693 | 59197 | 89701, 120205, 150709, 181213, 211717 | 1081 | AGX22209 | 29657 | 60161 | 90665, 121169, 151673, 182177, 212681 |
| 118 | ABN50529 | 28694 | 59198 | 89702, 120206, 150710, 181214, 211718 | 1082 | AGX22220 | 29658 | 60162 | 90666, 121170, 151674, 182178, 212682 |
| 119 | ABN50540 | 28695 | 59199 | 89703, 120207, 150711, 181215, 211719 | 1083 | AGX22231 | 29659 | 60163 | 90667, 121171, 151675, 182179, 212683 |

FIG. 4 continued

| | | | | | | | | | |
|---|---|---|---|---|---|---|---|---|---|
| 120 | ABN50551 | 28696 | 59200 | 89704, 120208, 150712, 181216, 211720 | 1084 | AGX22242 | 29660 | 60164 | 90668, 121172, 151676, 182180, 212684 |
| 121 | ABN50562 | 28697 | 59201 | 89705, 120209, 150713, 181217, 211721 | 1085 | AGX22253 | 29661 | 60165 | 90669, 121173, 151677, 182181, 212685 |
| 122 | ABN50573 | 28698 | 59202 | 89706, 120210, 150714, 181218, 211722 | 1086 | AGX22264 | 29662 | 60166 | 90670, 121174, 151678, 182182, 212686 |
| 123 | ABN50584 | 28699 | 59203 | 89707, 120211, 150715, 181219, 211723 | 1087 | AGX22275 | 29663 | 60167 | 90671, 121175, 151679, 182183, 212687 |
| 124 | ABN50595 | 28700 | 59204 | 89708, 120212, 150716, 181220, 211724 | 1088 | AGX22286 | 29664 | 60168 | 90672, 121176, 151680, 182184, 212688 |
| 125 | ABN50606 | 28701 | 59205 | 89709, 120213, 150717, 181221, 211725 | 1089 | AGX22297 | 29665 | 60169 | 90673, 121177, 151681, 182185, 212689 |
| 126 | ABN50628 | 28702 | 59206 | 89710, 120214, 150718, 181222, 211726 | 1090 | AGX22308 | 29666 | 60170 | 90674, 121178, 151682, 182186, 212690 |
| 127 | ABN50639 | 28703 | 59207 | 89711, 120215, 150719, 181223, 211727 | 1091 | AGX22330 | 29667 | 60171 | 90675, 121179, 151683, 182187, 212691 |
| 128 | ABN50650 | 28704 | 59208 | 89712, 120216, 150720, 181224, 211728 | 1092 | AGX22341 | 29668 | 60172 | 90676, 121180, 151684, 182188, 212692 |
| 129 | ABN50661 | 28705 | 59209 | 89713, 120217, 150721, 181225, 211729 | 1093 | AGX22352 | 29669 | 60173 | 90677, 121181, 151685, 182189, 212693 |
| 130 | ABN50683 | 28706 | 59210 | 89714, 120218, 150722, 181226, 211730 | 1094 | AGX22363 | 29670 | 60174 | 90678, 121182, 151686, 182190, 212694 |
| 131 | ABN50694 | 28707 | 59211 | 89715, 120219, 150723, 181227, 211731 | 1095 | AGX22374 | 29671 | 60175 | 90679, 121183, 151687, 182191, 212695 |
| 132 | ABN50705 | 28708 | 59212 | 89716, 120220, 150724, 181228, 211732 | 1096 | AGX22385 | 29672 | 60176 | 90680, 121184, 151688, 182192, 212696 |
| 133 | ABN50716 | 28709 | 59213 | 89717, 120221, 150725, 181229, 211733 | 1097 | AGX22396 | 29673 | 60177 | 90681, 121185, 151689, 182193, 212697 |
| 134 | ABN50727 | 28710 | 59214 | 89718, 120222, 150726, 181230, 211734 | 1098 | AGX22407 | 29674 | 60178 | 90682, 121186, 151690, 182194, 212698 |
| 135 | ABN50738 | 28711 | 59215 | 89719, 120223, 150727, 181231, 211735 | 1099 | AGX22418 | 29675 | 60179 | 90683, 121187, 151691, 182195, 212699 |
| 136 | ABN50749 | 28712 | 59216 | 89720, 120224, 150728, 181232, 211736 | 1100 | AGX22429 | 29676 | 60180 | 90684, 121188, 151692, 182196, 212700 |
| 137 | ABN51188 | 28713 | 59217 | 89721, 120225, 150729, 181233, 211737 | 1101 | AGX22440 | 29677 | 60181 | 90685, 121189, 151693, 182197, 212701 |

FIG. 4 continued

| | | | | | | | | | |
|---|---|---|---|---|---|---|---|---|---|
| 138 | ABN51199 | 28714 | 59218 | 89722, 120226, 150730, 181234, 211738 | 1102 | AGX22449 | 29678 | 60182 | 90686, 121190, 151694, 182198, 212702 |
| 139 | ABN58665 | 28715 | 59219 | 89723, 120227, 150731, 181235, 211739 | 1103 | AGX22460 | 29679 | 60183 | 90687, 121191, 151695, 182199, 212703 |
| 140 | ABN59449 | 28716 | 59220 | 89724, 120228, 150732, 181236, 211740 | 1104 | AGX22471 | 29680 | 60184 | 90688, 121192, 151696, 182200, 212704 |
| 141 | ABR15999 | 28717 | 59221 | 89725, 120229, 150733, 181237, 211741 | 1105 | AGX22482 | 29681 | 60185 | 90689, 121193, 151697, 182201, 212705 |
| 142 | ABR16010 | 28718 | 59222 | 89726, 120230, 150734, 181238, 211742 | 1106 | AGX22493 | 29682 | 60186 | 90690, 121194, 151698, 182202, 212706 |
| 143 | ABR16021 | 28719 | 59223 | 89727, 120231, 150735, 181239, 211743 | 1107 | AGX22504 | 29683 | 60187 | 90691, 121195, 151699, 182203, 212707 |
| 144 | ACA64903 | 28720 | 59224 | 89728, 120232, 150736, 181240, 211744 | 1108 | AGX22515 | 29684 | 60188 | 90692, 121196, 151700, 182204, 212708 |
| 145 | ACA64914 | 28721 | 59225 | 89729, 120233, 150737, 181241, 211745 | 1109 | AGX22526 | 29685 | 60189 | 90693, 121197, 151701, 182205, 212709 |
| 146 | ACA64936 | 28722 | 59226 | 89730, 120234, 150738, 181242, 211746 | 1110 | AGX22548 | 29686 | 60190 | 90694, 121198, 151702, 182206, 212710 |
| 147 | ACA64969 | 28723 | 59227 | 89731, 120235, 150739, 181243, 211747 | 1111 | AGX22559 | 29687 | 60191 | 90695, 121199, 151703, 182207, 212711 |
| 148 | ACA64980 | 28724 | 59228 | 89732, 120236, 150740, 181244, 211748 | 1112 | AGX22570 | 29688 | 60192 | 90696, 121200, 151704, 182208, 212712 |
| 149 | ACA64991 | 28725 | 59229 | 89733, 120237, 150741, 181245, 211749 | 1113 | AGX22581 | 29689 | 60193 | 90697, 121201, 151705, 182209, 212713 |
| 150 | ACA65013 | 28726 | 59230 | 89734, 120238, 150742, 181246, 211750 | 1114 | AGX22592 | 29690 | 60194 | 90698, 121202, 151706, 182210, 212714 |
| 151 | ACA65024 | 28727 | 59231 | 89735, 120239, 150743, 181247, 211751 | 1115 | AGX22603 | 29691 | 60195 | 90699, 121203, 151707, 182211, 212715 |
| 152 | ACA65035 | 28728 | 59232 | 89736, 120240, 150744, 181248, 211752 | 1116 | AGX22614 | 29692 | 60196 | 90700, 121204, 151708, 182212, 212716 |
| 153 | ACA65046 | 28729 | 59233 | 89737, 120241, 150745, 181249, 211753 | 1117 | AGX22625 | 29693 | 60197 | 90701, 121205, 151709, 182213, 212717 |
| 154 | ACA65057 | 28730 | 59234 | 89738, 120242, 150746, 181250, 211754 | 1118 | AGX22636 | 29694 | 60198 | 90702, 121206, 151710, 182214, 212718 |
| 155 | ACA65068 | 28731 | 59235 | 89739, 120243, 150747, 181251, 211755 | 1119 | AGX22647 | 29695 | 60199 | 90703, 121207, 151711, 182215, 212719 |

FIG. 4 continued

| | | | | | | | | | |
|---|---|---|---|---|---|---|---|---|---|
| 156 | ACA65079 | 28732 | 59236 | 89740, 120244, 150748, 181252, 211756 | 1120 | AGX22658 | 29696 | 60200 | 90704, 121208, 151712, 182216, 212720 |
| 157 | ACA65090 | 28733 | 59237 | 89741, 120245, 150749, 181253, 211757 | 1121 | AGX22669 | 29697 | 60201 | 90705, 121209, 151713, 182217, 212721 |
| 158 | ACA65101 | 28734 | 59238 | 89742, 120246, 150750, 181254, 211758 | 1122 | AGX22680 | 29698 | 60202 | 90706, 121210, 151714, 182218, 212722 |
| 159 | ACA96567 | 28735 | 59239 | 89743, 120247, 150751, 181255, 211759 | 1123 | AGX22691 | 29699 | 60203 | 90707, 121211, 151715, 182219, 212723 |
| 160 | ACA96578 | 28736 | 59240 | 89744, 120248, 150752, 181256, 211760 | 1124 | AGX22702 | 29700 | 60204 | 90708, 121212, 151716, 182220, 212724 |
| 161 | ACA96589 | 28737 | 59241 | 89745, 120249, 150753, 181257, 211761 | 1125 | AGX22713 | 29701 | 60205 | 90709, 121213, 151717, 182221, 212725 |
| 162 | ACA96600 | 28738 | 59242 | 89746, 120250, 150754, 181258, 211762 | 1126 | AGX22724 | 29702 | 60206 | 90710, 121214, 151718, 182222, 212726 |
| 163 | ACA96611 | 28739 | 59243 | 89747, 120251, 150755, 181259, 211763 | 1127 | AGX22735 | 29703 | 60207 | 90711, 121215, 151719, 182223, 212727 |
| 164 | ACA96622 | 28740 | 59244 | 89748, 120252, 150756, 181260, 211764 | 1128 | AGX22746 | 29704 | 60208 | 90712, 121216, 151720, 182224, 212728 |
| 165 | ACA96633 | 28741 | 59245 | 89749, 120253, 150757, 181261, 211765 | 1129 | AGX22757 | 29705 | 60209 | 90713, 121217, 151721, 182225, 212729 |
| 166 | ACA96644 | 28742 | 59246 | 89750, 120254, 150758, 181262, 211766 | 1130 | AGX22768 | 29706 | 60210 | 90714, 121218, 151722, 182226, 212730 |
| 167 | ACA96655 | 28743 | 59247 | 89751, 120255, 150759, 181263, 211767 | 1131 | AGX22779 | 29707 | 60211 | 90715, 121219, 151723, 182227, 212731 |
| 168 | ACA96666 | 28744 | 59248 | 89752, 120256, 150760, 181264, 211768 | 1132 | AGX22790 | 29708 | 60212 | 90716, 121220, 151724, 182228, 212732 |
| 169 | ACD56581 | 28745 | 59249 | 89753, 120257, 150761, 181265, 211769 | 1133 | AGX22801 | 29709 | 60213 | 90717, 121221, 151725, 182229, 212733 |
| 170 | ACF33793 | 28746 | 59250 | 89754, 120258, 150762, 181266, 211770 | 1134 | AGX22812 | 29710 | 60214 | 90718, 121222, 151726, 182230, 212734 |
| 171 | ACF33795 | 28747 | 59251 | 89755, 120259, 150763, 181267, 211771 | 1135 | AGX22823 | 29711 | 60215 | 90719, 121223, 151727, 182231, 212735 |
| 172 | ACF33797 | 28748 | 59252 | 89756, 120260, 150764, 181268, 211772 | 1136 | AGX22834 | 29712 | 60216 | 90720, 121224, 151728, 182232, 212736 |
| 173 | ACF41662 | 28749 | 59253 | 89757, 120261, 150765, 181269, 211773 | 1137 | AGX22845 | 29713 | 60217 | 90721, 121225, 151729, 182233, 212737 |

FIG. 4 continued

| | | | | | | | | | |
|---|---|---|---|---|---|---|---|---|---|
| 174 | ACF54140 | 28750 | 59254 | 89758, 120262, 150766, 181270, 211774 | 1138 | AGX22856 | 29714 | 60218 | 90722, 121226, 151730, 182234, 212738 |
| 175 | ACF54151 | 28751 | 59255 | 89759, 120263, 150767, 181271, 211775 | 1139 | AGX22867 | 29715 | 60219 | 90723, 121227, 151731, 182235, 212739 |
| 176 | ACF54162 | 28752 | 59256 | 89760, 120264, 150768, 181272, 211776 | 1140 | AGX22878 | 29716 | 60220 | 90724, 121228, 151732, 182236, 212740 |
| 177 | ACF54184 | 28753 | 59257 | 89761, 120265, 150769, 181273, 211777 | 1141 | AGX22889 | 29717 | 60221 | 90725, 121229, 151733, 182237, 212741 |
| 178 | ACF54206 | 28754 | 59258 | 89762, 120266, 150770, 181274, 211778 | 1142 | AGX22900 | 29718 | 60222 | 90726, 121230, 151734, 182238, 212742 |
| 179 | ACF54217 | 28755 | 59259 | 89763, 120267, 150771, 181275, 211779 | 1143 | AGX22911 | 29719 | 60223 | 90727, 121231, 151735, 182239, 212743 |
| 180 | ACF54228 | 28756 | 59260 | 89764, 120268, 150772, 181276, 211780 | 1144 | AGX22922 | 29720 | 60224 | 90728, 121232, 151736, 182240, 212744 |
| 181 | ACF54239 | 28757 | 59261 | 89765, 120269, 150773, 181277, 211781 | 1145 | AGX22933 | 29721 | 60225 | 90729, 121233, 151737, 182241, 212745 |
| 182 | ACF54261 | 28758 | 59262 | 89766, 120270, 150774, 181278, 211782 | 1146 | AGX22944 | 29722 | 60226 | 90730, 121234, 151738, 182242, 212746 |
| 183 | ACF54272 | 28759 | 59263 | 89767, 120271, 150775, 181279, 211783 | 1147 | AGX22955 | 29723 | 60227 | 90731, 121235, 151739, 182243, 212747 |
| 184 | ACF54283 | 28760 | 59264 | 89768, 120272, 150776, 181280, 211784 | 1148 | AGX22966 | 29724 | 60228 | 90732, 121236, 151740, 182244, 212748 |
| 185 | ACF54294 | 28761 | 59265 | 89769, 120273, 150777, 181281, 211785 | 1149 | AGX22977 | 29725 | 60229 | 90733, 121237, 151741, 182245, 212749 |
| 186 | ACF54305 | 28762 | 59266 | 89770, 120274, 150778, 181282, 211786 | 1150 | AGX22988 | 29726 | 60230 | 90734, 121238, 151742, 182246, 212750 |
| 187 | ACF54316 | 28763 | 59267 | 89771, 120275, 150779, 181283, 211787 | 1151 | AGX22999 | 29727 | 60231 | 90735, 121239, 151743, 182247, 212751 |
| 188 | ACF54338 | 28764 | 59268 | 89772, 120276, 150780, 181284, 211788 | 1152 | AGX23010 | 29728 | 60232 | 90736, 121240, 151744, 182248, 212752 |
| 189 | ACF54349 | 28765 | 59269 | 89773, 120277, 150781, 181285, 211789 | 1153 | AGX23021 | 29729 | 60233 | 90737, 121241, 151745, 182249, 212753 |
| 190 | ACF54371 | 28766 | 59270 | 89774, 120278, 150782, 181286, 211790 | 1154 | AGX23032 | 29730 | 60234 | 90738, 121242, 151746, 182250, 212754 |
| 191 | ACI22549 | 28767 | 59271 | 89775, 120279, 150783, 181287, 211791 | 1155 | AGX23043 | 29731 | 60235 | 90739, 121243, 151747, 182251, 212755 |

FIG. 4 continued

| | | | | | | | | | |
|---|---|---|---|---|---|---|---|---|---|
| 192 | ACI22551 | 28768 | 59272 | 89776, 120280, 150784, 181288, 211792 | 1156 | AGX23054 | 29732 | 60236 | 90740, 121244, 151748, 182252, 212756 |
| 193 | ACI22555 | 28769 | 59273 | 89777, 120281, 150785, 181289, 211793 | 1157 | AGX23065 | 29733 | 60237 | 90741, 121245, 151749, 182253, 212757 |
| 194 | ACI22557 | 28770 | 59274 | 89778, 120282, 150786, 181290, 211794 | 1158 | AGX23076 | 29734 | 60238 | 90742, 121246, 151750, 182254, 212758 |
| 195 | ACI22559 | 28771 | 59275 | 89779, 120283, 150787, 181291, 211795 | 1159 | AGX23087 | 29735 | 60239 | 90743, 121247, 151751, 182255, 212759 |
| 196 | ACI22561 | 28772 | 59276 | 89780, 120284, 150788, 181292, 211796 | 1160 | AGX23098 | 29736 | 60240 | 90744, 121248, 151752, 182256, 212760 |
| 197 | ACI22563 | 28773 | 59277 | 89781, 120285, 150789, 181293, 211797 | 1161 | AGX23109 | 29737 | 60241 | 90745, 121249, 151753, 182257, 212761 |
| 198 | ACI22565 | 28774 | 59278 | 89782, 120286, 150790, 181294, 211798 | 1162 | AGX23120 | 29738 | 60242 | 90746, 121250, 151754, 182258, 212762 |
| 199 | ACI22567 | 28775 | 59279 | 89783, 120287, 150791, 181295, 211799 | 1163 | AGX23131 | 29739 | 60243 | 90747, 121251, 151755, 182259, 212763 |
| 200 | ACI22569 | 28776 | 59280 | 89784, 120288, 150792, 181296, 211800 | 1164 | AGX23142 | 29740 | 60244 | 90748, 121252, 151756, 182260, 212764 |
| 201 | ACJ53908 | 28777 | 59281 | 89785, 120289, 150793, 181297, 211801 | 1165 | AGX23153 | 29741 | 60245 | 90749, 121253, 151757, 182261, 212765 |
| 202 | ACN32560 | 28778 | 59282 | 89786, 120290, 150794, 181298, 211802 | 1166 | AGX23164 | 29742 | 60246 | 90750, 121254, 151758, 182262, 212766 |
| 203 | ACN32582 | 28779 | 59283 | 89787, 120291, 150795, 181299, 211803 | 1167 | AGX23175 | 29743 | 60247 | 90751, 121255, 151759, 182263, 212767 |
| 204 | ACN32593 | 28780 | 59284 | 89788, 120292, 150796, 181300, 211804 | 1168 | AGX23186 | 29744 | 60248 | 90752, 121256, 151760, 182264, 212768 |
| 205 | ACN32604 | 28781 | 59285 | 89789, 120293, 150797, 181301, 211805 | 1169 | AGX23197 | 29745 | 60249 | 90753, 121257, 151761, 182265, 212769 |
| 206 | ACN32615 | 28782 | 59286 | 89790, 120294, 150798, 181302, 211806 | 1170 | AGX23208 | 29746 | 60250 | 90754, 121258, 151762, 182266, 212770 |
| 207 | ACN32775 | 28783 | 59287 | 89791, 120295, 150799, 181303, 211807 | 1171 | AGX23219 | 29747 | 60251 | 90755, 121259, 151763, 182267, 212771 |
| 208 | ACN32786 | 28784 | 59288 | 89792, 120296, 150800, 181304, 211808 | 1172 | AGX23230 | 29748 | 60252 | 90756, 121260, 151764, 182268, 212772 |
| 209 | ACO05928 | 28785 | 59289 | 89793, 120297, 150801, 181305, 211809 | 1173 | AGX23241 | 29749 | 60253 | 90757, 121261, 151765, 182269, 212773 |

FIG. 4 continued

| | | | | | | | | | |
|---|---|---|---|---|---|---|---|---|---|
| 210 | ACD05950 | 28786 | 59290 | 89794, 120298, 150802, 181306, 211810 | 1174 | AGX23252 | 29750 | 60254 | 90758, 121262, 151766, 182270, 212774 |
| 211 | ACD05961 | 28787 | 59291 | 89795, 120299, 150803, 181307, 211811 | 1175 | AGX23263 | 29751 | 60255 | 90759, 121263, 151767, 182271, 212775 |
| 212 | ACD05972 | 28788 | 59292 | 89796, 120300, 150804, 181308, 211812 | 1176 | AGX23274 | 29752 | 60256 | 90760, 121264, 151768, 182272, 212776 |
| 213 | ACD05983 | 28789 | 59293 | 89797, 120301, 150805, 181309, 211813 | 1177 | AGX23285 | 29753 | 60257 | 90761, 121265, 151769, 182273, 212777 |
| 214 | ACD05994 | 28790 | 59294 | 89798, 120302, 150806, 181310, 211814 | 1178 | AGX23296 | 29754 | 60258 | 90762, 121266, 151770, 182274, 212778 |
| 215 | ACD06005 | 28791 | 59295 | 89799, 120303, 150807, 181311, 211815 | 1179 | AGX23307 | 29755 | 60259 | 90763, 121267, 151771, 182275, 212779 |
| 216 | ACD06027 | 28792 | 59296 | 89800, 120304, 150808, 181312, 211816 | 1180 | AGX23318 | 29756 | 60260 | 90764, 121268, 151772, 182276, 212780 |
| 217 | ACD06066 | 28793 | 59297 | 89801, 120305, 150809, 181313, 211817 | 1181 | AGX23329 | 29757 | 60261 | 90765, 121269, 151773, 182277, 212781 |
| 218 | ACD94665 | 28794 | 59298 | 89802, 120306, 150810, 181314, 211818 | 1182 | AGX23340 | 29758 | 60262 | 90766, 121270, 151774, 182278, 212782 |
| 219 | ACQ45607 | 28795 | 59299 | 89803, 120307, 150811, 181315, 211819 | 1183 | AGX23351 | 29759 | 60263 | 90767, 121271, 151775, 182279, 212783 |
| 220 | ACQ45610 | 28796 | 59300 | 89804, 120308, 150812, 181316, 211820 | 1184 | AGX23362 | 29760 | 60264 | 90768, 121272, 151776, 182280, 212784 |
| 221 | ACQ45613 | 28797 | 59301 | 89805, 120309, 150813, 181317, 211821 | 1185 | AGX23373 | 29761 | 60265 | 90769, 121273, 151777, 182281, 212785 |
| 222 | ACR15626 | 28798 | 59302 | 89806, 120310, 150814, 181318, 211822 | 1186 | AGX23384 | 29762 | 60266 | 90770, 121274, 151778, 182282, 212786 |
| 223 | ACR15637 | 28799 | 59303 | 89807, 120311, 150815, 181319, 211823 | 1187 | AGX23395 | 29763 | 60267 | 90771, 121275, 151779, 182283, 212787 |
| 224 | ACR15648 | 28800 | 59304 | 89808, 120312, 150816, 181320, 211824 | 1188 | AGX23417 | 29764 | 60268 | 90772, 121276, 151780, 182284, 212788 |
| 225 | ACR15659 | 28801 | 59305 | 89809, 120313, 150817, 181321, 211825 | 1189 | AGX23428 | 29765 | 60269 | 90773, 121277, 151781, 182285, 212789 |
| 226 | ACR15670 | 28802 | 59306 | 89810, 120314, 150818, 181322, 211826 | 1190 | AGX23450 | 29766 | 60270 | 90774, 121278, 151782, 182286, 212790 |
| 227 | ACR15681 | 28803 | 59307 | 89811, 120315, 150819, 181323, 211827 | 1191 | AGX23461 | 29767 | 60271 | 90775, 121279, 151783, 182287, 212791 |

FIG. 4 continued

| | | | | | | | | | |
|---|---|---|---|---|---|---|---|---|---|
| 228 | ACR15692 | 28804 | 59308 | 89812, 120316, 150820, 181324, 211828 | 1192 | AGX23472 | 29768 | 60272 | 90776, 121280, 151784, 182288, 212792 |
| 229 | ACR15703 | 28805 | 59309 | 89813, 120317, 150821, 181325, 211829 | 1193 | AGX23483 | 29769 | 60273 | 90777, 121281, 151785, 182289, 212793 |
| 230 | ACR15714 | 28806 | 59310 | 89814, 120318, 150822, 181326, 211830 | 1194 | AGX23494 | 29770 | 60274 | 90778, 121282, 151786, 182290, 212794 |
| 231 | ACR15725 | 28807 | 59311 | 89815, 120319, 150823, 181327, 211831 | 1195 | AGX23505 | 29771 | 60275 | 90779, 121283, 151787, 182291, 212795 |
| 232 | ACR15736 | 28808 | 59312 | 89816, 120320, 150824, 181328, 211832 | 1196 | AGX23516 | 29772 | 60276 | 90780, 121284, 151788, 182292, 212796 |
| 233 | ACR39340 | 28809 | 59313 | 89817, 120321, 150825, 181329, 211833 | 1197 | AGX23527 | 29773 | 60277 | 90781, 121285, 151789, 182293, 212797 |
| 234 | ADL28399 | 28810 | 59314 | 89818, 120322, 150826, 181330, 211834 | 1198 | AGX23538 | 29774 | 60278 | 90782, 121286, 151790, 182294, 212798 |
| 235 | ADN32822 | 28811 | 59315 | 89819, 120323, 150827, 181331, 211835 | 1199 | AGX23549 | 29775 | 60279 | 90783, 121287, 151791, 182295, 212799 |
| 236 | ADR02756 | 28812 | 59316 | 89820, 120324, 150828, 181332, 211836 | 1200 | AGX23560 | 29776 | 60280 | 90784, 121288, 151792, 182296, 212800 |
| 237 | AEA51353 | 28813 | 59317 | 89821, 120325, 150829, 181333, 211837 | 1201 | AGX23571 | 29777 | 60281 | 90785, 121289, 151793, 182297, 212801 |
| 238 | AEA51355 | 28814 | 59318 | 89822, 120326, 150830, 181334, 211838 | 1202 | AGX23582 | 29778 | 60282 | 90786, 121290, 151794, 182298, 212802 |
| 239 | AEA51357 | 28815 | 59319 | 89823, 120327, 150831, 181335, 211839 | 1203 | AGX23593 | 29779 | 60283 | 90787, 121291, 151795, 182299, 212803 |
| 240 | AEA51359 | 28816 | 59320 | 89824, 120328, 150832, 181336, 211840 | 1204 | AGX23604 | 29780 | 60284 | 90788, 121292, 151796, 182300, 212804 |
| 241 | AEA51365 | 28817 | 59321 | 89825, 120329, 150833, 181337, 211841 | 1205 | AGX23615 | 29781 | 60285 | 90789, 121293, 151797, 182301, 212805 |
| 242 | AEA51367 | 28818 | 59322 | 89826, 120330, 150834, 181338, 211842 | 1206 | AGX23626 | 29782 | 60286 | 90790, 121294, 151798, 182302, 212806 |
| 243 | AEA51371 | 28819 | 59323 | 89827, 120331, 150835, 181339, 211843 | 1207 | AGX23637 | 29783 | 60287 | 90791, 121295, 151799, 182303, 212807 |
| 244 | AEA51373 | 28820 | 59324 | 89828, 120332, 150836, 181340, 211844 | 1208 | AGX23659 | 29784 | 60288 | 90792, 121296, 151800, 182304, 212808 |
| 245 | AEA51377 | 28821 | 59325 | 89829, 120333, 150837, 181341, 211845 | 1209 | AGX23670 | 29785 | 60289 | 90793, 121297, 151801, 182305, 212809 |

FIG. 4 continued

| | | | | | | | | | |
|---|---|---|---|---|---|---|---|---|---|
| 246 | AEA51379 | 28822 | 59326 | 89830, 120334, 150838, 181342, 211846 | 1210 | AGX23681 | 29786 | 60290 | 90794, 121298, 151802, 182306, 212810 |
| 247 | AEA51381 | 28823 | 59327 | 89831, 120335, 150839, 181343, 211847 | 1211 | AGX23692 | 29787 | 60291 | 90795, 121299, 151803, 182307, 212811 |
| 248 | AEA51383 | 28824 | 59328 | 89832, 120336, 150840, 181344, 211848 | 1212 | AGX23703 | 29788 | 60292 | 90796, 121300, 151804, 182308, 212812 |
| 249 | AEG20998 | 28825 | 59329 | 89833, 120337, 150841, 181345, 211849 | 1213 | AGX23714 | 29789 | 60293 | 90797, 121301, 151805, 182309, 212813 |
| 250 | AEG20999 | 28826 | 59330 | 89834, 120338, 150842, 181346, 211850 | 1214 | AGX23725 | 29790 | 60294 | 90798, 121302, 151806, 182310, 212814 |
| 251 | AEG21000 | 28827 | 59331 | 89835, 120339, 150843, 181347, 211851 | 1215 | AGX23736 | 29791 | 60295 | 90799, 121303, 151807, 182311, 212815 |
| 252 | AEG21002 | 28828 | 59332 | 89836, 120340, 150844, 181348, 211852 | 1216 | AGX23747 | 29792 | 60296 | 90800, 121304, 151808, 182312, 212816 |
| 253 | AEG21003 | 28829 | 59333 | 89837, 120341, 150845, 181349, 211853 | 1217 | AGX23758 | 29793 | 60297 | 90801, 121305, 151809, 182313, 212817 |
| 254 | AEG21004 | 28830 | 59334 | 89838, 120342, 150846, 181350, 211854 | 1218 | AGX23769 | 29794 | 60298 | 90802, 121306, 151810, 182314, 212818 |
| 255 | AEG21005 | 28831 | 59335 | 89839, 120343, 150847, 181351, 211855 | 1219 | AGX23780 | 29795 | 60299 | 90803, 121307, 151811, 182315, 212819 |
| 256 | AEG21006 | 28832 | 59336 | 89840, 120344, 150848, 181352, 211856 | 1220 | AGX23791 | 29796 | 60300 | 90804, 121308, 151812, 182316, 212820 |
| 257 | AEG21007 | 28833 | 59337 | 89841, 120345, 150849, 181353, 211857 | 1221 | AGX23802 | 29797 | 60301 | 90805, 121309, 151813, 182317, 212821 |
| 258 | AEG21008 | 28834 | 59338 | 89842, 120346, 150850, 181354, 211858 | 1222 | AGX23813 | 29798 | 60302 | 90806, 121310, 151814, 182318, 212822 |
| 259 | AEG21009 | 28835 | 59339 | 89843, 120347, 150851, 181355, 211859 | 1223 | AGX23824 | 29799 | 60303 | 90807, 121311, 151815, 182319, 212823 |
| 260 | AEG21010 | 28836 | 59340 | 89844, 120348, 150852, 181356, 211860 | 1224 | AGX23846 | 29800 | 60304 | 90808, 121312, 151816, 182320, 212824 |
| 261 | AEG21011 | 28837 | 59341 | 89845, 120349, 150853, 181357, 211861 | 1225 | AGX23857 | 29801 | 60305 | 90809, 121313, 151817, 182321, 212825 |
| 262 | AEG21012 | 28838 | 59342 | 89846, 120350, 150854, 181358, 211862 | 1226 | AGX23868 | 29802 | 60306 | 90810, 121314, 151818, 182322, 212826 |
| 263 | AEG21013 | 28839 | 59343 | 89847, 120351, 150855, 181359, 211863 | 1227 | AGX23879 | 29803 | 60307 | 90811, 121315, 151819, 182323, 212827 |

FIG. 4 continued

| | | | | | | | | | |
|---|---|---|---|---|---|---|---|---|---|
| 264 | AEN68957 | 28840 | 59344 | 89848, 120352, 150856, 181360, 211864 | 1228 | AGX23890 | 29804 | 60308 | 90812, 121316, 151820, 182324, 212828 |
| 265 | AE080071 | 28841 | 59345 | 89849, 120353, 150857, 181361, 211865 | 1229 | AGX23901 | 29805 | 60309 | 90813, 121317, 151821, 182325, 212829 |
| 266 | AE080082 | 28842 | 59346 | 89850, 120354, 150858, 181362, 211866 | 1230 | AGX23912 | 29806 | 60310 | 90814, 121318, 151822, 182326, 212830 |
| 267 | AE080090 | 28843 | 59347 | 89851, 120355, 150859, 181363, 211867 | 1231 | AGX23934 | 29807 | 60311 | 90815, 121319, 151823, 182327, 212831 |
| 268 | AE080101 | 28844 | 59348 | 89852, 120356, 150860, 181364, 211868 | 1232 | AGX23945 | 29808 | 60312 | 90816, 121320, 151824, 182328, 212832 |
| 269 | AE080149 | 28845 | 59349 | 89853, 120357, 150861, 181365, 211869 | 1233 | AGX23956 | 29809 | 60313 | 90817, 121321, 151825, 182329, 212833 |
| 270 | AE080158 | 28846 | 59350 | 89854, 120358, 150862, 181366, 211870 | 1234 | AGX23967 | 29810 | 60314 | 90818, 121322, 151826, 182330, 212834 |
| 271 | AE080167 | 28847 | 59351 | 89855, 120359, 150863, 181367, 211871 | 1235 | AGX23978 | 29811 | 60315 | 90819, 121323, 151827, 182331, 212835 |
| 272 | AE080176 | 28848 | 59352 | 89856, 120360, 150864, 181368, 211872 | 1236 | AGX23989 | 29812 | 60316 | 90820, 121324, 151828, 182332, 212836 |
| 273 | AE080187 | 28849 | 59353 | 89857, 120361, 150865, 181369, 211873 | 1237 | AGX24000 | 29813 | 60317 | 90821, 121325, 151829, 182333, 212837 |
| 274 | AE080198 | 28850 | 59354 | 89858, 120362, 150866, 181370, 211874 | 1238 | AGX24011 | 29814 | 60318 | 90822, 121326, 151830, 182334, 212838 |
| 275 | AE080209 | 28851 | 59355 | 89859, 120363, 150867, 181371, 211875 | 1239 | AGX24022 | 29815 | 60319 | 90823, 121327, 151831, 182335, 212839 |
| 276 | AE080220 | 28852 | 59356 | 89860, 120364, 150868, 181372, 211876 | 1240 | AGX24033 | 29816 | 60320 | 90824, 121328, 151832, 182336, 212840 |
| 277 | AE080231 | 28853 | 59357 | 89861, 120365, 150869, 181373, 211877 | 1241 | AGX24044 | 29817 | 60321 | 90825, 121329, 151833, 182337, 212841 |
| 278 | AE080242 | 28854 | 59358 | 89862, 120366, 150870, 181374, 211878 | 1242 | AGX24055 | 29818 | 60322 | 90826, 121330, 151834, 182338, 212842 |
| 279 | AEP20182 | 28855 | 59359 | 89863, 120367, 150871, 181375, 211879 | 1243 | AGX24066 | 29819 | 60323 | 90827, 121331, 151835, 182339, 212843 |
| 280 | AEP20193 | 28856 | 59360 | 89864, 120368, 150872, 181376, 211880 | 1244 | AGX24077 | 29820 | 60324 | 90828, 121332, 151836, 182340, 212844 |
| 281 | AEP20204 | 28857 | 59361 | 89865, 120369, 150873, 181377, 211881 | 1245 | AGX24088 | 29821 | 60325 | 90829, 121333, 151837, 182341, 212845 |

FIG. 4 continued

| | | | | | | | | | |
|---|---|---|---|---|---|---|---|---|---|
| 282 | AEP20215 | 28858 | 59362 | 89866, 120370, 150874, 181378, 211882 | 1246 | AGX24099 | 29822 | 60326 | 90830, 121334, 151838, 182342, 212846 |
| 283 | AEP20237 | 28859 | 59363 | 89867, 120371, 150875, 181379, 211883 | 1247 | AGX24110 | 29823 | 60327 | 90831, 121335, 151839, 182343, 212847 |
| 284 | AEP20248 | 28860 | 59364 | 89868, 120372, 150876, 181380, 211884 | 1248 | AGX24121 | 29824 | 60328 | 90832, 121336, 151840, 182344, 212848 |
| 285 | AEP20259 | 28861 | 59365 | 89869, 120373, 150877, 181381, 211885 | 1249 | AGX24132 | 29825 | 60329 | 90833, 121337, 151841, 182345, 212849 |
| 286 | AEP20281 | 28862 | 59366 | 89870, 120374, 150878, 181382, 211886 | 1250 | AGX24143 | 29826 | 60330 | 90834, 121338, 151842, 182346, 212850 |
| 287 | AEP20292 | 28863 | 59367 | 89871, 120375, 150879, 181383, 211887 | 1251 | AGX24154 | 29827 | 60331 | 90835, 121339, 151843, 182347, 212851 |
| 288 | AEP20303 | 28864 | 59368 | 89872, 120376, 150880, 181384, 211888 | 1252 | AGX24165 | 29828 | 60332 | 90836, 121340, 151844, 182348, 212852 |
| 289 | AEP20314 | 28865 | 59369 | 89873, 120377, 150881, 181385, 211889 | 1253 | AGX24176 | 29829 | 60333 | 90837, 121341, 151845, 182349, 212853 |
| 290 | AEP20336 | 28866 | 59370 | 89874, 120378, 150882, 181386, 211890 | 1254 | AGX24187 | 29830 | 60334 | 90838, 121342, 151846, 182350, 212854 |
| 291 | AEP20347 | 28867 | 59371 | 89875, 120379, 150883, 181387, 211891 | 1255 | AGX24198 | 29831 | 60335 | 90839, 121343, 151847, 182351, 212855 |
| 292 | AEP20358 | 28868 | 59372 | 89876, 120380, 150884, 181388, 211892 | 1256 | AGX24231 | 29832 | 60336 | 90840, 121344, 151848, 182352, 212856 |
| 293 | AEP20369 | 28869 | 59373 | 89877, 120381, 150885, 181389, 211893 | 1257 | AGX24242 | 29833 | 60337 | 90841, 121345, 151849, 182353, 212857 |
| 294 | AEP20380 | 28870 | 59374 | 89878, 120382, 150886, 181390, 211894 | 1258 | AGX24275 | 29834 | 60338 | 90842, 121346, 151850, 182354, 212858 |
| 295 | AEP20391 | 28871 | 59375 | 89879, 120383, 150887, 181391, 211895 | 1259 | AGX24286 | 29835 | 60339 | 90843, 121347, 151851, 182355, 212859 |
| 296 | AEP20413 | 28872 | 59376 | 89880, 120384, 150888, 181392, 211896 | 1260 | AGX24297 | 29836 | 60340 | 90844, 121348, 151852, 182356, 212860 |
| 297 | AEP20435 | 28873 | 59377 | 89881, 120385, 150889, 181393, 211897 | 1261 | AGX24319 | 29837 | 60341 | 90845, 121349, 151853, 182357, 212861 |
| 298 | AEQ39031 | 28874 | 59378 | 89882, 120386, 150890, 181394, 211898 | 1262 | AGX24330 | 29838 | 60342 | 90846, 121350, 151854, 182358, 212862 |
| 299 | AEQ39275 | 28875 | 59379 | 89883, 120387, 150891, 181395, 211899 | 1263 | AGX24341 | 29839 | 60343 | 90847, 121351, 151855, 182359, 212863 |

FIG. 4 continued

| | | | | | | | | | |
|---|---|---|---|---|---|---|---|---|---|
| 300 | AEQ39286 | 28876 | 59380 | 89884, 120388, 150892, 181396, 211900 | 1264 | AGX24352 | 29840 | 60344 | 90848, 121352, 151856, 182360, 212864 |
| 301 | AEQ39297 | 28877 | 59381 | 89885, 120389, 150893, 181397, 211901 | 1265 | AGX24363 | 29841 | 60345 | 90849, 121353, 151857, 182361, 212865 |
| 302 | AEQ39308 | 28878 | 59382 | 89886, 120390, 150894, 181398, 211902 | 1266 | AGX24374 | 29842 | 60346 | 90850, 121354, 151858, 182362, 212866 |
| 303 | AEQ39319 | 28879 | 59383 | 89887, 120391, 150895, 181399, 211903 | 1267 | AGX24385 | 29843 | 60347 | 90851, 121355, 151859, 182363, 212867 |
| 304 | AEQ39330 | 28880 | 59384 | 89888, 120392, 150896, 181400, 211904 | 1268 | AGX24396 | 29844 | 60348 | 90852, 121356, 151860, 182364, 212868 |
| 305 | AEQ39341 | 28881 | 59385 | 89889, 120393, 150897, 181401, 211905 | 1269 | AGX24407 | 29845 | 60349 | 90853, 121357, 151861, 182365, 212869 |
| 306 | AEQ39352 | 28882 | 59386 | 89890, 120394, 150898, 181402, 211906 | 1270 | AGX24418 | 29846 | 60350 | 90854, 121358, 151862, 182366, 212870 |
| 307 | AEQ39363 | 28883 | 59387 | 89891, 120395, 150899, 181403, 211907 | 1271 | AGX24429 | 29847 | 60351 | 90855, 121359, 151863, 182367, 212871 |
| 308 | AEQ39374 | 28884 | 59388 | 89892, 120396, 150900, 181404, 211908 | 1272 | AGX24440 | 29848 | 60352 | 90856, 121360, 151864, 182368, 212872 |
| 309 | AEQ39385 | 28885 | 59389 | 89893, 120397, 150901, 181405, 211909 | 1273 | AGX24451 | 29849 | 60353 | 90857, 121361, 151865, 182369, 212873 |
| 310 | AEQ39444 | 28886 | 59390 | 89894, 120398, 150902, 181406, 211910 | 1274 | AGX24462 | 29850 | 60354 | 90858, 121362, 151866, 182370, 212874 |
| 311 | AEQ39455 | 28887 | 59391 | 89895, 120399, 150903, 181407, 211911 | 1275 | AGX24473 | 29851 | 60355 | 90859, 121363, 151867, 182371, 212875 |
| 312 | AEQ39466 | 28888 | 59392 | 89896, 120400, 150904, 181408, 211912 | 1276 | AGX24484 | 29852 | 60356 | 90860, 121364, 151868, 182372, 212876 |
| 313 | AEQ39477 | 28889 | 59393 | 89897, 120401, 150905, 181409, 211913 | 1277 | AGX24495 | 29853 | 60357 | 90861, 121365, 151869, 182373, 212877 |
| 314 | AEQ39488 | 28890 | 59394 | 89898, 120402, 150906, 181410, 211914 | 1278 | AGX24506 | 29854 | 60358 | 90862, 121366, 151870, 182374, 212878 |
| 315 | AEQ39499 | 28891 | 59395 | 89899, 120403, 150907, 181411, 211915 | 1279 | AGX24517 | 29855 | 60359 | 90863, 121367, 151871, 182375, 212879 |
| 316 | AEQ39510 | 28892 | 59396 | 89900, 120404, 150908, 181412, 211916 | 1280 | AGX24528 | 29856 | 60360 | 90864, 121368, 151872, 182376, 212880 |
| 317 | AEQ49685 | 28893 | 59397 | 89901, 120405, 150909, 181413, 211917 | 1281 | AGX24539 | 29857 | 60361 | 90865, 121369, 151873, 182377, 212881 |

FIG. 4 continued

| | | | | | | | | | |
|---|---|---|---|---|---|---|---|---|---|
| 318 | AEQ49686 | 28894 | 59398 | 89902, 120406, 150910, 181414, 211918 | 1282 | AGX24550 | 29858 | 60362 | 90866, 121370, 151874, 182378, 212882 |
| 319 | AEQ49687 | 28895 | 59399 | 89903, 120407, 150911, 181415, 211919 | 1283 | AGX24561 | 29859 | 60363 | 90867, 121371, 151875, 182379, 212883 |
| 320 | AEQ49688 | 28896 | 59400 | 89904, 120408, 150912, 181416, 211920 | 1284 | AGX24572 | 29860 | 60364 | 90868, 121372, 151876, 182380, 212884 |
| 321 | AEQ49691 | 28897 | 59401 | 89905, 120409, 150913, 181417, 211921 | 1285 | AGX24583 | 29861 | 60365 | 90869, 121373, 151877, 182381, 212885 |
| 322 | AEQ49692 | 28898 | 59402 | 89906, 120410, 150914, 181418, 211922 | 1286 | AGX24594 | 29862 | 60366 | 90870, 121374, 151878, 182382, 212886 |
| 323 | AEQ49693 | 28899 | 59403 | 89907, 120411, 150915, 181419, 211923 | 1287 | AGX24605 | 29863 | 60367 | 90871, 121375, 151879, 182383, 212887 |
| 324 | AEQ49695 | 28900 | 59404 | 89908, 120412, 150916, 181420, 211924 | 1288 | AGX24616 | 29864 | 60368 | 90872, 121376, 151880, 182384, 212888 |
| 325 | AEQ49697 | 28901 | 59405 | 89909, 120413, 150917, 181421, 211925 | 1289 | AGX24627 | 29865 | 60369 | 90873, 121377, 151881, 182385, 212889 |
| 326 | AEQ49698 | 28902 | 59406 | 89910, 120414, 150918, 181422, 211926 | 1290 | AGX24638 | 29866 | 60370 | 90874, 121378, 151882, 182386, 212890 |
| 327 | AEQ49699 | 28903 | 59407 | 89911, 120415, 150919, 181423, 211927 | 1291 | AGX24660 | 29867 | 60371 | 90875, 121379, 151883, 182387, 212891 |
| 328 | AEQ49700 | 28904 | 59408 | 89912, 120416, 150920, 181424, 211928 | 1292 | AGX24671 | 29868 | 60372 | 90876, 121380, 151884, 182388, 212892 |
| 329 | AEQ49701 | 28905 | 59409 | 89913, 120417, 150921, 181425, 211929 | 1293 | AGX24682 | 29869 | 60373 | 90877, 121381, 151885, 182389, 212893 |
| 330 | AEQ49702 | 28906 | 59410 | 89914, 120418, 150922, 181426, 211930 | 1294 | AGX24693 | 29870 | 60374 | 90878, 121382, 151886, 182390, 212894 |
| 331 | AEQ49703 | 28907 | 59411 | 89915, 120419, 150923, 181427, 211931 | 1295 | AGX24704 | 29871 | 60375 | 90879, 121383, 151887, 182391, 212895 |
| 332 | AEQ49705 | 28908 | 59412 | 89916, 120420, 150924, 181428, 211932 | 1296 | AGX24715 | 29872 | 60376 | 90880, 121384, 151888, 182392, 212896 |
| 333 | AEQ49706 | 28909 | 59413 | 89917, 120421, 150925, 181429, 211933 | 1297 | AGX24737 | 29873 | 60377 | 90881, 121385, 151889, 182393, 212897 |
| 334 | AEQ49707 | 28910 | 59414 | 89918, 120422, 150926, 181430, 211934 | 1298 | AGX24748 | 29874 | 60378 | 90882, 121386, 151890, 182394, 212898 |
| 335 | AEQ49708 | 28911 | 59415 | 89919, 120423, 150927, 181431, 211935 | 1299 | AGX24759 | 29875 | 60379 | 90883, 121387, 151891, 182395, 212899 |

FIG. 4 continued

| | | | | | | | | | |
|---|---|---|---|---|---|---|---|---|---|
| 336 | AEQ49709 | 28912 | 59416 | 89920, 120424, 150928, 181432, 211936 | 1300 | AGX24770 | 29876 | 60380 | 90884, 121388, 151892, 182396, 212900 |
| 337 | AEQ49710 | 28913 | 59417 | 89921, 120425, 150929, 181433, 211937 | 1301 | AGX24781 | 29877 | 60381 | 90885, 121389, 151893, 182397, 212901 |
| 338 | AER27042 | 28914 | 59418 | 89922, 120426, 150930, 181434, 211938 | 1302 | AGX24792 | 29878 | 60382 | 90886, 121390, 151894, 182398, 212902 |
| 339 | AER27053 | 28915 | 59419 | 89923, 120427, 150931, 181435, 211939 | 1303 | AGX24803 | 29879 | 60383 | 90887, 121391, 151895, 182399, 212903 |
| 340 | AER27064 | 28916 | 59420 | 89924, 120428, 150932, 181436, 211940 | 1304 | AGX24814 | 29880 | 60384 | 90888, 121392, 151896, 182400, 212904 |
| 341 | AET43128 | 28917 | 59421 | 89925, 120429, 150933, 181437, 211941 | 1305 | AGX24825 | 29881 | 60385 | 90889, 121393, 151897, 182401, 212905 |
| 342 | AET43139 | 28918 | 59422 | 89926, 120430, 150934, 181438, 211942 | 1306 | AGX24836 | 29882 | 60386 | 90890, 121394, 151898, 182402, 212906 |
| 343 | AET43150 | 28919 | 59423 | 89927, 120431, 150935, 181439, 211943 | 1307 | AGX24847 | 29883 | 60387 | 90891, 121395, 151899, 182403, 212907 |
| 344 | AET43161 | 28920 | 59424 | 89928, 120432, 150936, 181440, 211944 | 1308 | AGX24858 | 29884 | 60388 | 90892, 121396, 151900, 182404, 212908 |
| 345 | AET43172 | 28921 | 59425 | 89929, 120433, 150937, 181441, 211945 | 1309 | AGX24869 | 29885 | 60389 | 90893, 121397, 151901, 182405, 212909 |
| 346 | AET43183 | 28922 | 59426 | 89930, 120434, 150938, 181442, 211946 | 1310 | AGX24880 | 29886 | 60390 | 90894, 121398, 151902, 182406, 212910 |
| 347 | AET43194 | 28923 | 59427 | 89931, 120435, 150939, 181443, 211947 | 1311 | AGX24902 | 29887 | 60391 | 90895, 121399, 151903, 182407, 212911 |
| 348 | AET43216 | 28924 | 59428 | 89932, 120436, 150940, 181444, 211948 | 1312 | AGX84846 | 29888 | 60392 | 90896, 121400, 151904, 182408, 212912 |
| 349 | AET43227 | 28925 | 59429 | 89933, 120437, 150941, 181445, 211949 | 1313 | AGX84858 | 29889 | 60393 | 90897, 121401, 151905, 182409, 212913 |
| 350 | AET50947 | 28926 | 59430 | 89934, 120438, 150942, 181446, 211950 | 1314 | AGX84869 | 29890 | 60394 | 90898, 121402, 151906, 182410, 212914 |
| 351 | AET50958 | 28927 | 59431 | 89935, 120439, 150943, 181447, 211951 | 1315 | AGX84880 | 29891 | 60395 | 90899, 121403, 151907, 182411, 212915 |
| 352 | AET50969 | 28928 | 59432 | 89936, 120440, 150944, 181448, 211952 | 1316 | AGX84891 | 29892 | 60396 | 90900, 121404, 151908, 182412, 212916 |
| 353 | AET50980 | 28929 | 59433 | 89937, 120441, 150945, 181449, 211953 | 1317 | AGX84902 | 29893 | 60397 | 90901, 121405, 151909, 182413, 212917 |

FIG. 4 continued

| | | | | | | | | | |
|---|---|---|---|---|---|---|---|---|---|
| 354 | AET74259 | 28930 | 59434 | 89938, 120442, 150946, 181450, 211954 | 1318 | AGX84924 | 29894 | 60398 | 90902, 121406, 151910, 182414, 212918 |
| 355 | AET74270 | 28931 | 59435 | 89939, 120443, 150947, 181451, 211955 | 1319 | AGY46393 | 29895 | 60399 | 90903, 121407, 151911, 182415, 212919 |
| 356 | AET74281 | 28932 | 59436 | 89940, 120444, 150948, 181452, 211956 | 1320 | AGY46397 | 29896 | 60400 | 90904, 121408, 151912, 182416, 212920 |
| 357 | AET74292 | 28933 | 59437 | 89941, 120445, 150949, 181453, 211957 | 1321 | AGY46399 | 29897 | 60401 | 90905, 121409, 151913, 182417, 212921 |
| 358 | AET74303 | 28934 | 59438 | 89942, 120446, 150950, 181454, 211958 | 1322 | AGY46401 | 29898 | 60402 | 90906, 121410, 151914, 182418, 212922 |
| 359 | AET74314 | 28935 | 59439 | 89943, 120447, 150951, 181455, 211959 | 1323 | AGZ59825 | 29899 | 60403 | 90907, 121411, 151915, 182419, 212923 |
| 360 | AET74333 | 28936 | 59440 | 89944, 120448, 150952, 181456, 211960 | 1324 | AGZ59836 | 29900 | 60404 | 90908, 121412, 151916, 182420, 212924 |
| 361 | AET74344 | 28937 | 59441 | 89945, 120449, 150953, 181457, 211961 | 1325 | AGZ59847 | 29901 | 60405 | 90909, 121413, 151917, 182421, 212925 |
| 362 | AET74355 | 28938 | 59442 | 89946, 120450, 150954, 181458, 211962 | 1326 | AGZ59858 | 29902 | 60406 | 90910, 121414, 151918, 182422, 212926 |
| 363 | AEY75594 | 28939 | 59443 | 89947, 120451, 150955, 181459, 211963 | 1327 | AGZ59869 | 29903 | 60407 | 90911, 121415, 151919, 182423, 212927 |
| 364 | AFA45223 | 28940 | 59444 | 89948, 120452, 150956, 181460, 211964 | 1328 | AGZ59880 | 29904 | 60408 | 90912, 121416, 151920, 182424, 212928 |
| 365 | AFA45226 | 28941 | 59445 | 89949, 120453, 150957, 181461, 211965 | 1329 | AGZ59891 | 29905 | 60409 | 90913, 121417, 151921, 182425, 212929 |
| 366 | AFA45229 | 28942 | 59446 | 89950, 120454, 150958, 181462, 211966 | 1330 | AGZ59902 | 29906 | 60410 | 90914, 121418, 151922, 182426, 212930 |
| 367 | AFA45235 | 28943 | 59447 | 89951, 120455, 150959, 181463, 211967 | 1331 | AGZ59913 | 29907 | 60411 | 90915, 121419, 151923, 182427, 212931 |
| 368 | AFA45238 | 28944 | 59448 | 89952, 120456, 150960, 181464, 211968 | 1332 | AGZ59924 | 29908 | 60412 | 90916, 121420, 151924, 182428, 212932 |
| 369 | AFA45241 | 28945 | 59449 | 89953, 120457, 150961, 181465, 211969 | 1333 | AGZ59935 | 29909 | 60413 | 90917, 121421, 151925, 182429, 212933 |
| 370 | AFA45244 | 28946 | 59450 | 89954, 120458, 150962, 181466, 211970 | 1334 | AGZ59946 | 29910 | 60414 | 90918, 121422, 151926, 182430, 212934 |
| 371 | AFA45247 | 28947 | 59451 | 89955, 120459, 150963, 181467, 211971 | 1335 | AGZ59957 | 29911 | 60415 | 90919, 121423, 151927, 182431, 212935 |

FIG. 4 continued

| | | | | | | | | | |
|---|---|---|---|---|---|---|---|---|---|
| 372 | AFA45250 | 28948 | 59452 | 89956, 120460, 150964, 181468, 211972 | 1336 | AGZ59969 | 29912 | 60416 | 90920, 121424, 151928, 182432, 212936 |
| 373 | AFA45253 | 28949 | 59453 | 89957, 120461, 150965, 181469, 211973 | 1337 | AGZ59980 | 29913 | 60417 | 90921, 121425, 151929, 182433, 212937 |
| 374 | AFB77645 | 28950 | 59454 | 89958, 120462, 150966, 181470, 211974 | 1338 | AGZ59991 | 29914 | 60418 | 90922, 121426, 151930, 182434, 212938 |
| 375 | AFB77647 | 28951 | 59455 | 89959, 120463, 150967, 181471, 211975 | 1339 | AGZ60003 | 29915 | 60419 | 90923, 121427, 151931, 182435, 212939 |
| 376 | AFB77649 | 28952 | 59456 | 89960, 120464, 150968, 181472, 211976 | 1340 | AGZ60014 | 29916 | 60420 | 90924, 121428, 151932, 182436, 212940 |
| 377 | AFB77651 | 28953 | 59457 | 89961, 120465, 150969, 181473, 211977 | 1341 | AGZ60025 | 29917 | 60421 | 90925, 121429, 151933, 182437, 212941 |
| 378 | AFE00364 | 28954 | 59458 | 89962, 120466, 150970, 181474, 211978 | 1342 | AGZ60037 | 29918 | 60422 | 90926, 121430, 151934, 182438, 212942 |
| 379 | AFF18536 | 28955 | 59459 | 89963, 120467, 150971, 181475, 211979 | 1343 | AGZ60048 | 29919 | 60423 | 90927, 121431, 151935, 182439, 212943 |
| 380 | AFF18545 | 28956 | 59460 | 89964, 120468, 150972, 181476, 211980 | 1344 | AGZ60059 | 29920 | 60424 | 90928, 121432, 151936, 182440, 212944 |
| 381 | AFH34933 | 28957 | 59461 | 89965, 120469, 150973, 181477, 211981 | 1345 | AGZ60070 | 29921 | 60425 | 90929, 121433, 151937, 182441, 212945 |
| 382 | AFH34939 | 28958 | 59462 | 89966, 120470, 150974, 181478, 211982 | 1346 | AGZ60081 | 29922 | 60426 | 90930, 121434, 151938, 182442, 212946 |
| 383 | AFH57869 | 28959 | 59463 | 89967, 120471, 150975, 181479, 211983 | 1347 | AGZ60092 | 29923 | 60427 | 90931, 121435, 151939, 182443, 212947 |
| 384 | AFH57891 | 28960 | 59464 | 89968, 120472, 150976, 181480, 211984 | 1348 | AGZ60103 | 29924 | 60428 | 90932, 121436, 151940, 182444, 212948 |
| 385 | AFH57913 | 28961 | 59465 | 89969, 120473, 150977, 181481, 211985 | 1349 | AGZ60135 | 29925 | 60429 | 90933, 121437, 151941, 182445, 212949 |
| 386 | AFH57935 | 28962 | 59466 | 89970, 120474, 150978, 181482, 211986 | 1350 | AGZ60154 | 29926 | 60430 | 90934, 121438, 151942, 182446, 212950 |
| 387 | AFH57946 | 28963 | 59467 | 89971, 120475, 150979, 181483, 211987 | 1351 | AGZ60164 | 29927 | 60431 | 90935, 121439, 151943, 182447, 212951 |
| 388 | AFH57957 | 28964 | 59468 | 89972, 120476, 150980, 181484, 211988 | 1352 | AGZ60176 | 29928 | 60432 | 90936, 121440, 151944, 182448, 212952 |
| 389 | AFH57968 | 28965 | 59469 | 89973, 120477, 150981, 181485, 211989 | 1353 | AGZ60187 | 29929 | 60433 | 90937, 121441, 151945, 182449, 212953 |

FIG. 4 continued

| | | | | | | | | | |
|---|---|---|---|---|---|---|---|---|---|
| 390 | AFH57979 | 28966 | 59470 | 89974, 120478, 150982, 181486, 211990 | 1354 | AGZ60198 | 29930 | 60434 | 90938, 121442, 151946, 182450, 212954 |
| 391 | AFH58253 | 28967 | 59471 | 89975, 120479, 150983, 181487, 211991 | 1355 | AGZ60210 | 29931 | 60435 | 90939, 121443, 151947, 182451, 212955 |
| 392 | AFH58264 | 28968 | 59472 | 89976, 120480, 150984, 181488, 211992 | 1356 | AGZ60221 | 29932 | 60436 | 90940, 121444, 151948, 182452, 212956 |
| 393 | AFH58275 | 28969 | 59473 | 89977, 120481, 150985, 181489, 211993 | 1357 | AGZ60272 | 29933 | 60437 | 90941, 121445, 151949, 182453, 212957 |
| 394 | AFH58286 | 28970 | 59474 | 89978, 120482, 150986, 181490, 211994 | 1358 | AHL91182 | 29934 | 60438 | 90942, 121446, 151950, 182454, 212958 |
| 395 | AFH58297 | 28971 | 59475 | 89979, 120483, 150987, 181491, 211995 | 1359 | AHL91193 | 29935 | 60439 | 90943, 121447, 151951, 182455, 212959 |
| 396 | AFH58308 | 28972 | 59476 | 89980, 120484, 150988, 181492, 211996 | 1360 | AHL91204 | 29936 | 60440 | 90944, 121448, 151952, 182456, 212960 |
| 397 | AFH58319 | 28973 | 59477 | 89981, 120485, 150989, 181493, 211997 | 1361 | AHL91215 | 29937 | 60441 | 90945, 121449, 151953, 182457, 212961 |
| 398 | AFH58341 | 28974 | 59478 | 89982, 120486, 150990, 181494, 211998 | 1362 | AHL91226 | 29938 | 60442 | 90946, 121450, 151954, 182458, 212962 |
| 399 | AFH58363 | 28975 | 59479 | 89983, 120487, 150991, 181495, 211999 | 1363 | AHL91237 | 29939 | 60443 | 90947, 121451, 151955, 182459, 212963 |
| 400 | AFH58374 | 28976 | 59480 | 89984, 120488, 150992, 181496, 212000 | 1364 | AHL91248 | 29940 | 60444 | 90948, 121452, 151956, 182460, 212964 |
| 401 | AFH58385 | 28977 | 59481 | 89985, 120489, 150993, 181497, 212001 | 1365 | AHL91259 | 29941 | 60445 | 90949, 121453, 151957, 182461, 212965 |
| 402 | AFH58396 | 28978 | 59482 | 89986, 120490, 150994, 181498, 212002 | 1366 | AHL91270 | 29942 | 60446 | 90950, 121454, 151958, 182462, 212966 |
| 403 | AFH58407 | 28979 | 59483 | 89987, 120491, 150995, 181499, 212003 | 1367 | AHL91281 | 29943 | 60447 | 90951, 121455, 151959, 182463, 212967 |
| 404 | AFH58418 | 28980 | 59484 | 89988, 120492, 150996, 181500, 212004 | 1368 | AHL91303 | 29944 | 60448 | 90952, 121456, 151960, 182464, 212968 |
| 405 | AFH58429 | 28981 | 59485 | 89989, 120493, 150997, 181501, 212005 | 1369 | AHL91314 | 29945 | 60449 | 90953, 121457, 151961, 182465, 212969 |
| 406 | AFH58440 | 28982 | 59486 | 89990, 120494, 150998, 181502, 212006 | 1370 | AHL91325 | 29946 | 60450 | 90954, 121458, 151962, 182466, 212970 |
| 407 | AFH58462 | 28983 | 59487 | 89991, 120495, 150999, 181503, 212007 | 1371 | AHL91347 | 29947 | 60451 | 90955, 121459, 151963, 182467, 212971 |

FIG. 4 continued

| | | | | | | | | | |
|---|---|---|---|---|---|---|---|---|---|
| 408 | AFH58473 | 28984 | 59488 | 89992, 120496, 151000, 181504, 212008 | 1372 | AHL91358 | 29948 | 60452 | 90956, 121460, 151964, 182468, 212972 |
| 409 | AFH58484 | 28985 | 59489 | 89993, 120497, 151001, 181505, 212009 | 1373 | AHL91369 | 29949 | 60453 | 90957, 121461, 151965, 182469, 212973 |
| 410 | AFH58495 | 28986 | 59490 | 89994, 120498, 151002, 181506, 212010 | 1374 | AHL91380 | 29950 | 60454 | 90958, 121462, 151966, 182470, 212974 |
| 411 | AFH58506 | 28987 | 59491 | 89995, 120499, 151003, 181507, 212011 | 1375 | AHL91391 | 29951 | 60455 | 90959, 121463, 151967, 182471, 212975 |
| 412 | AFH58517 | 28988 | 59492 | 89996, 120500, 151004, 181508, 212012 | 1376 | AHL91413 | 29952 | 60456 | 90960, 121464, 151968, 182472, 212976 |
| 413 | AFH58528 | 28989 | 59493 | 89997, 120501, 151005, 181509, 212013 | 1377 | AHL91446 | 29953 | 60457 | 90961, 121465, 151969, 182473, 212977 |
| 414 | AFH58539 | 28990 | 59494 | 89998, 120502, 151006, 181510, 212014 | 1378 | AHL91457 | 29954 | 60458 | 90962, 121466, 151970, 182474, 212978 |
| 415 | AFH58550 | 28991 | 59495 | 89999, 120503, 151007, 181511, 212015 | 1379 | AHL91468 | 29955 | 60459 | 90963, 121467, 151971, 182475, 212979 |
| 416 | AFH58561 | 28992 | 59496 | 90000, 120504, 151008, 181512, 212016 | 1380 | AHL91479 | 29956 | 60460 | 90964, 121468, 151972, 182476, 212980 |
| 417 | AFJ69969 | 28993 | 59497 | 90001, 120505, 151009, 181513, 212017 | 1381 | AHL91501 | 29957 | 60461 | 90965, 121469, 151973, 182477, 212981 |
| 418 | AFJ69971 | 28994 | 59498 | 90002, 120506, 151010, 181514, 212018 | 1382 | AHL91512 | 29958 | 60462 | 90966, 121470, 151974, 182478, 212982 |
| 419 | AFJ69973 | 28995 | 59499 | 90003, 120507, 151011, 181515, 212019 | 1383 | AHL91523 | 29959 | 60463 | 90967, 121471, 151975, 182479, 212983 |
| 420 | AFJ69975 | 28996 | 59500 | 90004, 120508, 151012, 181516, 212020 | 1384 | AHL91534 | 29960 | 60464 | 90968, 121472, 151976, 182480, 212984 |
| 421 | AFJ69979 | 28997 | 59501 | 90005, 120509, 151013, 181517, 212021 | 1385 | AHL91545 | 29961 | 60465 | 90969, 121473, 151977, 182481, 212985 |
| 422 | AFJ69981 | 28998 | 59502 | 90006, 120510, 151014, 181518, 212022 | 1386 | AHL91556 | 29962 | 60466 | 90970, 121474, 151978, 182482, 212986 |
| 423 | AFJ69983 | 28999 | 59503 | 90007, 120511, 151015, 181519, 212023 | 1387 | AHL91578 | 29963 | 60467 | 90971, 121475, 151979, 182483, 212987 |
| 424 | AFJ69987 | 29000 | 59504 | 90008, 120512, 151016, 181520, 212024 | 1388 | AHL91589 | 29964 | 60468 | 90972, 121476, 151980, 182484, 212988 |
| 425 | AFJ76228 | 29001 | 59505 | 90009, 120513, 151017, 181521, 212025 | 1389 | AHL91600 | 29965 | 60469 | 90973, 121477, 151981, 182485, 212989 |

FIG. 4 continued

| | | | | | | | | | |
|---|---|---|---|---|---|---|---|---|---|
| 426 | AFJ76261 | 29002 | 59506 | 90010, 120514, 151018, 181522, 212026 | 1390 | AHL91611 | 29966 | 60470 | 90974, 121478, 151982, 182486, 212990 |
| 427 | AFJ76283 | 29003 | 59507 | 90011, 120515, 151019, 181523, 212027 | 1391 | AHL91622 | 29967 | 60471 | 90975, 121479, 151983, 182487, 212991 |
| 428 | AFJ76305 | 29004 | 59508 | 90012, 120516, 151020, 181524, 212028 | 1392 | AHL91633 | 29968 | 60472 | 90976, 121480, 151984, 182488, 212992 |
| 429 | AFJ76316 | 29005 | 59509 | 90013, 120517, 151021, 181525, 212029 | 1393 | AHL91644 | 29969 | 60473 | 90977, 121481, 151985, 182489, 212993 |
| 430 | AFJ76338 | 29006 | 59510 | 90014, 120518, 151022, 181526, 212030 | 1394 | AHL91655 | 29970 | 60474 | 90978, 121482, 151986, 182490, 212994 |
| 431 | AFJ77331 | 29007 | 59511 | 90015, 120519, 151023, 181527, 212031 | 1395 | AHL91666 | 29971 | 60475 | 90979, 121483, 151987, 182491, 212995 |
| 432 | AFJ77351 | 29008 | 59512 | 90016, 120520, 151024, 181528, 212032 | 1396 | AHL91677 | 29972 | 60476 | 90980, 121484, 151988, 182492, 212996 |
| 433 | AFJ77362 | 29009 | 59513 | 90017, 120521, 151025, 181529, 212033 | 1397 | AHL91688 | 29973 | 60477 | 90981, 121485, 151989, 182493, 212997 |
| 434 | AFJ77384 | 29010 | 59514 | 90018, 120522, 151026, 181530, 212034 | 1398 | AHL91699 | 29974 | 60478 | 90982, 121486, 151990, 182494, 212998 |
| 435 | AFJ80132 | 29011 | 59515 | 90019, 120523, 151027, 181531, 212035 | 1399 | AHL91710 | 29975 | 60479 | 90983, 121487, 151991, 182495, 212999 |
| 436 | AFJ80143 | 29012 | 59516 | 90020, 120524, 151028, 181532, 212036 | 1400 | AHL91721 | 29976 | 60480 | 90984, 121488, 151992, 182496, 213000 |
| 437 | AFJ80154 | 29013 | 59517 | 90021, 120525, 151029, 181533, 212037 | 1401 | AHL91732 | 29977 | 60481 | 90985, 121489, 151993, 182497, 213001 |
| 438 | AFJ80165 | 29014 | 59518 | 90022, 120526, 151030, 181534, 212038 | 1402 | AHL91743 | 29978 | 60482 | 90986, 121490, 151994, 182498, 213002 |
| 439 | AFJ80176 | 29015 | 59519 | 90023, 120527, 151031, 181535, 212039 | 1403 | AHL91754 | 29979 | 60483 | 90987, 121491, 151995, 182499, 213003 |
| 440 | AFJ80187 | 29016 | 59520 | 90024, 120528, 151032, 181536, 212040 | 1404 | AHL91765 | 29980 | 60484 | 90988, 121492, 151996, 182500, 213004 |
| 441 | AFJ80198 | 29017 | 59521 | 90025, 120529, 151033, 181537, 212041 | 1405 | AHL91776 | 29981 | 60485 | 90989, 121493, 151997, 182501, 213005 |
| 442 | AFJ80220 | 29018 | 59522 | 90026, 120530, 151034, 181538, 212042 | 1406 | AHL91787 | 29982 | 60486 | 90990, 121494, 151998, 182502, 213006 |
| 443 | AFJ80231 | 29019 | 59523 | 90027, 120531, 151035, 181539, 212043 | 1407 | AHL91798 | 29983 | 60487 | 90991, 121495, 151999, 182503, 213007 |

FIG. 4 continued

| | | | | | | | | | |
|---|---|---|---|---|---|---|---|---|---|
| 444 | AFJ80242 | 29020 | 59524 | 90028, 120532, 151036, 181540, 212044 | 1408 | AHL91809 | 29984 | 60488 | 90992, 121496, 152000, 182504, 213008 |
| 445 | AFJ80660 | 29021 | 59525 | 90029, 120533, 151037, 181541, 212045 | 1409 | AHL91820 | 29985 | 60489 | 90993, 121497, 152001, 182505, 213009 |
| 446 | AFJ80671 | 29022 | 59526 | 90030, 120534, 151038, 181542, 212046 | 1410 | AHL91831 | 29986 | 60490 | 90994, 121498, 152002, 182506, 213010 |
| 447 | AFJ80682 | 29023 | 59527 | 90031, 120535, 151039, 181543, 212047 | 1411 | AHL91842 | 29987 | 60491 | 90995, 121499, 152003, 182507, 213011 |
| 448 | AFJ80693 | 29024 | 59528 | 90032, 120536, 151040, 181544, 212048 | 1412 | AHL91853 | 29988 | 60492 | 90996, 121500, 152004, 182508, 213012 |
| 449 | AFJ80726 | 29025 | 59529 | 90033, 120537, 151041, 181545, 212049 | 1413 | AHL91864 | 29989 | 60493 | 90997, 121501, 152005, 182509, 213013 |
| 450 | AFJ80737 | 29026 | 59530 | 90034, 120538, 151042, 181546, 212050 | 1414 | AHL91875 | 29990 | 60494 | 90998, 121502, 152006, 182510, 213014 |
| 451 | AFJ80759 | 29027 | 59531 | 90035, 120539, 151043, 181547, 212051 | 1415 | AHL91886 | 29991 | 60495 | 90999, 121503, 152007, 182511, 213015 |
| 452 | AFJ80770 | 29028 | 59532 | 90036, 120540, 151044, 181548, 212052 | 1416 | AHL91897 | 29992 | 60496 | 91000, 121504, 152008, 182512, 213016 |
| 453 | AFJ80785 | 29029 | 59533 | 90037, 120541, 151045, 181549, 212053 | 1417 | AHL91908 | 29993 | 60497 | 91001, 121505, 152009, 182513, 213017 |
| 454 | AFJ80796 | 29030 | 59534 | 90038, 120542, 151046, 181550, 212054 | 1418 | AHL91919 | 29994 | 60498 | 91002, 121506, 152010, 182514, 213018 |
| 455 | AFJ80807 | 29031 | 59535 | 90039, 120543, 151047, 181551, 212055 | 1419 | AHL91930 | 29995 | 60499 | 91003, 121507, 152011, 182515, 213019 |
| 456 | AFJ80818 | 29032 | 59536 | 90040, 120544, 151048, 181552, 212056 | 1420 | AHL91941 | 29996 | 60500 | 91004, 121508, 152012, 182516, 213020 |
| 457 | AFJ80829 | 29033 | 59537 | 90041, 120545, 151049, 181553, 212057 | 1421 | AHL91952 | 29997 | 60501 | 91005, 121509, 152013, 182517, 213021 |
| 458 | AFJ80840 | 29034 | 59538 | 90042, 120546, 151050, 181554, 212058 | 1422 | AHL91963 | 29998 | 60502 | 91006, 121510, 152014, 182518, 213022 |
| 459 | AFJ80851 | 29035 | 59539 | 90043, 120547, 151051, 181555, 212059 | 1423 | AHL91974 | 29999 | 60503 | 91007, 121511, 152015, 182519, 213023 |
| 460 | AFJ80862 | 29036 | 59540 | 90044, 120548, 151052, 181556, 212060 | 1424 | AHL91985 | 30000 | 60504 | 91008, 121512, 152016, 182520, 213024 |
| 461 | AFJ80873 | 29037 | 59541 | 90045, 120549, 151053, 181557, 212061 | 1425 | AHL91995 | 30001 | 60505 | 91009, 121513, 152017, 182521, 213025 |

FIG. 4 continued

| | | | | | | | | | |
|---|---|---|---|---|---|---|---|---|---|
| 462 | AFJ80884 | 29038 | 59542 | 90046, 120550, 151054, 181558, 212062 | 1426 | AHL92006 | 30002 | 60506 | 91010, 121514, 152018, 182522, 213026 |
| 463 | AFJ80895 | 29039 | 59543 | 90047, 120551, 151055, 181559, 212063 | 1427 | AHL92017 | 30003 | 60507 | 91011, 121515, 152019, 182523, 213027 |
| 464 | AFJ80917 | 29040 | 59544 | 90048, 120552, 151056, 181560, 212064 | 1428 | AHL92028 | 30004 | 60508 | 91012, 121516, 152020, 182524, 213028 |
| 465 | AFJ80928 | 29041 | 59545 | 90049, 120553, 151057, 181561, 212065 | 1429 | AHL92039 | 30005 | 60509 | 91013, 121517, 152021, 182525, 213029 |
| 466 | AFJ80939 | 29042 | 59546 | 90050, 120554, 151058, 181562, 212066 | 1430 | AHL92050 | 30006 | 60510 | 91014, 121518, 152022, 182526, 213030 |
| 467 | AFJ80950 | 29043 | 59547 | 90051, 120555, 151059, 181563, 212067 | 1431 | AHL92061 | 30007 | 60511 | 91015, 121519, 152023, 182527, 213031 |
| 468 | AFJ80961 | 29044 | 59548 | 90052, 120556, 151060, 181564, 212068 | 1432 | AHL92072 | 30008 | 60512 | 91016, 121520, 152024, 182528, 213032 |
| 469 | AFJ80972 | 29045 | 59549 | 90053, 120557, 151061, 181565, 212069 | 1433 | AHL92083 | 30009 | 60513 | 91017, 121521, 152025, 182529, 213033 |
| 470 | AFJ80983 | 29046 | 59550 | 90054, 120558, 151062, 181566, 212070 | 1434 | AHL92094 | 30010 | 60514 | 91018, 121522, 152026, 182530, 213034 |
| 471 | AFJ80994 | 29047 | 59551 | 90055, 120559, 151063, 181567, 212071 | 1435 | AHL92105 | 30011 | 60515 | 91019, 121523, 152027, 182531, 213035 |
| 472 | AFJ81005 | 29048 | 59552 | 90056, 120560, 151064, 181568, 212072 | 1436 | AHL92116 | 30012 | 60516 | 91020, 121524, 152028, 182532, 213036 |
| 473 | AFJ84364 | 29049 | 59553 | 90057, 120561, 151065, 181569, 212073 | 1437 | AHL92127 | 30013 | 60517 | 91021, 121525, 152029, 182533, 213037 |
| 474 | AFJ90399 | 29050 | 59554 | 90058, 120562, 151066, 181570, 212074 | 1438 | AHL92138 | 30014 | 60518 | 91022, 121526, 152030, 182534, 213038 |
| 475 | AFJ90410 | 29051 | 59555 | 90059, 120563, 151067, 181571, 212075 | 1439 | AHL92149 | 30015 | 60519 | 91023, 121527, 152031, 182535, 213039 |
| 476 | AFJ90432 | 29052 | 59556 | 90060, 120564, 151068, 181572, 212076 | 1440 | AHL92171 | 30016 | 60520 | 91024, 121528, 152032, 182536, 213040 |
| 477 | AFJ90443 | 29053 | 59557 | 90061, 120565, 151069, 181573, 212077 | 1441 | AHL92182 | 30017 | 60521 | 91025, 121529, 152033, 182537, 213041 |
| 478 | AFJ90454 | 29054 | 59558 | 90062, 120566, 151070, 181574, 212078 | 1442 | AHL92193 | 30018 | 60522 | 91026, 121530, 152034, 182538, 213042 |
| 479 | AFJ91042 | 29055 | 59559 | 90063, 120567, 151071, 181575, 212079 | 1443 | AHL92204 | 30019 | 60523 | 91027, 121531, 152035, 182539, 213043 |

FIG. 4 continued

| | | | | | | | | | |
|---|---|---|---|---|---|---|---|---|---|
| 480 | AFJ91053 | 29056 | 59560 | 90064, 120568, 151072, 181576, 212080 | 1444 | AHL92215 | 30020 | 60524 | 91028, 121532, 152036, 182540, 213044 |
| 481 | AFJ91075 | 29057 | 59561 | 90065, 120569, 151073, 181577, 212081 | 1445 | AHL92226 | 30021 | 60525 | 91029, 121533, 152037, 182541, 213045 |
| 482 | AFJ91086 | 29058 | 59562 | 90066, 120570, 151074, 181578, 212082 | 1446 | AHL92237 | 30022 | 60526 | 91030, 121534, 152038, 182542, 213046 |
| 483 | AFJ91097 | 29059 | 59563 | 90067, 120571, 151075, 181579, 212083 | 1447 | AHL92248 | 30023 | 60527 | 91031, 121535, 152039, 182543, 213047 |
| 484 | AFJ91108 | 29060 | 59564 | 90068, 120572, 151076, 181580, 212084 | 1448 | AHL92259 | 30024 | 60528 | 91032, 121536, 152040, 182544, 213048 |
| 485 | AFJ91119 | 29061 | 59565 | 90069, 120573, 151077, 181581, 212085 | 1449 | AHL92270 | 30025 | 60529 | 91033, 121537, 152041, 182545, 213049 |
| 486 | AFJ91707 | 29062 | 59566 | 90070, 120574, 151078, 181582, 212086 | 1450 | AHL92281 | 30026 | 60530 | 91034, 121538, 152042, 182546, 213050 |
| 487 | AFK09801 | 29063 | 59567 | 90071, 120575, 151079, 181583, 212087 | 1451 | AHL92303 | 30027 | 60531 | 91035, 121539, 152043, 182547, 213051 |
| 488 | AFN54669 | 29064 | 59568 | 90072, 120576, 151080, 181584, 212088 | 1452 | AHL92314 | 30028 | 60532 | 91036, 121540, 152044, 182548, 213052 |
| 489 | AFN54680 | 29065 | 59569 | 90073, 120577, 151081, 181585, 212089 | 1453 | AHL92325 | 30029 | 60533 | 91037, 121541, 152045, 182549, 213053 |
| 490 | AFN54691 | 29066 | 59570 | 90074, 120578, 151082, 181586, 212090 | 1454 | AHL92336 | 30030 | 60534 | 91038, 121542, 152046, 182550, 213054 |
| 491 | AFN54702 | 29067 | 59571 | 90075, 120579, 151083, 181587, 212091 | 1455 | AHL92358 | 30031 | 60535 | 91039, 121543, 152047, 182551, 213055 |
| 492 | AFN54713 | 29068 | 59572 | 90076, 120580, 151084, 181588, 212092 | 1456 | AHL92369 | 30032 | 60536 | 91040, 121544, 152048, 182552, 213056 |
| 493 | AFN54724 | 29069 | 59573 | 90077, 120581, 151085, 181589, 212093 | 1457 | AHL92380 | 30033 | 60537 | 91041, 121545, 152049, 182553, 213057 |
| 494 | AFN54735 | 29070 | 59574 | 90078, 120582, 151086, 181590, 212094 | 1458 | AHL92391 | 30034 | 60538 | 91042, 121546, 152050, 182554, 213058 |
| 495 | AFN54746 | 29071 | 59575 | 90079, 120583, 151087, 181591, 212095 | 1459 | AHL92402 | 30035 | 60539 | 91043, 121547, 152051, 182555, 213059 |
| 496 | AFN54757 | 29072 | 59576 | 90080, 120584, 151088, 181592, 212096 | 1460 | AHL92413 | 30036 | 60540 | 91044, 121548, 152052, 182556, 213060 |
| 497 | AFN54768 | 29073 | 59577 | 90081, 120585, 151089, 181593, 212097 | 1461 | AHL92424 | 30037 | 60541 | 91045, 121549, 152053, 182557, 213061 |

FIG. 4 continued

| | | | | | | | | | |
|---|---|---|---|---|---|---|---|---|---|
| 498 | AFN54779 | 29074 | 59578 | 90082, 120586, 151090, 181594, 212098 | 1462 | AHL92435 | 30038 | 60542 | 91046, 121550, 152054, 182558, 213062 |
| 499 | AFN54790 | 29075 | 59579 | 90083, 120587, 151091, 181595, 212099 | 1463 | AHL92446 | 30039 | 60543 | 91047, 121551, 152055, 182559, 213063 |
| 500 | AFN54801 | 29076 | 59580 | 90084, 120588, 151092, 181596, 212100 | 1464 | AHL92457 | 30040 | 60544 | 91048, 121552, 152056, 182560, 213064 |
| 501 | AFN54812 | 29077 | 59581 | 90085, 120589, 151093, 181597, 212101 | 1465 | AHL92468 | 30041 | 60545 | 91049, 121553, 152057, 182561, 213065 |
| 502 | AFN54834 | 29078 | 59582 | 90086, 120590, 151094, 181598, 212102 | 1466 | AHL92479 | 30042 | 60546 | 91050, 121554, 152058, 182562, 213066 |
| 503 | AFN54845 | 29079 | 59583 | 90087, 120591, 151095, 181599, 212103 | 1467 | AHL92490 | 30043 | 60547 | 91051, 121555, 152059, 182563, 213067 |
| 504 | AFN54856 | 29080 | 59584 | 90088, 120592, 151096, 181600, 212104 | 1468 | AHL92501 | 30044 | 60548 | 91052, 121556, 152060, 182564, 213068 |
| 505 | AFN54867 | 29081 | 59585 | 90089, 120593, 151097, 181601, 212105 | 1469 | AHL92512 | 30045 | 60549 | 91053, 121557, 152061, 182565, 213069 |
| 506 | AFU34598 | 29082 | 59586 | 90090, 120594, 151098, 181602, 212106 | 1470 | AHL92523 | 30046 | 60550 | 91054, 121558, 152062, 182566, 213070 |
| 507 | AFU34609 | 29083 | 59587 | 90091, 120595, 151099, 181603, 212107 | 1471 | AHL92534 | 30047 | 60551 | 91055, 121559, 152063, 182567, 213071 |
| 508 | AFU34620 | 29084 | 59588 | 90092, 120596, 151100, 181604, 212108 | 1472 | AHL92545 | 30048 | 60552 | 91056, 121560, 152064, 182568, 213072 |
| 509 | AFU34631 | 29085 | 59589 | 90093, 120597, 151101, 181605, 212109 | 1473 | AHL92556 | 30049 | 60553 | 91057, 121561, 152065, 182569, 213073 |
| 510 | AFU34642 | 29086 | 59590 | 90094, 120598, 151102, 181606, 212110 | 1474 | AHL92567 | 30050 | 60554 | 91058, 121562, 152066, 182570, 213074 |
| 511 | AGB97261 | 29087 | 59591 | 90095, 120599, 151103, 181607, 212111 | 1475 | AHL92578 | 30051 | 60555 | 91059, 121563, 152067, 182571, 213075 |
| 512 | AGB97267 | 29088 | 59592 | 90096, 120600, 151104, 181608, 212112 | 1476 | AHL92589 | 30052 | 60556 | 91060, 121564, 152068, 182572, 213076 |
| 513 | AGR54784 | 29089 | 59593 | 90097, 120601, 151105, 181609, 212113 | 1477 | AHL92600 | 30053 | 60557 | 91061, 121565, 152069, 182573, 213077 |
| 514 | AGX15491 | 29090 | 59594 | 90098, 120602, 151106, 181610, 212114 | 1478 | AHL92611 | 30054 | 60558 | 91062, 121566, 152070, 182574, 213078 |
| 515 | AGX15533 | 29091 | 59595 | 90099, 120603, 151107, 181611, 212115 | 1479 | AHL92622 | 30055 | 60559 | 91063, 121567, 152071, 182575, 213079 |

FIG. 4 continued

| | | | | | | | | | |
|---|---|---|---|---|---|---|---|---|---|
| 516 | AGX15545 | 29092 | 59596 | 90100, 120604, 151108, 181612, 212116 | 1480 | AHL92633 | 30056 | 60560 | 91064, 121568, 152072, 182576, 213080 |
| 517 | AGX15556 | 29093 | 59597 | 90101, 120605, 151109, 181613, 212117 | 1481 | AHL92644 | 30057 | 60561 | 91065, 121569, 152073, 182577, 213081 |
| 518 | AGX15567 | 29094 | 59598 | 90102, 120606, 151110, 181614, 212118 | 1482 | AHL92655 | 30058 | 60562 | 91066, 121570, 152074, 182578, 213082 |
| 519 | AGX15578 | 29095 | 59599 | 90103, 120607, 151111, 181615, 212119 | 1483 | AHL92666 | 30059 | 60563 | 91067, 121571, 152075, 182579, 213083 |
| 520 | AGX15589 | 29096 | 59600 | 90104, 120608, 151112, 181616, 212120 | 1484 | AHL92677 | 30060 | 60564 | 91068, 121572, 152076, 182580, 213084 |
| 521 | AGX15600 | 29097 | 59601 | 90105, 120609, 151113, 181617, 212121 | 1485 | AHL92688 | 30061 | 60565 | 91069, 121573, 152077, 182581, 213085 |
| 522 | AGX15611 | 29098 | 59602 | 90106, 120610, 151114, 181618, 212122 | 1486 | AHL92699 | 30062 | 60566 | 91070, 121574, 152078, 182582, 213086 |
| 523 | AGX15644 | 29099 | 59603 | 90107, 120611, 151115, 181619, 212123 | 1487 | AHL92710 | 30063 | 60567 | 91071, 121575, 152079, 182583, 213087 |
| 524 | AGX15655 | 29100 | 59604 | 90108, 120612, 151116, 181620, 212124 | 1488 | AHL92721 | 30064 | 60568 | 91072, 121576, 152080, 182584, 213088 |
| 525 | AGX15666 | 29101 | 59605 | 90109, 120613, 151117, 181621, 212125 | 1489 | AHL92732 | 30065 | 60569 | 91073, 121577, 152081, 182585, 213089 |
| 526 | AGX15679 | 29102 | 59606 | 90110, 120614, 151118, 181622, 212126 | 1490 | AHL92743 | 30066 | 60570 | 91074, 121578, 152082, 182586, 213090 |
| 527 | AGX15690 | 29103 | 59607 | 90111, 120615, 151119, 181623, 212127 | 1491 | AHL92754 | 30067 | 60571 | 91075, 121579, 152083, 182587, 213091 |
| 528 | AGX15701 | 29104 | 59608 | 90112, 120616, 151120, 181624, 212128 | 1492 | AHL92765 | 30068 | 60572 | 91076, 121580, 152084, 182588, 213092 |
| 529 | AGX15712 | 29105 | 59609 | 90113, 120617, 151121, 181625, 212129 | 1493 | AHL92776 | 30069 | 60573 | 91077, 121581, 152085, 182589, 213093 |
| 530 | AGX15723 | 29106 | 59610 | 90114, 120618, 151122, 181626, 212130 | 1494 | AHL92787 | 30070 | 60574 | 91078, 121582, 152086, 182590, 213094 |
| 531 | AGX15745 | 29107 | 59611 | 90115, 120619, 151123, 181627, 212131 | 1495 | AHL92798 | 30071 | 60575 | 91079, 121583, 152087, 182591, 213095 |
| 532 | AGX15757 | 29108 | 59612 | 90116, 120620, 151124, 181628, 212132 | 1496 | AHL92809 | 30072 | 60576 | 91080, 121584, 152088, 182592, 213096 |
| 533 | AGX15768 | 29109 | 59613 | 90117, 120621, 151125, 181629, 212133 | 1497 | AHL92820 | 30073 | 60577 | 91081, 121585, 152089, 182593, 213097 |

FIG. 4 continued

| | | | | | | | | | |
|---|---|---|---|---|---|---|---|---|---|
| 534 | AGX15801 | 29110 | 59614 | 90118, 120622, 151126, 181630, 212134 | 1498 | AHL92842 | 30074 | 60578 | 91082, 121586, 152090, 182594, 213098 |
| 535 | AGX15812 | 29111 | 59615 | 90119, 120623, 151127, 181631, 212135 | 1499 | AHL92853 | 30075 | 60579 | 91083, 121587, 152091, 182595, 213099 |
| 536 | AGX15823 | 29112 | 59616 | 90120, 120624, 151128, 181632, 212136 | 1500 | AHL92864 | 30076 | 60580 | 91084, 121588, 152092, 182596, 213100 |
| 537 | AGX15845 | 29113 | 59617 | 90121, 120625, 151129, 181633, 212137 | 1501 | AHL92875 | 30077 | 60581 | 91085, 121589, 152093, 182597, 213101 |
| 538 | AGX15856 | 29114 | 59618 | 90122, 120626, 151130, 181634, 212138 | 1502 | AHL92886 | 30078 | 60582 | 91086, 121590, 152094, 182598, 213102 |
| 539 | AGX15867 | 29115 | 59619 | 90123, 120627, 151131, 181635, 212139 | 1503 | AHL92897 | 30079 | 60583 | 91087, 121591, 152095, 182599, 213103 |
| 540 | AGX15889 | 29116 | 59620 | 90124, 120628, 151132, 181636, 212140 | 1504 | AHL92908 | 30080 | 60584 | 91088, 121592, 152096, 182600, 213104 |
| 541 | AGX15900 | 29117 | 59621 | 90125, 120629, 151133, 181637, 212141 | 1505 | AHL92919 | 30081 | 60585 | 91089, 121593, 152097, 182601, 213105 |
| 542 | AGX15911 | 29118 | 59622 | 90126, 120630, 151134, 181638, 212142 | 1506 | AHL92930 | 30082 | 60586 | 91090, 121594, 152098, 182602, 213106 |
| 543 | AGX15933 | 29119 | 59623 | 90127, 120631, 151135, 181639, 212143 | 1507 | AHL92941 | 30083 | 60587 | 91091, 121595, 152099, 182603, 213107 |
| 544 | AGX15944 | 29120 | 59624 | 90128, 120632, 151136, 181640, 212144 | 1508 | AHL92952 | 30084 | 60588 | 91092, 121596, 152100, 182604, 213108 |
| 545 | AGX15966 | 29121 | 59625 | 90129, 120633, 151137, 181641, 212145 | 1509 | AHL92963 | 30085 | 60589 | 91093, 121597, 152101, 182605, 213109 |
| 546 | AGX15988 | 29122 | 59626 | 90130, 120634, 151138, 181642, 212146 | 1510 | AHL92974 | 30086 | 60590 | 91094, 121598, 152102, 182606, 213110 |
| 547 | AGX15999 | 29123 | 59627 | 90131, 120635, 151139, 181643, 212147 | 1511 | AHL92985 | 30087 | 60591 | 91095, 121599, 152103, 182607, 213111 |
| 548 | AGX16010 | 29124 | 59628 | 90132, 120636, 151140, 181644, 212148 | 1512 | AHL92996 | 30088 | 60592 | 91096, 121600, 152104, 182608, 213112 |
| 549 | AGX16021 | 29125 | 59629 | 90133, 120637, 151141, 181645, 212149 | 1513 | AHL93008 | 30089 | 60593 | 91097, 121601, 152105, 182609, 213113 |
| 550 | AGX16032 | 29126 | 59630 | 90134, 120638, 151142, 181646, 212150 | 1514 | AHL93019 | 30090 | 60594 | 91098, 121602, 152106, 182610, 213114 |
| 551 | AGX16043 | 29127 | 59631 | 90135, 120639, 151143, 181647, 212151 | 1515 | AHL93030 | 30091 | 60595 | 91099, 121603, 152107, 182611, 213115 |

FIG. 4 continued

| | | | | | | | | | |
|---|---|---|---|---|---|---|---|---|---|
| 552 | AGX16054 | 29128 | 59632 | 90136, 120640, 151144, 181648, 212152 | 1516 | AHL93041 | 30092 | 60596 | 91100, 121604, 152108, 182612, 213116 |
| 553 | AGX16087 | 29129 | 59633 | 90137, 120641, 151145, 181649, 212153 | 1517 | AHL93052 | 30093 | 60597 | 91101, 121605, 152109, 182613, 213117 |
| 554 | AGX16109 | 29130 | 59634 | 90138, 120642, 151146, 181650, 212154 | 1518 | AHL93063 | 30094 | 60598 | 91102, 121606, 152110, 182614, 213118 |
| 555 | AGX16120 | 29131 | 59635 | 90139, 120643, 151147, 181651, 212155 | 1519 | AHL93074 | 30095 | 60599 | 91103, 121607, 152111, 182615, 213119 |
| 556 | AGX16131 | 29132 | 59636 | 90140, 120644, 151148, 181652, 212156 | 1520 | AHL93085 | 30096 | 60600 | 91104, 121608, 152112, 182616, 213120 |
| 557 | AGX16142 | 29133 | 59637 | 90141, 120645, 151149, 181653, 212157 | 1521 | AHL93096 | 30097 | 60601 | 91105, 121609, 152113, 182617, 213121 |
| 558 | AGX16153 | 29134 | 59638 | 90142, 120646, 151150, 181654, 212158 | 1522 | AHL93107 | 30098 | 60602 | 91106, 121610, 152114, 182618, 213122 |
| 559 | AGX16164 | 29135 | 59639 | 90143, 120647, 151151, 181655, 212159 | 1523 | AHL93118 | 30099 | 60603 | 91107, 121611, 152115, 182619, 213123 |
| 560 | AGX16197 | 29136 | 59640 | 90144, 120648, 151152, 181656, 212160 | 1524 | AHL93129 | 30100 | 60604 | 91108, 121612, 152116, 182620, 213124 |
| 561 | AGX16208 | 29137 | 59641 | 90145, 120649, 151153, 181657, 212161 | 1525 | AHL93140 | 30101 | 60605 | 91109, 121613, 152117, 182621, 213125 |
| 562 | AGX16219 | 29138 | 59642 | 90146, 120650, 151154, 181658, 212162 | 1526 | AHL93151 | 30102 | 60606 | 91110, 121614, 152118, 182622, 213126 |
| 563 | AGX16230 | 29139 | 59643 | 90147, 120651, 151155, 181659, 212163 | 1527 | AHL93162 | 30103 | 60607 | 91111, 121615, 152119, 182623, 213127 |
| 564 | AGX16241 | 29140 | 59644 | 90148, 120652, 151156, 181660, 212164 | 1528 | AHL93173 | 30104 | 60608 | 91112, 121616, 152120, 182624, 213128 |
| 565 | AGX16252 | 29141 | 59645 | 90149, 120653, 151157, 181661, 212165 | 1529 | AHL93184 | 30105 | 60609 | 91113, 121617, 152121, 182625, 213129 |
| 566 | AGX16274 | 29142 | 59646 | 90150, 120654, 151158, 181662, 212166 | 1530 | AHL93195 | 30106 | 60610 | 91114, 121618, 152122, 182626, 213130 |
| 567 | AGX16285 | 29143 | 59647 | 90151, 120655, 151159, 181663, 212167 | 1531 | AHL93206 | 30107 | 60611 | 91115, 121619, 152123, 182627, 213131 |
| 568 | AGX16296 | 29144 | 59648 | 90152, 120656, 151160, 181664, 212168 | 1532 | AHL93217 | 30108 | 60612 | 91116, 121620, 152124, 182628, 213132 |
| 569 | AGX16307 | 29145 | 59649 | 90153, 120657, 151161, 181665, 212169 | 1533 | AHL93228 | 30109 | 60613 | 91117, 121621, 152125, 182629, 213133 |

FIG. 4 continued

| | | | | | | | | | |
|---|---|---|---|---|---|---|---|---|---|
| 570 | AGX16329 | 29146 | 59650 | 90154, 120658, 151162, 181666, 212170 | 1534 | AHL93239 | 30110 | 60614 | 91118, 121622, 152126, 182630, 213134 |
| 571 | AGX16362 | 29147 | 59651 | 90155, 120659, 151163, 181667, 212171 | 1535 | AHL93250 | 30111 | 60615 | 91119, 121623, 152127, 182631, 213135 |
| 572 | AGX16373 | 29148 | 59652 | 90156, 120660, 151164, 181668, 212172 | 1536 | AHL93261 | 30112 | 60616 | 91120, 121624, 152128, 182632, 213136 |
| 573 | AGX16384 | 29149 | 59653 | 90157, 120661, 151165, 181669, 212173 | 1537 | AHL93272 | 30113 | 60617 | 91121, 121625, 152129, 182633, 213137 |
| 574 | AGX16406 | 29150 | 59654 | 90158, 120662, 151166, 181670, 212174 | 1538 | AHL93283 | 30114 | 60618 | 91122, 121626, 152130, 182634, 213138 |
| 575 | AGX16427 | 29151 | 59655 | 90159, 120663, 151167, 181671, 212175 | 1539 | AHL93294 | 30115 | 60619 | 91123, 121627, 152131, 182635, 213139 |
| 576 | AGX16438 | 29152 | 59656 | 90160, 120664, 151168, 181672, 212176 | 1540 | AHL93305 | 30116 | 60620 | 91124, 121628, 152132, 182636, 213140 |
| 577 | AGX16449 | 29153 | 59657 | 90161, 120665, 151169, 181673, 212177 | 1541 | AHL93316 | 30117 | 60621 | 91125, 121629, 152133, 182637, 213141 |
| 578 | AGX16460 | 29154 | 59658 | 90162, 120666, 151170, 181674, 212178 | 1542 | AHL93338 | 30118 | 60622 | 91126, 121630, 152134, 182638, 213142 |
| 579 | AGX16471 | 29155 | 59659 | 90163, 120667, 151171, 181675, 212179 | 1543 | AHL93349 | 30119 | 60623 | 91127, 121631, 152135, 182639, 213143 |
| 580 | AGX16482 | 29156 | 59660 | 90164, 120668, 151172, 181676, 212180 | 1544 | AHL93371 | 30120 | 60624 | 91128, 121632, 152136, 182640, 213144 |
| 581 | AGX16493 | 29157 | 59661 | 90165, 120669, 151173, 181677, 212181 | 1545 | AHL93382 | 30121 | 60625 | 91129, 121633, 152137, 182641, 213145 |
| 582 | AGX16504 | 29158 | 59662 | 90166, 120670, 151174, 181678, 212182 | 1546 | AHL93393 | 30122 | 60626 | 91130, 121634, 152138, 182642, 213146 |
| 583 | AGX16515 | 29159 | 59663 | 90167, 120671, 151175, 181679, 212183 | 1547 | AHL93404 | 30123 | 60627 | 91131, 121635, 152139, 182643, 213147 |
| 584 | AGX16548 | 29160 | 59664 | 90168, 120672, 151176, 181680, 212184 | 1548 | AHL93415 | 30124 | 60628 | 91132, 121636, 152140, 182644, 213148 |
| 585 | AGX16559 | 29161 | 59665 | 90169, 120673, 151177, 181681, 212185 | 1549 | AHL93426 | 30125 | 60629 | 91133, 121637, 152141, 182645, 213149 |
| 586 | AGX16581 | 29162 | 59666 | 90170, 120674, 151178, 181682, 212186 | 1550 | AHL93437 | 30126 | 60630 | 91134, 121638, 152142, 182646, 213150 |
| 587 | AGX16592 | 29163 | 59667 | 90171, 120675, 151179, 181683, 212187 | 1551 | AHL93448 | 30127 | 60631 | 91135, 121639, 152143, 182647, 213151 |

FIG. 4 continued

| | | | | | | | | | |
|---|---|---|---|---|---|---|---|---|---|
| 588 | AGX16603 | 29164 | 59668 | 90172, 120676, 151180, 181684, 212188 | 1552 | AHL93459 | 30128 | 60632 | 91136, 121640, 152144, 182648, 213152 |
| 589 | AGX16614 | 29165 | 59669 | 90173, 120677, 151181, 181685, 212189 | 1553 | AHL93470 | 30129 | 60633 | 91137, 121641, 152145, 182649, 213153 |
| 590 | AGX16625 | 29166 | 59670 | 90174, 120678, 151182, 181686, 212190 | 1554 | AHL93481 | 30130 | 60634 | 91138, 121642, 152146, 182650, 213154 |
| 591 | AGX16636 | 29167 | 59671 | 90175, 120679, 151183, 181687, 212191 | 1555 | AHL93492 | 30131 | 60635 | 91139, 121643, 152147, 182651, 213155 |
| 592 | AGX16647 | 29168 | 59672 | 90176, 120680, 151184, 181688, 212192 | 1556 | AHL93503 | 30132 | 60636 | 91140, 121644, 152148, 182652, 213156 |
| 593 | AGX16658 | 29169 | 59673 | 90177, 120681, 151185, 181689, 212193 | 1557 | AHL93514 | 30133 | 60637 | 91141, 121645, 152149, 182653, 213157 |
| 594 | AGX16669 | 29170 | 59674 | 90178, 120682, 151186, 181690, 212194 | 1558 | AHL93525 | 30134 | 60638 | 91142, 121646, 152150, 182654, 213158 |
| 595 | AGX16680 | 29171 | 59675 | 90179, 120683, 151187, 181691, 212195 | 1559 | AHL93536 | 30135 | 60639 | 91143, 121647, 152151, 182655, 213159 |
| 596 | AGX16691 | 29172 | 59676 | 90180, 120684, 151188, 181692, 212196 | 1560 | AHL93558 | 30136 | 60640 | 91144, 121648, 152152, 182656, 213160 |
| 597 | AGX16702 | 29173 | 59677 | 90181, 120685, 151189, 181693, 212197 | 1561 | AHL93569 | 30137 | 60641 | 91145, 121649, 152153, 182657, 213161 |
| 598 | AGX16713 | 29174 | 59678 | 90182, 120686, 151190, 181694, 212198 | 1562 | AHL93580 | 30138 | 60642 | 91146, 121650, 152154, 182658, 213162 |
| 599 | AGX16724 | 29175 | 59679 | 90183, 120687, 151191, 181695, 212199 | 1563 | AHL93591 | 30139 | 60643 | 91147, 121651, 152155, 182659, 213163 |
| 600 | AGX16735 | 29176 | 59680 | 90184, 120688, 151192, 181696, 212200 | 1564 | AHL93613 | 30140 | 60644 | 91148, 121652, 152156, 182660, 213164 |
| 601 | AGX16746 | 29177 | 59681 | 90185, 120689, 151193, 181697, 212201 | 1565 | AHL93624 | 30141 | 60645 | 91149, 121653, 152157, 182661, 213165 |
| 602 | AGX16757 | 29178 | 59682 | 90186, 120690, 151194, 181698, 212202 | 1566 | AHL93635 | 30142 | 60646 | 91150, 121654, 152158, 182662, 213166 |
| 603 | AGX16768 | 29179 | 59683 | 90187, 120691, 151195, 181699, 212203 | 1567 | AHL93646 | 30143 | 60647 | 91151, 121655, 152159, 182663, 213167 |
| 604 | AGX16779 | 29180 | 59684 | 90188, 120692, 151196, 181700, 212204 | 1568 | AHL93657 | 30144 | 60648 | 91152, 121656, 152160, 182664, 213168 |
| 605 | AGX16790 | 29181 | 59685 | 90189, 120693, 151197, 181701, 212205 | 1569 | AHL93668 | 30145 | 60649 | 91153, 121657, 152161, 182665, 213169 |

FIG. 4 continued

| | | | | | | | | | |
|---|---|---|---|---|---|---|---|---|---|
| 606 | AGX16801 | 29182 | 59686 | 90190, 120694, 151198, 181702, 212206 | 1570 | AHL93679 | 30146 | 60650 | 91154, 121658, 152162, 182666, 213170 |
| 607 | AGX16812 | 29183 | 59687 | 90191, 120695, 151199, 181703, 212207 | 1571 | AHL93690 | 30147 | 60651 | 91155, 121659, 152163, 182667, 213171 |
| 608 | AGX16823 | 29184 | 59688 | 90192, 120696, 151200, 181704, 212208 | 1572 | AHL93701 | 30148 | 60652 | 91156, 121660, 152164, 182668, 213172 |
| 609 | AGX16834 | 29185 | 59689 | 90193, 120697, 151201, 181705, 212209 | 1573 | AHL93712 | 30149 | 60653 | 91157, 121661, 152165, 182669, 213173 |
| 610 | AGX16845 | 29186 | 59690 | 90194, 120698, 151202, 181706, 212210 | 1574 | AHL93723 | 30150 | 60654 | 91158, 121662, 152166, 182670, 213174 |
| 611 | AGX16856 | 29187 | 59691 | 90195, 120699, 151203, 181707, 212211 | 1575 | AHL93734 | 30151 | 60655 | 91159, 121663, 152167, 182671, 213175 |
| 612 | AGX16867 | 29188 | 59692 | 90196, 120700, 151204, 181708, 212212 | 1576 | AHL93745 | 30152 | 60656 | 91160, 121664, 152168, 182672, 213176 |
| 613 | AGX16878 | 29189 | 59693 | 90197, 120701, 151205, 181709, 212213 | 1577 | AHL93756 | 30153 | 60657 | 91161, 121665, 152169, 182673, 213177 |
| 614 | AGX16889 | 29190 | 59694 | 90198, 120702, 151206, 181710, 212214 | 1578 | AHL93767 | 30154 | 60658 | 91162, 121666, 152170, 182674, 213178 |
| 615 | AGX16900 | 29191 | 59695 | 90199, 120703, 151207, 181711, 212215 | 1579 | AHL93778 | 30155 | 60659 | 91163, 121667, 152171, 182675, 213179 |
| 616 | AGX16911 | 29192 | 59696 | 90200, 120704, 151208, 181712, 212216 | 1580 | AHL93789 | 30156 | 60660 | 91164, 121668, 152172, 182676, 213180 |
| 617 | AGX16922 | 29193 | 59697 | 90201, 120705, 151209, 181713, 212217 | 1581 | AHL93800 | 30157 | 60661 | 91165, 121669, 152173, 182677, 213181 |
| 618 | AGX16933 | 29194 | 59698 | 90202, 120706, 151210, 181714, 212218 | 1582 | AHL93811 | 30158 | 60662 | 91166, 121670, 152174, 182678, 213182 |
| 619 | AGX16944 | 29195 | 59699 | 90203, 120707, 151211, 181715, 212219 | 1583 | AHL93822 | 30159 | 60663 | 91167, 121671, 152175, 182679, 213183 |
| 620 | AGX16955 | 29196 | 59700 | 90204, 120708, 151212, 181716, 212220 | 1584 | AHL93833 | 30160 | 60664 | 91168, 121672, 152176, 182680, 213184 |
| 621 | AGX16966 | 29197 | 59701 | 90205, 120709, 151213, 181717, 212221 | 1585 | AHL93844 | 30161 | 60665 | 91169, 121673, 152177, 182681, 213185 |
| 622 | AGX16977 | 29198 | 59702 | 90206, 120710, 151214, 181718, 212222 | 1586 | AHL93855 | 30162 | 60666 | 91170, 121674, 152178, 182682, 213186 |
| 623 | AGX16988 | 29199 | 59703 | 90207, 120711, 151215, 181719, 212223 | 1587 | AHL93866 | 30163 | 60667 | 91171, 121675, 152179, 182683, 213187 |

FIG. 4 continued

| | | | | | | | | | |
|---|---|---|---|---|---|---|---|---|---|
| 624 | AGX16999 | 29200 | 59704 | 90208, 120712, 151216, 181720, 212224 | 1588 | AHL93877 | 30164 | 60668 | 91172, 121676, 152180, 182684, 213188 |
| 625 | AGX17010 | 29201 | 59705 | 90209, 120713, 151217, 181721, 212225 | 1589 | AHL93888 | 30165 | 60669 | 91173, 121677, 152181, 182685, 213189 |
| 626 | AGX17021 | 29202 | 59706 | 90210, 120714, 151218, 181722, 212226 | 1590 | AHL93899 | 30166 | 60670 | 91174, 121678, 152182, 182686, 213190 |
| 627 | AGX17032 | 29203 | 59707 | 90211, 120715, 151219, 181723, 212227 | 1591 | AHL93910 | 30167 | 60671 | 91175, 121679, 152183, 182687, 213191 |
| 628 | AGX17043 | 29204 | 59708 | 90212, 120716, 151220, 181724, 212228 | 1592 | AHL93921 | 30168 | 60672 | 91176, 121680, 152184, 182688, 213192 |
| 629 | AGX17054 | 29205 | 59709 | 90213, 120717, 151221, 181725, 212229 | 1593 | AHL93932 | 30169 | 60673 | 91177, 121681, 152185, 182689, 213193 |
| 630 | AGX17065 | 29206 | 59710 | 90214, 120718, 151222, 181726, 212230 | 1594 | AHL93943 | 30170 | 60674 | 91178, 121682, 152186, 182690, 213194 |
| 631 | AGX17076 | 29207 | 59711 | 90215, 120719, 151223, 181727, 212231 | 1595 | AHL93954 | 30171 | 60675 | 91179, 121683, 152187, 182691, 213195 |
| 632 | AGX17087 | 29208 | 59712 | 90216, 120720, 151224, 181728, 212232 | 1596 | AHL93965 | 30172 | 60676 | 91180, 121684, 152188, 182692, 213196 |
| 633 | AGX17098 | 29209 | 59713 | 90217, 120721, 151225, 181729, 212233 | 1597 | AHL93976 | 30173 | 60677 | 91181, 121685, 152189, 182693, 213197 |
| 634 | AGX17109 | 29210 | 59714 | 90218, 120722, 151226, 181730, 212234 | 1598 | AHL93987 | 30174 | 60678 | 91182, 121686, 152190, 182694, 213198 |
| 635 | AGX17120 | 29211 | 59715 | 90219, 120723, 151227, 181731, 212235 | 1599 | AHL93998 | 30175 | 60679 | 91183, 121687, 152191, 182695, 213199 |
| 636 | AGX17131 | 29212 | 59716 | 90220, 120724, 151228, 181732, 212236 | 1600 | AHL94009 | 30176 | 60680 | 91184, 121688, 152192, 182696, 213200 |
| 637 | AGX17142 | 29213 | 59717 | 90221, 120725, 151229, 181733, 212237 | 1601 | AHL94020 | 30177 | 60681 | 91185, 121689, 152193, 182697, 213201 |
| 638 | AGX17153 | 29214 | 59718 | 90222, 120726, 151230, 181734, 212238 | 1602 | AHL94031 | 30178 | 60682 | 91186, 121690, 152194, 182698, 213202 |
| 639 | AGX17164 | 29215 | 59719 | 90223, 120727, 151231, 181735, 212239 | 1603 | AHL94042 | 30179 | 60683 | 91187, 121691, 152195, 182699, 213203 |
| 640 | AGX17175 | 29216 | 59720 | 90224, 120728, 151232, 181736, 212240 | 1604 | AHL94053 | 30180 | 60684 | 91188, 121692, 152196, 182700, 213204 |
| 641 | AGX17186 | 29217 | 59721 | 90225, 120729, 151233, 181737, 212241 | 1605 | AHL94064 | 30181 | 60685 | 91189, 121693, 152197, 182701, 213205 |

FIG. 4 continued

| | | | | | | | | | |
|---|---|---|---|---|---|---|---|---|---|
| 642 | AGX17197 | 29218 | 59722 | 90226, 120730, 151234, 181738, 212242 | 1606 | AHL94075 | 30182 | 60686 | 91190, 121694, 152198, 182702, 213206 |
| 643 | AGX17208 | 29219 | 59723 | 90227, 120731, 151235, 181739, 212243 | 1607 | AHL94086 | 30183 | 60687 | 91191, 121695, 152199, 182703, 213207 |
| 644 | AGX17219 | 29220 | 59724 | 90228, 120732, 151236, 181740, 212244 | 1608 | AHL94095 | 30184 | 60688 | 91192, 121696, 152200, 182704, 213208 |
| 645 | AGX17230 | 29221 | 59725 | 90229, 120733, 151237, 181741, 212245 | 1609 | AHL94106 | 30185 | 60689 | 91193, 121697, 152201, 182705, 213209 |
| 646 | AGX17241 | 29222 | 59726 | 90230, 120734, 151238, 181742, 212246 | 1610 | AHL94117 | 30186 | 60690 | 91194, 121698, 152202, 182706, 213210 |
| 647 | AGX17252 | 29223 | 59727 | 90231, 120735, 151239, 181743, 212247 | 1611 | AHL94128 | 30187 | 60691 | 91195, 121699, 152203, 182707, 213211 |
| 648 | AGX17263 | 29224 | 59728 | 90232, 120736, 151240, 181744, 212248 | 1612 | AHL94139 | 30188 | 60692 | 91196, 121700, 152204, 182708, 213212 |
| 649 | AGX17274 | 29225 | 59729 | 90233, 120737, 151241, 181745, 212249 | 1613 | AHL94150 | 30189 | 60693 | 91197, 121701, 152205, 182709, 213213 |
| 650 | AGX17285 | 29226 | 59730 | 90234, 120738, 151242, 181746, 212250 | 1614 | AHL94161 | 30190 | 60694 | 91198, 121702, 152206, 182710, 213214 |
| 651 | AGX17296 | 29227 | 59731 | 90235, 120739, 151243, 181747, 212251 | 1615 | AHL94183 | 30191 | 60695 | 91199, 121703, 152207, 182711, 213215 |
| 652 | AGX17307 | 29228 | 59732 | 90236, 120740, 151244, 181748, 212252 | 1616 | AHL94194 | 30192 | 60696 | 91200, 121704, 152208, 182712, 213216 |
| 653 | AGX17318 | 29229 | 59733 | 90237, 120741, 151245, 181749, 212253 | 1617 | AHL94205 | 30193 | 60697 | 91201, 121705, 152209, 182713, 213217 |
| 654 | AGX17329 | 29230 | 59734 | 90238, 120742, 151246, 181750, 212254 | 1618 | AHL94214 | 30194 | 60698 | 91202, 121706, 152210, 182714, 213218 |
| 655 | AGX17340 | 29231 | 59735 | 90239, 120743, 151247, 181751, 212255 | 1619 | AHL94224 | 30195 | 60699 | 91203, 121707, 152211, 182715, 213219 |
| 656 | AGX17351 | 29232 | 59736 | 90240, 120744, 151248, 181752, 212256 | 1620 | AHL94235 | 30196 | 60700 | 91204, 121708, 152212, 182716, 213220 |
| 657 | AGX17362 | 29233 | 59737 | 90241, 120745, 151249, 181753, 212257 | 1621 | AHL94246 | 30197 | 60701 | 91205, 121709, 152213, 182717, 213221 |
| 658 | AGX17373 | 29234 | 59738 | 90242, 120746, 151250, 181754, 212258 | 1622 | AHL94257 | 30198 | 60702 | 91206, 121710, 152214, 182718, 213222 |
| 659 | AGX17384 | 29235 | 59739 | 90243, 120747, 151251, 181755, 212259 | 1623 | AHL94267 | 30199 | 60703 | 91207, 121711, 152215, 182719, 213223 |

FIG. 4 continued

| | | | | | | | | | |
|---|---|---|---|---|---|---|---|---|---|
| 660 | AGX17395 | 29236 | 59740 | 90244, 120748, 151252, 181756, 212260 | 1624 | AHL94278 | 30200 | 60704 | 91208, 121712, 152216, 182720, 213224 |
| 661 | AGX17404 | 29237 | 59741 | 90245, 120749, 151253, 181757, 212261 | 1625 | AHL94299 | 30201 | 60705 | 91209, 121713, 152217, 182721, 213225 |
| 662 | AGX17415 | 29238 | 59742 | 90246, 120750, 151254, 181758, 212262 | 1626 | AHL94310 | 30202 | 60706 | 91210, 121714, 152218, 182722, 213226 |
| 663 | AGX17426 | 29239 | 59743 | 90247, 120751, 151255, 181759, 212263 | 1627 | AHL94321 | 30203 | 60707 | 91211, 121715, 152219, 182723, 213227 |
| 664 | AGX17437 | 29240 | 59744 | 90248, 120752, 151256, 181760, 212264 | 1628 | AHL94332 | 30204 | 60708 | 91212, 121716, 152220, 182724, 213228 |
| 665 | AGX17448 | 29241 | 59745 | 90249, 120753, 151257, 181761, 212265 | 1629 | AHL94343 | 30205 | 60709 | 91213, 121717, 152221, 182725, 213229 |
| 666 | AGX17459 | 29242 | 59746 | 90250, 120754, 151258, 181762, 212266 | 1630 | AHL94354 | 30206 | 60710 | 91214, 121718, 152222, 182726, 213230 |
| 667 | AGX17470 | 29243 | 59747 | 90251, 120755, 151259, 181763, 212267 | 1631 | AHL94365 | 30207 | 60711 | 91215, 121719, 152223, 182727, 213231 |
| 668 | AGX17481 | 29244 | 59748 | 90252, 120756, 151260, 181764, 212268 | 1632 | AHL94387 | 30208 | 60712 | 91216, 121720, 152224, 182728, 213232 |
| 669 | AGX17492 | 29245 | 59749 | 90253, 120757, 151261, 181765, 212269 | 1633 | AHL94398 | 30209 | 60713 | 91217, 121721, 152225, 182729, 213233 |
| 670 | AGX17503 | 29246 | 59750 | 90254, 120758, 151262, 181766, 212270 | 1634 | AHL94409 | 30210 | 60714 | 91218, 121722, 152226, 182730, 213234 |
| 671 | AGX17514 | 29247 | 59751 | 90255, 120759, 151263, 181767, 212271 | 1635 | AHL94431 | 30211 | 60715 | 91219, 121723, 152227, 182731, 213235 |
| 672 | AGX17525 | 29248 | 59752 | 90256, 120760, 151264, 181768, 212272 | 1636 | AHL94442 | 30212 | 60716 | 91220, 121724, 152228, 182732, 213236 |
| 673 | AGX17536 | 29249 | 59753 | 90257, 120761, 151265, 181769, 212273 | 1637 | AHL94464 | 30213 | 60717 | 91221, 121725, 152229, 182733, 213237 |
| 674 | AGX17547 | 29250 | 59754 | 90258, 120762, 151266, 181770, 212274 | 1638 | AHL94475 | 30214 | 60718 | 91222, 121726, 152230, 182734, 213238 |
| 675 | AGX17558 | 29251 | 59755 | 90259, 120763, 151267, 181771, 212275 | 1639 | AHL94486 | 30215 | 60719 | 91223, 121727, 152231, 182735, 213239 |
| 676 | AGX17569 | 29252 | 59756 | 90260, 120764, 151268, 181772, 212276 | 1640 | AHL94497 | 30216 | 60720 | 91224, 121728, 152232, 182736, 213240 |
| 677 | AGX17580 | 29253 | 59757 | 90261, 120765, 151269, 181773, 212277 | 1641 | AHL94508 | 30217 | 60721 | 91225, 121729, 152233, 182737, 213241 |

FIG. 4 continued

| | | | | | | | | | |
|---|---|---|---|---|---|---|---|---|---|
| 678 | AGX17591 | 29254 | 59758 | 90262, 120766, 151270, 181774, 212278 | 1642 | AHL94519 | 30218 | 60722 | 91226, 121730, 152234, 182738, 213242 |
| 679 | AGX17602 | 29255 | 59759 | 90263, 120767, 151271, 181775, 212279 | 1643 | AHL94530 | 30219 | 60723 | 91227, 121731, 152235, 182739, 213243 |
| 680 | AGX17613 | 29256 | 59760 | 90264, 120768, 151272, 181776, 212280 | 1644 | AHL94541 | 30220 | 60724 | 91228, 121732, 152236, 182740, 213244 |
| 681 | AGX17624 | 29257 | 59761 | 90265, 120769, 151273, 181777, 212281 | 1645 | AHL94563 | 30221 | 60725 | 91229, 121733, 152237, 182741, 213245 |
| 682 | AGX17635 | 29258 | 59762 | 90266, 120770, 151274, 181778, 212282 | 1646 | AHL94574 | 30222 | 60726 | 91230, 121734, 152238, 182742, 213246 |
| 683 | AGX17657 | 29259 | 59763 | 90267, 120771, 151275, 181779, 212283 | 1647 | AHL94585 | 30223 | 60727 | 91231, 121735, 152239, 182743, 213247 |
| 684 | AGX17668 | 29260 | 59764 | 90268, 120772, 151276, 181780, 212284 | 1648 | AHL94596 | 30224 | 60728 | 91232, 121736, 152240, 182744, 213248 |
| 685 | AGX17679 | 29261 | 59765 | 90269, 120773, 151277, 181781, 212285 | 1649 | AHL94607 | 30225 | 60729 | 91233, 121737, 152241, 182745, 213249 |
| 686 | AGX17690 | 29262 | 59766 | 90270, 120774, 151278, 181782, 212286 | 1650 | AHL94618 | 30226 | 60730 | 91234, 121738, 152242, 182746, 213250 |
| 687 | AGX17701 | 29263 | 59767 | 90271, 120775, 151279, 181783, 212287 | 1651 | AHL94628 | 30227 | 60731 | 91235, 121739, 152243, 182747, 213251 |
| 688 | AGX17723 | 29264 | 59768 | 90272, 120776, 151280, 181784, 212288 | 1652 | AHL94639 | 30228 | 60732 | 91236, 121740, 152244, 182748, 213252 |
| 689 | AGX17734 | 29265 | 59769 | 90273, 120777, 151281, 181785, 212289 | 1653 | AHL94650 | 30229 | 60733 | 91237, 121741, 152245, 182749, 213253 |
| 690 | AGX17745 | 29266 | 59770 | 90274, 120778, 151282, 181786, 212290 | 1654 | AHL94661 | 30230 | 60734 | 91238, 121742, 152246, 182750, 213254 |
| 691 | AGX17756 | 29267 | 59771 | 90275, 120779, 151283, 181787, 212291 | 1655 | AHL94672 | 30231 | 60735 | 91239, 121743, 152247, 182751, 213255 |
| 692 | AGX17767 | 29268 | 59772 | 90276, 120780, 151284, 181788, 212292 | 1656 | AHL94683 | 30232 | 60736 | 91240, 121744, 152248, 182752, 213256 |
| 693 | AGX17778 | 29269 | 59773 | 90277, 120781, 151285, 181789, 212293 | 1657 | AHL94694 | 30233 | 60737 | 91241, 121745, 152249, 182753, 213257 |
| 694 | AGX17789 | 29270 | 59774 | 90278, 120782, 151286, 181790, 212294 | 1658 | AHL94705 | 30234 | 60738 | 91242, 121746, 152250, 182754, 213258 |
| 695 | AGX17800 | 29271 | 59775 | 90279, 120783, 151287, 181791, 212295 | 1659 | AHL94716 | 30235 | 60739 | 91243, 121747, 152251, 182755, 213259 |

FIG. 4 continued

| | | | | | | | | | |
|---|---|---|---|---|---|---|---|---|---|
| 696 | AGX17811 | 29272 | 59776 | 90280, 120784, 151288, 181792, 212296 | 1660 | AHL94727 | 30236 | 60740 | 91244, 121748, 152252, 182756, 213260 |
| 697 | AGX17822 | 29273 | 59777 | 90281, 120785, 151289, 181793, 212297 | 1661 | AHL94738 | 30237 | 60741 | 91245, 121749, 152253, 182757, 213261 |
| 698 | AGX17833 | 29274 | 59778 | 90282, 120786, 151290, 181794, 212298 | 1662 | AHL94749 | 30238 | 60742 | 91246, 121750, 152254, 182758, 213262 |
| 699 | AGX17844 | 29275 | 59779 | 90283, 120787, 151291, 181795, 212299 | 1663 | AHL94760 | 30239 | 60743 | 91247, 121751, 152255, 182759, 213263 |
| 700 | AGX17855 | 29276 | 59780 | 90284, 120788, 151292, 181796, 212300 | 1664 | AHL94770 | 30240 | 60744 | 91248, 121752, 152256, 182760, 213264 |
| 701 | AGX17866 | 29277 | 59781 | 90285, 120789, 151293, 181797, 212301 | 1665 | AHL94781 | 30241 | 60745 | 91249, 121753, 152257, 182761, 213265 |
| 702 | AGX17877 | 29278 | 59782 | 90286, 120790, 151294, 181798, 212302 | 1666 | AHL94791 | 30242 | 60746 | 91250, 121754, 152258, 182762, 213266 |
| 703 | AGX17888 | 29279 | 59783 | 90287, 120791, 151295, 181799, 212303 | 1667 | AHL94801 | 30243 | 60747 | 91251, 121755, 152259, 182763, 213267 |
| 704 | AGX17899 | 29280 | 59784 | 90288, 120792, 151296, 181800, 212304 | 1668 | AHL94812 | 30244 | 60748 | 91252, 121756, 152260, 182764, 213268 |
| 705 | AGX17910 | 29281 | 59785 | 90289, 120793, 151297, 181801, 212305 | 1669 | AHL94821 | 30245 | 60749 | 91253, 121757, 152261, 182765, 213269 |
| 706 | AGX17921 | 29282 | 59786 | 90290, 120794, 151298, 181802, 212306 | 1670 | AHL94831 | 30246 | 60750 | 91254, 121758, 152262, 182766, 213270 |
| 707 | AGX17932 | 29283 | 59787 | 90291, 120795, 151299, 181803, 212307 | 1671 | AHL94840 | 30247 | 60751 | 91255, 121759, 152263, 182767, 213271 |
| 708 | AGX17943 | 29284 | 59788 | 90292, 120796, 151300, 181804, 212308 | 1672 | AHL94851 | 30248 | 60752 | 91256, 121760, 152264, 182768, 213272 |
| 709 | AGX17954 | 29285 | 59789 | 90293, 120797, 151301, 181805, 212309 | 1673 | AHL94862 | 30249 | 60753 | 91257, 121761, 152265, 182769, 213273 |
| 710 | AGX17976 | 29286 | 59790 | 90294, 120798, 151302, 181806, 212310 | 1674 | AHL94873 | 30250 | 60754 | 91258, 121762, 152266, 182770, 213274 |
| 711 | AGX17987 | 29287 | 59791 | 90295, 120799, 151303, 181807, 212311 | 1675 | AHL94884 | 30251 | 60755 | 91259, 121763, 152267, 182771, 213275 |
| 712 | AGX17998 | 29288 | 59792 | 90296, 120800, 151304, 181808, 212312 | 1676 | AHL94893 | 30252 | 60756 | 91260, 121764, 152268, 182772, 213276 |
| 713 | AGX18009 | 29289 | 59793 | 90297, 120801, 151305, 181809, 212313 | 1677 | AHL94904 | 30253 | 60757 | 91261, 121765, 152269, 182773, 213277 |

FIG. 4 continued

| | | | | | | | | | |
|---|---|---|---|---|---|---|---|---|---|
| 714 | AGX18020 | 29290 | 59794 | 90298, 120802, 151306, 181810, 212314 | 1678 | AHL94915 | 30254 | 60758 | 91262, 121766, 152270, 182774, 213278 |
| 715 | AGX18031 | 29291 | 59795 | 90299, 120803, 151307, 181811, 212315 | 1679 | AHL94926 | 30255 | 60759 | 91263, 121767, 152271, 182775, 213279 |
| 716 | AGX18042 | 29292 | 59796 | 90300, 120804, 151308, 181812, 212316 | 1680 | AHL94937 | 30256 | 60760 | 91264, 121768, 152272, 182776, 213280 |
| 717 | AGX18053 | 29293 | 59797 | 90301, 120805, 151309, 181813, 212317 | 1681 | AHL94948 | 30257 | 60761 | 91265, 121769, 152273, 182777, 213281 |
| 718 | AGX18064 | 29294 | 59798 | 90302, 120806, 151310, 181814, 212318 | 1682 | AHL94959 | 30258 | 60762 | 91266, 121770, 152274, 182778, 213282 |
| 719 | AGX18075 | 29295 | 59799 | 90303, 120807, 151311, 181815, 212319 | 1683 | AHL94969 | 30259 | 60763 | 91267, 121771, 152275, 182779, 213283 |
| 720 | AGX18086 | 29296 | 59800 | 90304, 120808, 151312, 181816, 212320 | 1684 | AHL94978 | 30260 | 60764 | 91268, 121772, 152276, 182780, 213284 |
| 721 | AGX18097 | 29297 | 59801 | 90305, 120809, 151313, 181817, 212321 | 1685 | AHM00990 | 30261 | 60765 | 91269, 121773, 152277, 182781, 213285 |
| 722 | AGX18108 | 29298 | 59802 | 90306, 120810, 151314, 181818, 212322 | 1686 | AHM01001 | 30262 | 60766 | 91270, 121774, 152278, 182782, 213286 |
| 723 | AGX18119 | 29299 | 59803 | 90307, 120811, 151315, 181819, 212323 | 1687 | AHM01012 | 30263 | 60767 | 91271, 121775, 152279, 182783, 213287 |
| 724 | AGX18130 | 29300 | 59804 | 90308, 120812, 151316, 181820, 212324 | 1688 | AHM01023 | 30264 | 60768 | 91272, 121776, 152280, 182784, 213288 |
| 725 | AGX18141 | 29301 | 59805 | 90309, 120813, 151317, 181821, 212325 | 1689 | AHM01034 | 30265 | 60769 | 91273, 121777, 152281, 182785, 213289 |
| 726 | AGX18152 | 29302 | 59806 | 90310, 120814, 151318, 181822, 212326 | 1690 | AHM01045 | 30266 | 60770 | 91274, 121778, 152282, 182786, 213290 |
| 727 | AGX18163 | 29303 | 59807 | 90311, 120815, 151319, 181823, 212327 | 1691 | AHM01056 | 30267 | 60771 | 91275, 121779, 152283, 182787, 213291 |
| 728 | AGX18174 | 29304 | 59808 | 90312, 120816, 151320, 181824, 212328 | 1692 | AHM01067 | 30268 | 60772 | 91276, 121780, 152284, 182788, 213292 |
| 729 | AGX18185 | 29305 | 59809 | 90313, 120817, 151321, 181825, 212329 | 1693 | AHM01078 | 30269 | 60773 | 91277, 121781, 152285, 182789, 213293 |
| 730 | AGX18196 | 29306 | 59810 | 90314, 120818, 151322, 181826, 212330 | 1694 | AHM01089 | 30270 | 60774 | 91278, 121782, 152286, 182790, 213294 |
| 731 | AGX18207 | 29307 | 59811 | 90315, 120819, 151323, 181827, 212331 | 1695 | AHM01100 | 30271 | 60775 | 91279, 121783, 152287, 182791, 213295 |

FIG. 4 continued

| | | | | | | | | | |
|---|---|---|---|---|---|---|---|---|---|
| 732 | AGX18218 | 29308 | 59812 | 90316, 120820, 151324, 181828, 212332 | 1696 | AHM01111 | 30272 | 60776 | 91280, 121784, 152288, 182792, 213296 |
| 733 | AGX18229 | 29309 | 59813 | 90317, 120821, 151325, 181829, 212333 | 1697 | AHM01122 | 30273 | 60777 | 91281, 121785, 152289, 182793, 213297 |
| 734 | AGX18240 | 29310 | 59814 | 90318, 120822, 151326, 181830, 212334 | 1698 | AHM01133 | 30274 | 60778 | 91282, 121786, 152290, 182794, 213298 |
| 735 | AGX18251 | 29311 | 59815 | 90319, 120823, 151327, 181831, 212335 | 1699 | AHM01144 | 30275 | 60779 | 91283, 121787, 152291, 182795, 213299 |
| 736 | AGX18262 | 29312 | 59816 | 90320, 120824, 151328, 181832, 212336 | 1700 | AHM01166 | 30276 | 60780 | 91284, 121788, 152292, 182796, 213300 |
| 737 | AGX18273 | 29313 | 59817 | 90321, 120825, 151329, 181833, 212337 | 1701 | AHM01188 | 30277 | 60781 | 91285, 121789, 152293, 182797, 213301 |
| 738 | AGX18284 | 29314 | 59818 | 90322, 120826, 151330, 181834, 212338 | 1702 | AHM01199 | 30278 | 60782 | 91286, 121790, 152294, 182798, 213302 |
| 739 | AGX18295 | 29315 | 59819 | 90323, 120827, 151331, 181835, 212339 | 1703 | AHM01210 | 30279 | 60783 | 91287, 121791, 152295, 182799, 213303 |
| 740 | AGX18306 | 29316 | 59820 | 90324, 120828, 151332, 181836, 212340 | 1704 | AHM01221 | 30280 | 60784 | 91288, 121792, 152296, 182800, 213304 |
| 741 | AGX18317 | 29317 | 59821 | 90325, 120829, 151333, 181837, 212341 | 1705 | AHM01232 | 30281 | 60785 | 91289, 121793, 152297, 182801, 213305 |
| 742 | AGX18328 | 29318 | 59822 | 90326, 120830, 151334, 181838, 212342 | 1706 | AHM01243 | 30282 | 60786 | 91290, 121794, 152298, 182802, 213306 |
| 743 | AGX18339 | 29319 | 59823 | 90327, 120831, 151335, 181839, 212343 | 1707 | AHM01254 | 30283 | 60787 | 91291, 121795, 152299, 182803, 213307 |
| 744 | AGX18350 | 29320 | 59824 | 90328, 120832, 151336, 181840, 212344 | 1708 | AHM01265 | 30284 | 60788 | 91292, 121796, 152300, 182804, 213308 |
| 745 | AGX18361 | 29321 | 59825 | 90329, 120833, 151337, 181841, 212345 | 1709 | AHM01276 | 30285 | 60789 | 91293, 121797, 152301, 182805, 213309 |
| 746 | AGX18383 | 29322 | 59826 | 90330, 120834, 151338, 181842, 212346 | 1710 | AHM01287 | 30286 | 60790 | 91294, 121798, 152302, 182806, 213310 |
| 747 | AGX18394 | 29323 | 59827 | 90331, 120835, 151339, 181843, 212347 | 1711 | AHM01298 | 30287 | 60791 | 91295, 121799, 152303, 182807, 213311 |
| 748 | AGX18405 | 29324 | 59828 | 90332, 120836, 151340, 181844, 212348 | 1712 | AHM01309 | 30288 | 60792 | 91296, 121800, 152304, 182808, 213312 |
| 749 | AGX18416 | 29325 | 59829 | 90333, 120837, 151341, 181845, 212349 | 1713 | AHM01320 | 30289 | 60793 | 91297, 121801, 152305, 182809, 213313 |

FIG. 4 continued

| | | | | | | | | | |
|---|---|---|---|---|---|---|---|---|---|
| 750 | AGX18428 | 29326 | 59830 | 90334, 120838, 151342, 181846, 212350 | 1714 | AHM01331 | 30290 | 60794 | 91298, 121802, 152306, 182810, 213314 |
| 751 | AGX18439 | 29327 | 59831 | 90335, 120839, 151343, 181847, 212351 | 1715 | AHM01342 | 30291 | 60795 | 91299, 121803, 152307, 182811, 213315 |
| 752 | AGX18450 | 29328 | 59832 | 90336, 120840, 151344, 181848, 212352 | 1716 | AHM01353 | 30292 | 60796 | 91300, 121804, 152308, 182812, 213316 |
| 753 | AGX18461 | 29329 | 59833 | 90337, 120841, 151345, 181849, 212353 | 1717 | AHM01364 | 30293 | 60797 | 91301, 121805, 152309, 182813, 213317 |
| 754 | AGX18472 | 29330 | 59834 | 90338, 120842, 151346, 181850, 212354 | 1718 | AHM01375 | 30294 | 60798 | 91302, 121806, 152310, 182814, 213318 |
| 755 | AGX18483 | 29331 | 59835 | 90339, 120843, 151347, 181851, 212355 | 1719 | AHM01386 | 30295 | 60799 | 91303, 121807, 152311, 182815, 213319 |
| 756 | AGX18494 | 29332 | 59836 | 90340, 120844, 151348, 181852, 212356 | 1720 | AHM01397 | 30296 | 60800 | 91304, 121808, 152312, 182816, 213320 |
| 757 | AGX18505 | 29333 | 59837 | 90341, 120845, 151349, 181853, 212357 | 1721 | AHM01408 | 30297 | 60801 | 91305, 121809, 152313, 182817, 213321 |
| 758 | AGX18516 | 29334 | 59838 | 90342, 120846, 151350, 181854, 212358 | 1722 | AHM01419 | 30298 | 60802 | 91306, 121810, 152314, 182818, 213322 |
| 759 | AGX18527 | 29335 | 59839 | 90343, 120847, 151351, 181855, 212359 | 1723 | AHM01430 | 30299 | 60803 | 91307, 121811, 152315, 182819, 213323 |
| 760 | AGX18538 | 29336 | 59840 | 90344, 120848, 151352, 181856, 212360 | 1724 | AHM01441 | 30300 | 60804 | 91308, 121812, 152316, 182820, 213324 |
| 761 | AGX18549 | 29337 | 59841 | 90345, 120849, 151353, 181857, 212361 | 1725 | AHM01463 | 30301 | 60805 | 91309, 121813, 152317, 182821, 213325 |
| 762 | AGX18560 | 29338 | 59842 | 90346, 120850, 151354, 181858, 212362 | 1726 | AHM01474 | 30302 | 60806 | 91310, 121814, 152318, 182822, 213326 |
| 763 | AGX18571 | 29339 | 59843 | 90347, 120851, 151355, 181859, 212363 | 1727 | AHM01485 | 30303 | 60807 | 91311, 121815, 152319, 182823, 213327 |
| 764 | AGX18582 | 29340 | 59844 | 90348, 120852, 151356, 181860, 212364 | 1728 | AHM01496 | 30304 | 60808 | 91312, 121816, 152320, 182824, 213328 |
| 765 | AGX18593 | 29341 | 59845 | 90349, 120853, 151357, 181861, 212365 | 1729 | AHM01507 | 30305 | 60809 | 91313, 121817, 152321, 182825, 213329 |
| 766 | AGX18604 | 29342 | 59846 | 90350, 120854, 151358, 181862, 212366 | 1730 | AHM01518 | 30306 | 60810 | 91314, 121818, 152322, 182826, 213330 |
| 767 | AGX18615 | 29343 | 59847 | 90351, 120855, 151359, 181863, 212367 | 1731 | AHM01529 | 30307 | 60811 | 91315, 121819, 152323, 182827, 213331 |

FIG. 4 continued

| | | | | | | | | | |
|---|---|---|---|---|---|---|---|---|---|
| 768 | AGX18626 | 29344 | 59848 | 90352, 120856, 151360, 181864, 212368 | 1732 | AHM01540 | 30308 | 60812 | 91316, 121820, 152324, 182828, 213332 |
| 769 | AGX18637 | 29345 | 59849 | 90353, 120857, 151361, 181865, 212369 | 1733 | AHM01551 | 30309 | 60813 | 91317, 121821, 152325, 182829, 213333 |
| 770 | AGX18648 | 29346 | 59850 | 90354, 120858, 151362, 181866, 212370 | 1734 | AHM01562 | 30310 | 60814 | 91318, 121822, 152326, 182830, 213334 |
| 771 | AGX18659 | 29347 | 59851 | 90355, 120859, 151363, 181867, 212371 | 1735 | AHZ13597 | 30311 | 60815 | 91319, 121823, 152327, 182831, 213335 |
| 772 | AGX18670 | 29348 | 59852 | 90356, 120860, 151364, 181868, 212372 | 1736 | AHZ36701 | 30312 | 60816 | 91320, 121824, 152328, 182832, 213336 |
| 773 | AGX18681 | 29349 | 59853 | 90357, 120861, 151365, 181869, 212373 | 1737 | AHZ36756 | 30313 | 60817 | 91321, 121825, 152329, 182833, 213337 |
| 774 | AGX18692 | 29350 | 59854 | 90358, 120862, 151366, 181870, 212374 | 1738 | AHZ36767 | 30314 | 60818 | 91322, 121826, 152330, 182834, 213338 |
| 775 | AGX18703 | 29351 | 59855 | 90359, 120863, 151367, 181871, 212375 | 1739 | AHZ36778 | 30315 | 60819 | 91323, 121827, 152331, 182835, 213339 |
| 776 | AGX18714 | 29352 | 59856 | 90360, 120864, 151368, 181872, 212376 | 1740 | AHZ36789 | 30316 | 60820 | 91324, 121828, 152332, 182836, 213340 |
| 777 | AGX18725 | 29353 | 59857 | 90361, 120865, 151369, 181873, 212377 | 1741 | AHZ36800 | 30317 | 60821 | 91325, 121829, 152333, 182837, 213341 |
| 778 | AGX18736 | 29354 | 59858 | 90362, 120866, 151370, 181874, 212378 | 1742 | AHZ36811 | 30318 | 60822 | 91326, 121830, 152334, 182838, 213342 |
| 779 | AGX18758 | 29355 | 59859 | 90363, 120867, 151371, 181875, 212379 | 1743 | AHZ36822 | 30319 | 60823 | 91327, 121831, 152335, 182839, 213343 |
| 780 | AGX18769 | 29356 | 59860 | 90364, 120868, 151372, 181876, 212380 | 1744 | AHZ36833 | 30320 | 60824 | 91328, 121832, 152336, 182840, 213344 |
| 781 | AGX18780 | 29357 | 59861 | 90365, 120869, 151373, 181877, 212381 | 1745 | AHZ36844 | 30321 | 60825 | 91329, 121833, 152337, 182841, 213345 |
| 782 | AGX18791 | 29358 | 59862 | 90366, 120870, 151374, 181878, 212382 | 1746 | AHZ36855 | 30322 | 60826 | 91330, 121834, 152338, 182842, 213346 |
| 783 | AGX18802 | 29359 | 59863 | 90367, 120871, 151375, 181879, 212383 | 1747 | AHZ36866 | 30323 | 60827 | 91331, 121835, 152339, 182843, 213347 |
| 784 | AGX18813 | 29360 | 59864 | 90368, 120872, 151376, 181880, 212384 | 1748 | AHZ36877 | 30324 | 60828 | 91332, 121836, 152340, 182844, 213348 |
| 785 | AGX18824 | 29361 | 59865 | 90369, 120873, 151377, 181881, 212385 | 1749 | AHZ36888 | 30325 | 60829 | 91333, 121837, 152341, 182845, 213349 |

FIG. 4 continued

| | | | | | | | | | |
|---|---|---|---|---|---|---|---|---|---|
| 786 | AGX18846 | 29362 | 59866 | 90370, 120874, 151378, 181882, 212386 | 1750 | AHZ36899 | 30326 | 60830 | 91334, 121838, 152342, 182846, 213350 |
| 787 | AGX18857 | 29363 | 59867 | 90371, 120875, 151379, 181883, 212387 | 1751 | AHZ36910 | 30327 | 60831 | 91335, 121839, 152343, 182847, 213351 |
| 788 | AGX18868 | 29364 | 59868 | 90372, 120876, 151380, 181884, 212388 | 1752 | AHZ36921 | 30328 | 60832 | 91336, 121840, 152344, 182848, 213352 |
| 789 | AGX18879 | 29365 | 59869 | 90373, 120877, 151381, 181885, 212389 | 1753 | AHZ36932 | 30329 | 60833 | 91337, 121841, 152345, 182849, 213353 |
| 790 | AGX18890 | 29366 | 59870 | 90374, 120878, 151382, 181886, 212390 | 1754 | AHZ36943 | 30330 | 60834 | 91338, 121842, 152346, 182850, 213354 |
| 791 | AGX18912 | 29367 | 59871 | 90375, 120879, 151383, 181887, 212391 | 1755 | AHZ36954 | 30331 | 60835 | 91339, 121843, 152347, 182851, 213355 |
| 792 | AGX18923 | 29368 | 59872 | 90376, 120880, 151384, 181888, 212392 | 1756 | AHZ36965 | 30332 | 60836 | 91340, 121844, 152348, 182852, 213356 |
| 793 | AGX18934 | 29369 | 59873 | 90377, 120881, 151385, 181889, 212393 | 1757 | AHZ36976 | 30333 | 60837 | 91341, 121845, 152349, 182853, 213357 |
| 794 | AGX18956 | 29370 | 59874 | 90378, 120882, 151386, 181890, 212394 | 1758 | AHZ36987 | 30334 | 60838 | 91342, 121846, 152350, 182854, 213358 |
| 795 | AGX18967 | 29371 | 59875 | 90379, 120883, 151387, 181891, 212395 | 1759 | AHZ36998 | 30335 | 60839 | 91343, 121847, 152351, 182855, 213359 |
| 796 | AGX18978 | 29372 | 59876 | 90380, 120884, 151388, 181892, 212396 | 1760 | AHZ37009 | 30336 | 60840 | 91344, 121848, 152352, 182856, 213360 |
| 797 | AGX18989 | 29373 | 59877 | 90381, 120885, 151389, 181893, 212397 | 1761 | AHZ37020 | 30337 | 60841 | 91345, 121849, 152353, 182857, 213361 |
| 798 | AGX19000 | 29374 | 59878 | 90382, 120886, 151390, 181894, 212398 | 1762 | AHZ37031 | 30338 | 60842 | 91346, 121850, 152354, 182858, 213362 |
| 799 | AGX19011 | 29375 | 59879 | 90383, 120887, 151391, 181895, 212399 | 1763 | AHZ37042 | 30339 | 60843 | 91347, 121851, 152355, 182859, 213363 |
| 800 | AGX19022 | 29376 | 59880 | 90384, 120888, 151392, 181896, 212400 | 1764 | AHZ37064 | 30340 | 60844 | 91348, 121852, 152356, 182860, 213364 |
| 801 | AGX19033 | 29377 | 59881 | 90385, 120889, 151393, 181897, 212401 | 1765 | AHZ37075 | 30341 | 60845 | 91349, 121853, 152357, 182861, 213365 |
| 802 | AGX19044 | 29378 | 59882 | 90386, 120890, 151394, 181898, 212402 | 1766 | AHZ37086 | 30342 | 60846 | 91350, 121854, 152358, 182862, 213366 |
| 803 | AGX19055 | 29379 | 59883 | 90387, 120891, 151395, 181899, 212403 | 1767 | AHZ37097 | 30343 | 60847 | 91351, 121855, 152359, 182863, 213367 |

FIG. 4 continued

| | | | | | | | | | |
|---|---|---|---|---|---|---|---|---|---|
| 804 | AGX19066 | 29380 | 59884 | 90388, 120892, 151396, 181900, 212404 | 1768 | AHZ37108 | 30344 | 60848 | 91352, 121856, 152360, 182864, 213368 |
| 805 | AGX19077 | 29381 | 59885 | 90389, 120893, 151397, 181901, 212405 | 1769 | AHZ41774 | 30345 | 60849 | 91353, 121857, 152361, 182865, 213369 |
| 806 | AGX19088 | 29382 | 59886 | 90390, 120894, 151398, 181902, 212406 | 1770 | AHZ41785 | 30346 | 60850 | 91354, 121858, 152362, 182866, 213370 |
| 807 | AGX19099 | 29383 | 59887 | 90391, 120895, 151399, 181903, 212407 | 1771 | AHZ41796 | 30347 | 60851 | 91355, 121859, 152363, 182867, 213371 |
| 808 | AGX19110 | 29384 | 59888 | 90392, 120896, 151400, 181904, 212408 | 1772 | AHZ41807 | 30348 | 60852 | 91356, 121860, 152364, 182868, 213372 |
| 809 | AGX19121 | 29385 | 59889 | 90393, 120897, 151401, 181905, 212409 | 1773 | AHZ41818 | 30349 | 60853 | 91357, 121861, 152365, 182869, 213373 |
| 810 | AGX19132 | 29386 | 59890 | 90394, 120898, 151402, 181906, 212410 | 1774 | AHZ41829 | 30350 | 60854 | 91358, 121862, 152366, 182870, 213374 |
| 811 | AGX19143 | 29387 | 59891 | 90395, 120899, 151403, 181907, 212411 | 1775 | AHZ41840 | 30351 | 60855 | 91359, 121863, 152367, 182871, 213375 |
| 812 | AGX19154 | 29388 | 59892 | 90396, 120900, 151404, 181908, 212412 | 1776 | AHZ41851 | 30352 | 60856 | 91360, 121864, 152368, 182872, 213376 |
| 813 | AGX19165 | 29389 | 59893 | 90397, 120901, 151405, 181909, 212413 | 1777 | AHZ41862 | 30353 | 60857 | 91361, 121865, 152369, 182873, 213377 |
| 814 | AGX19176 | 29390 | 59894 | 90398, 120902, 151406, 181910, 212414 | 1778 | AHZ41873 | 30354 | 60858 | 91362, 121866, 152370, 182874, 213378 |
| 815 | AGX19187 | 29391 | 59895 | 90399, 120903, 151407, 181911, 212415 | 1779 | AIL94981 | 30355 | 60859 | 91363, 121867, 152371, 182875, 213379 |
| 816 | AGX19198 | 29392 | 59896 | 90400, 120904, 151408, 181912, 212416 | 1780 | AIL94992 | 30356 | 60860 | 91364, 121868, 152372, 182876, 213380 |
| 817 | AGX19209 | 29393 | 59897 | 90401, 120905, 151409, 181913, 212417 | 1781 | AIL95003 | 30357 | 60861 | 91365, 121869, 152373, 182877, 213381 |
| 818 | AGX19220 | 29394 | 59898 | 90402, 120906, 151410, 181914, 212418 | 1782 | AIL95014 | 30358 | 60862 | 91366, 121870, 152374, 182878, 213382 |
| 819 | AGX19231 | 29395 | 59899 | 90403, 120907, 151411, 181915, 212419 | 1783 | AIL95025 | 30359 | 60863 | 91367, 121871, 152375, 182879, 213383 |
| 820 | AGX19253 | 29396 | 59900 | 90404, 120908, 151412, 181916, 212420 | 1784 | AIL95036 | 30360 | 60864 | 91368, 121872, 152376, 182880, 213384 |
| 821 | AGX19264 | 29397 | 59901 | 90405, 120909, 151413, 181917, 212421 | 1785 | AIL95047 | 30361 | 60865 | 91369, 121873, 152377, 182881, 213385 |

FIG. 4 continued

| | | | | | | | | | |
|---|---|---|---|---|---|---|---|---|---|
| 822 | AGX19275 | 29398 | 59902 | 90406, 120910, 151414, 181918, 212422 | 1786 | AIL95058 | 30362 | 60866 | 91370, 121874, 152378, 182882, 213386 |
| 823 | AGX19286 | 29399 | 59903 | 90407, 120911, 151415, 181919, 212423 | 1787 | AIL95069 | 30363 | 60867 | 91371, 121875, 152379, 182883, 213387 |
| 824 | AGX19297 | 29400 | 59904 | 90408, 120912, 151416, 181920, 212424 | 1788 | AIL95080 | 30364 | 60868 | 91372, 121876, 152380, 182884, 213388 |
| 825 | AGX19308 | 29401 | 59905 | 90409, 120913, 151417, 181921, 212425 | 1789 | AIL95091 | 30365 | 60869 | 91373, 121877, 152381, 182885, 213389 |
| 826 | AGX19319 | 29402 | 59906 | 90410, 120914, 151418, 181922, 212426 | 1790 | AIL95102 | 30366 | 60870 | 91374, 121878, 152382, 182886, 213390 |
| 827 | AGX19330 | 29403 | 59907 | 90411, 120915, 151419, 181923, 212427 | 1791 | AIL95113 | 30367 | 60871 | 91375, 121879, 152383, 182887, 213391 |
| 828 | AGX19341 | 29404 | 59908 | 90412, 120916, 151420, 181924, 212428 | 1792 | AIL95124 | 30368 | 60872 | 91376, 121880, 152384, 182888, 213392 |
| 829 | AGX19352 | 29405 | 59909 | 90413, 120917, 151421, 181925, 212429 | 1793 | AKA54777 | 30369 | 60873 | 91377, 121881, 152385, 182889, 213393 |
| 830 | AGX19363 | 29406 | 59910 | 90414, 120918, 151422, 181926, 212430 | 1794 | AKA54781 | 30370 | 60874 | 91378, 121882, 152386, 182890, 213394 |
| 831 | AGX19374 | 29407 | 59911 | 90415, 120919, 151423, 181927, 212431 | 1795 | AKA54783 | 30371 | 60875 | 91379, 121883, 152387, 182891, 213395 |
| 832 | AGX19385 | 29408 | 59912 | 90416, 120920, 151424, 181928, 212432 | 1796 | AKA54785 | 30372 | 60876 | 91380, 121884, 152388, 182892, 213396 |
| 833 | AGX19396 | 29409 | 59913 | 90417, 120921, 151425, 181929, 212433 | 1797 | AKA54787 | 30373 | 60877 | 91381, 121885, 152389, 182893, 213397 |
| 834 | AGX19407 | 29410 | 59914 | 90418, 120922, 151426, 181930, 212434 | 1798 | AKA54789 | 30374 | 60878 | 91382, 121886, 152390, 182894, 213398 |
| 835 | AGX19418 | 29411 | 59915 | 90419, 120923, 151427, 181931, 212435 | 1799 | AKA54791 | 30375 | 60879 | 91383, 121887, 152391, 182895, 213399 |
| 836 | AGX19429 | 29412 | 59916 | 90420, 120924, 151428, 181932, 212436 | 1800 | AKA54793 | 30376 | 60880 | 91384, 121888, 152392, 182896, 213400 |
| 837 | AGX19451 | 29413 | 59917 | 90421, 120925, 151429, 181933, 212437 | 1801 | AKA54795 | 30377 | 60881 | 91385, 121889, 152393, 182897, 213401 |
| 838 | AGX19462 | 29414 | 59918 | 90422, 120926, 151430, 181934, 212438 | 1802 | AKA54797 | 30378 | 60882 | 91386, 121890, 152394, 182898, 213402 |
| 839 | AGX19473 | 29415 | 59919 | 90423, 120927, 151431, 181935, 212439 | 1803 | AKA54799 | 30379 | 60883 | 91387, 121891, 152395, 182899, 213403 |

FIG. 4 continued

| | | | | | | | | | |
|---|---|---|---|---|---|---|---|---|---|
| 840 | AGX19484 | 29416 | 59920 | 90424, 120928, 151432, 181936, 212440 | 1804 | AKA54801 | 30380 | 60884 | 91388, 121892, 152396, 182900, 213404 |
| 841 | AGX19495 | 29417 | 59921 | 90425, 120929, 151433, 181937, 212441 | 1805 | AKA54803 | 30381 | 60885 | 91389, 121893, 152397, 182901, 213405 |
| 842 | AGX19506 | 29418 | 59922 | 90426, 120930, 151434, 181938, 212442 | 1806 | AKA54805 | 30382 | 60886 | 91390, 121894, 152398, 182902, 213406 |
| 843 | AGX19517 | 29419 | 59923 | 90427, 120931, 151435, 181939, 212443 | 1807 | AKA54807 | 30383 | 60887 | 91391, 121895, 152399, 182903, 213407 |
| 844 | AGX19528 | 29420 | 59924 | 90428, 120932, 151436, 181940, 212444 | 1808 | AKA54809 | 30384 | 60888 | 91392, 121896, 152400, 182904, 213408 |
| 845 | AGX19539 | 29421 | 59925 | 90429, 120933, 151437, 181941, 212445 | 1809 | AKA54811 | 30385 | 60889 | 91393, 121897, 152401, 182905, 213409 |
| 846 | AGX19550 | 29422 | 59926 | 90430, 120934, 151438, 181942, 212446 | 1810 | AKA54813 | 30386 | 60890 | 91394, 121898, 152402, 182906, 213410 |
| 847 | AGX19561 | 29423 | 59927 | 90431, 120935, 151439, 181943, 212447 | 1811 | AKA54815 | 30387 | 60891 | 91395, 121899, 152403, 182907, 213411 |
| 848 | AGX19572 | 29424 | 59928 | 90432, 120936, 151440, 181944, 212448 | 1812 | AKA54817 | 30388 | 60892 | 91396, 121900, 152404, 182908, 213412 |
| 849 | AGX19583 | 29425 | 59929 | 90433, 120937, 151441, 181945, 212449 | 1813 | AKA54819 | 30389 | 60893 | 91397, 121901, 152405, 182909, 213413 |
| 850 | AGX19594 | 29426 | 59930 | 90434, 120938, 151442, 181946, 212450 | 1814 | AKA54821 | 30390 | 60894 | 91398, 121902, 152406, 182910, 213414 |
| 851 | AGX19605 | 29427 | 59931 | 90435, 120939, 151443, 181947, 212451 | 1815 | AKA54823 | 30391 | 60895 | 91399, 121903, 152407, 182911, 213415 |
| 852 | AGX19616 | 29428 | 59932 | 90436, 120940, 151444, 181948, 212452 | 1816 | AKA54825 | 30392 | 60896 | 91400, 121904, 152408, 182912, 213416 |
| 853 | AGX19627 | 29429 | 59933 | 90437, 120941, 151445, 181949, 212453 | 1817 | AKA54827 | 30393 | 60897 | 91401, 121905, 152409, 182913, 213417 |
| 854 | AGX19638 | 29430 | 59934 | 90438, 120942, 151446, 181950, 212454 | 1818 | AKA54829 | 30394 | 60898 | 91402, 121906, 152410, 182914, 213418 |
| 855 | AGX19649 | 29431 | 59935 | 90439, 120943, 151447, 181951, 212455 | 1819 | AKA54831 | 30395 | 60899 | 91403, 121907, 152411, 182915, 213419 |
| 856 | AGX19660 | 29432 | 59936 | 90440, 120944, 151448, 181952, 212456 | 1820 | AKA54833 | 30396 | 60900 | 91404, 121908, 152412, 182916, 213420 |
| 857 | AGX19671 | 29433 | 59937 | 90441, 120945, 151449, 181953, 212457 | 1821 | AKA54837 | 30397 | 60901 | 91405, 121909, 152413, 182917, 213421 |

FIG. 4 continued

| | | | | | | | | | |
|---|---|---|---|---|---|---|---|---|---|
| 858 | AGX19682 | 29434 | 59938 | 90442, 120946, 151450, 181954, 212458 | 1822 | AKA54839 | 30398 | 60902 | 91406, 121910, 152414, 182918, 213422 |
| 859 | AGX19704 | 29435 | 59939 | 90443, 120947, 151451, 181955, 212459 | 1823 | AKA54841 | 30399 | 60903 | 91407, 121911, 152415, 182919, 213423 |
| 860 | AGX19715 | 29436 | 59940 | 90444, 120948, 151452, 181956, 212460 | 1824 | AKA54843 | 30400 | 60904 | 91408, 121912, 152416, 182920, 213424 |
| 861 | AGX19726 | 29437 | 59941 | 90445, 120949, 151453, 181957, 212461 | 1825 | AKA54845 | 30401 | 60905 | 91409, 121913, 152417, 182921, 213425 |
| 862 | AGX19737 | 29438 | 59942 | 90446, 120950, 151454, 181958, 212462 | 1826 | AKA54847 | 30402 | 60906 | 91410, 121914, 152418, 182922, 213426 |
| 863 | AGX19748 | 29439 | 59943 | 90447, 120951, 151455, 181959, 212463 | 1827 | AKA54849 | 30403 | 60907 | 91411, 121915, 152419, 182923, 213427 |
| 864 | AGX19759 | 29440 | 59944 | 90448, 120952, 151456, 181960, 212464 | 1828 | AKA54851 | 30404 | 60908 | 91412, 121916, 152420, 182924, 213428 |
| 865 | AGX19770 | 29441 | 59945 | 90449, 120953, 151457, 181961, 212465 | 1829 | AKA54853 | 30405 | 60909 | 91413, 121917, 152421, 182925, 213429 |
| 866 | AGX19781 | 29442 | 59946 | 90450, 120954, 151458, 181962, 212466 | 1830 | AKA54855 | 30406 | 60910 | 91414, 121918, 152422, 182926, 213430 |
| 867 | AGX19792 | 29443 | 59947 | 90451, 120955, 151459, 181963, 212467 | 1831 | AKT07927 | 30407 | 60911 | 91415, 121919, 152423, 182927, 213431 |
| 868 | AGX19803 | 29444 | 59948 | 90452, 120956, 151460, 181964, 212468 | 1832 | AKT07931 | 30408 | 60912 | 91416, 121920, 152424, 182928, 213432 |
| 869 | AGX19814 | 29445 | 59949 | 90453, 120957, 151461, 181965, 212469 | 1833 | AKT07933 | 30409 | 60913 | 91417, 121921, 152425, 182929, 213433 |
| 870 | AGX19825 | 29446 | 59950 | 90454, 120958, 151462, 181966, 212470 | 1834 | AKT07935 | 30410 | 60914 | 91418, 121922, 152426, 182930, 213434 |
| 871 | AGX19836 | 29447 | 59951 | 90455, 120959, 151463, 181967, 212471 | 1835 | AKT07937 | 30411 | 60915 | 91419, 121923, 152427, 182931, 213435 |
| 872 | AGX19847 | 29448 | 59952 | 90456, 120960, 151464, 181968, 212472 | 1836 | AKT07939 | 30412 | 60916 | 91420, 121924, 152428, 182932, 213436 |
| 873 | AGX19858 | 29449 | 59953 | 90457, 120961, 151465, 181969, 212473 | 1837 | AKT07941 | 30413 | 60917 | 91421, 121925, 152429, 182933, 213437 |
| 874 | AGX19869 | 29450 | 59954 | 90458, 120962, 151466, 181970, 212474 | 1838 | AKT07945 | 30414 | 60918 | 91422, 121926, 152430, 182934, 213438 |
| 875 | AGX19880 | 29451 | 59955 | 90459, 120963, 151467, 181971, 212475 | 1839 | AKT07947 | 30415 | 60919 | 91423, 121927, 152431, 182935, 213439 |

FIG. 4 continued

| | | | | | | | | | |
|---|---|---|---|---|---|---|---|---|---|
| 876 | AGX19891 | 29452 | 59956 | 90460, 120964, 151468, 181972, 212476 | 1840 | AKU40585 | 30416 | 60920 | 91424, 121928, 152432, 182936, 213440 |
| 877 | AGX19902 | 29453 | 59957 | 90461, 120965, 151469, 181973, 212477 | 1841 | AKU40596 | 30417 | 60921 | 91425, 121929, 152433, 182937, 213441 |
| 878 | AGX19913 | 29454 | 59958 | 90462, 120966, 151470, 181974, 212478 | 1842 | AKU40607 | 30418 | 60922 | 91426, 121930, 152434, 182938, 213442 |
| 879 | AGX19924 | 29455 | 59959 | 90463, 120967, 151471, 181975, 212479 | 1843 | AKU40618 | 30419 | 60923 | 91427, 121931, 152435, 182939, 213443 |
| 880 | AGX19935 | 29456 | 59960 | 90464, 120968, 151472, 181976, 212480 | 1844 | AKU40640 | 30420 | 60924 | 91428, 121932, 152436, 182940, 213444 |
| 881 | AGX19946 | 29457 | 59961 | 90465, 120969, 151473, 181977, 212481 | 1845 | AKU40662 | 30421 | 60925 | 91429, 121933, 152437, 182941, 213445 |
| 882 | AGX19957 | 29458 | 59962 | 90466, 120970, 151474, 181978, 212482 | 1846 | AKU40673 | 30422 | 60926 | 91430, 121934, 152438, 182942, 213446 |
| 883 | AGX19968 | 29459 | 59963 | 90467, 120971, 151475, 181979, 212483 | 1847 | AKU40684 | 30423 | 60927 | 91431, 121935, 152439, 182943, 213447 |
| 884 | AGX19979 | 29460 | 59964 | 90468, 120972, 151476, 181980, 212484 | 1848 | AKU40695 | 30424 | 60928 | 91432, 121936, 152440, 182944, 213448 |
| 885 | AGX19990 | 29461 | 59965 | 90469, 120973, 151477, 181981, 212485 | 1849 | AKU40706 | 30425 | 60929 | 91433, 121937, 152441, 182945, 213449 |
| 886 | AGX20001 | 29462 | 59966 | 90470, 120974, 151478, 181982, 212486 | 1850 | AKU40717 | 30426 | 60930 | 91434, 121938, 152442, 182946, 213450 |
| 887 | AGX20012 | 29463 | 59967 | 90471, 120975, 151479, 181983, 212487 | 1851 | AKU40728 | 30427 | 60931 | 91435, 121939, 152443, 182947, 213451 |
| 888 | AGX20023 | 29464 | 59968 | 90472, 120976, 151480, 181984, 212488 | 1852 | AKU40739 | 30428 | 60932 | 91436, 121940, 152444, 182948, 213452 |
| 889 | AGX20034 | 29465 | 59969 | 90473, 120977, 151481, 181985, 212489 | 1853 | AKU40750 | 30429 | 60933 | 91437, 121941, 152445, 182949, 213453 |
| 890 | AGX20045 | 29466 | 59970 | 90474, 120978, 151482, 181986, 212490 | 1854 | AKU40761 | 30430 | 60934 | 91438, 121942, 152446, 182950, 213454 |
| 891 | AGX20056 | 29467 | 59971 | 90475, 120979, 151483, 181987, 212491 | 1855 | AKU40772 | 30431 | 60935 | 91439, 121943, 152447, 182951, 213455 |
| 892 | AGX20067 | 29468 | 59972 | 90476, 120980, 151484, 181988, 212492 | 1856 | AKU40783 | 30432 | 60936 | 91440, 121944, 152448, 182952, 213456 |
| 893 | AGX20078 | 29469 | 59973 | 90477, 120981, 151485, 181989, 212493 | 1857 | AKU40794 | 30433 | 60937 | 91441, 121945, 152449, 182953, 213457 |

FIG. 4 continued

| | | | | | | | | | |
|---|---|---|---|---|---|---|---|---|---|
| 894 | AGX20089 | 29470 | 59974 | 90478, 120982, 151486, 181990, 212494 | 1858 | AKU40805 | 30434 | 60938 | 91442, 121946, 152450, 182954, 213458 |
| 895 | AGX20100 | 29471 | 59975 | 90479, 120983, 151487, 181991, 212495 | 1859 | AKU40816 | 30435 | 60939 | 91443, 121947, 152451, 182955, 213459 |
| 896 | AGX20111 | 29472 | 59976 | 90480, 120984, 151488, 181992, 212496 | 1860 | AKU40827 | 30436 | 60940 | 91444, 121948, 152452, 182956, 213460 |
| 897 | AGX20122 | 29473 | 59977 | 90481, 120985, 151489, 181993, 212497 | 1861 | AKU40838 | 30437 | 60941 | 91445, 121949, 152453, 182957, 213461 |
| 898 | AGX20133 | 29474 | 59978 | 90482, 120986, 151490, 181994, 212498 | 1862 | AKU40849 | 30438 | 60942 | 91446, 121950, 152454, 182958, 213462 |
| 899 | AGX20144 | 29475 | 59979 | 90483, 120987, 151491, 181995, 212499 | 1863 | AKU40860 | 30439 | 60943 | 91447, 121951, 152455, 182959, 213463 |
| 900 | AGX20155 | 29476 | 59980 | 90484, 120988, 151492, 181996, 212500 | 1864 | AKU40871 | 30440 | 60944 | 91448, 121952, 152456, 182960, 213464 |
| 901 | AGX20166 | 29477 | 59981 | 90485, 120989, 151493, 181997, 212501 | 1865 | AKU40882 | 30441 | 60945 | 91449, 121953, 152457, 182961, 213465 |
| 902 | AGX20177 | 29478 | 59982 | 90486, 120990, 151494, 181998, 212502 | 1866 | AKU40893 | 30442 | 60946 | 91450, 121954, 152458, 182962, 213466 |
| 903 | AGX20188 | 29479 | 59983 | 90487, 120991, 151495, 181999, 212503 | 1867 | AKU40904 | 30443 | 60947 | 91451, 121955, 152459, 182963, 213467 |
| 904 | AGX20199 | 29480 | 59984 | 90488, 120992, 151496, 182000, 212504 | 1868 | AKU40915 | 30444 | 60948 | 91452, 121956, 152460, 182964, 213468 |
| 905 | AGX20210 | 29481 | 59985 | 90489, 120993, 151497, 182001, 212505 | 1869 | AKU40926 | 30445 | 60949 | 91453, 121957, 152461, 182965, 213469 |
| 906 | AGX20221 | 29482 | 59986 | 90490, 120994, 151498, 182002, 212506 | 1870 | AKU40937 | 30446 | 60950 | 91454, 121958, 152462, 182966, 213470 |
| 907 | AGX20232 | 29483 | 59987 | 90491, 120995, 151499, 182003, 212507 | 1871 | AKU40948 | 30447 | 60951 | 91455, 121959, 152463, 182967, 213471 |
| 908 | AGX20243 | 29484 | 59988 | 90492, 120996, 151500, 182004, 212508 | 1872 | AKU40959 | 30448 | 60952 | 91456, 121960, 152464, 182968, 213472 |
| 909 | AGX20254 | 29485 | 59989 | 90493, 120997, 151501, 182005, 212509 | 1873 | AKU40970 | 30449 | 60953 | 91457, 121961, 152465, 182969, 213473 |
| 910 | AGX20265 | 29486 | 59990 | 90494, 120998, 151502, 182006, 212510 | 1874 | AKU40981 | 30450 | 60954 | 91458, 121962, 152466, 182970, 213474 |
| 911 | AGX20276 | 29487 | 59991 | 90495, 120999, 151503, 182007, 212511 | 1875 | AKU40991 | 30451 | 60955 | 91459, 121963, 152467, 182971, 213475 |

FIG. 4 continued

| | | | | | | | | | |
|---|---|---|---|---|---|---|---|---|---|
| 912 | AGX20287 | 29488 | 59992 | 90496, 121000, 151504, 182008, 212512 | 1876 | AKU41002 | 30452 | 60956 | 91460, 121964, 152468, 182972, 213476 |
| 913 | AGX20298 | 29489 | 59993 | 90497, 121001, 151505, 182009, 212513 | 1877 | AKU41013 | 30453 | 60957 | 91461, 121965, 152469, 182973, 213477 |
| 914 | AGX20320 | 29490 | 59994 | 90498, 121002, 151506, 182010, 212514 | 1878 | AKU41024 | 30454 | 60958 | 91462, 121966, 152470, 182974, 213478 |
| 915 | AGX20331 | 29491 | 59995 | 90499, 121003, 151507, 182011, 212515 | 1879 | EPI173278 | 30455 | 60959 | 91463, 121967, 152471, 182975, 213479 |
| 916 | AGX20342 | 29492 | 59996 | 90500, 121004, 151508, 182012, 212516 | 1880 | EPI498049 | 30456 | 60960 | 91464, 121968, 152472, 182976, 213480 |
| 917 | AGX20353 | 29493 | 59997 | 90501, 121005, 151509, 182013, 212517 | 1881 | AFH57913 | 30457 | 60961 | 91465, 121969, 152473, 182977, 213481 |
| 918 | AGX20364 | 29494 | 59998 | 90502, 121006, 151510, 182014, 212518 | 1882 | EPI827074 | 30458 | 60962 | 91466, 121970, 152474, 182978, 213482 |
| 919 | AGX20375 | 29495 | 59999 | 90503, 121007, 151511, 182015, 212519 | 1883 | EPI244698 | 30459 | 60963 | 91467, 121971, 152475, 182979, 213483 |
| 920 | AGX20386 | 29496 | 60000 | 90504, 121008, 151512, 182016, 212520 | 1884 | EPI244701 | 30460 | 60964 | 91468, 121972, 152476, 182980, 213484 |
| 921 | AGX20397 | 29497 | 60001 | 90505, 121009, 151513, 182017, 212521 | 1885 | EPI540672 | 30461 | 60965 | 91469, 121973, 152477, 182981, 213485 |
| 922 | AGX20408 | 29498 | 60002 | 90506, 121010, 151514, 182018, 212522 | 1886 | EPI829465 | 30462 | 60966 | 91470, 121974, 152478, 182982, 213486 |
| 923 | AGX20419 | 29499 | 60003 | 90507, 121011, 151515, 182019, 212523 | 1887 | EPI684428 | 30463 | 60967 | 91471, 121975, 152479, 182983, 213487 |
| 924 | AGX20430 | 29500 | 60004 | 90508, 121012, 151516, 182020, 212524 | 1888 | AFH58451 | 30464 | 60968 | 91472, 121976, 152480, 182984, 213488 |
| 925 | AGX20441 | 29501 | 60005 | 90509, 121013, 151517, 182021, 212525 | 1889 | EPI173280 | 30465 | 60969 | 91473, 121977, 152481, 182985, 213489 |
| 926 | AGX20452 | 29502 | 60006 | 90510, 121014, 151518, 182022, 212526 | 1890 | EPI186302 | 30466 | 60970 | 91474, 121978, 152482, 182986, 213490 |
| 927 | AGX20463 | 29503 | 60007 | 90511, 121015, 151519, 182023, 212527 | 1891 | EPI636339 | 30467 | 60971 | 91475, 121979, 152483, 182987, 213491 |
| 928 | AGX20474 | 29504 | 60008 | 90512, 121016, 151520, 182024, 212528 | 1892 | EPI645996 | 30468 | 60972 | 91476, 121980, 152484, 182988, 213492 |
| 929 | AGX20485 | 29505 | 60009 | 90513, 121017, 151521, 182025, 212529 | 1893 | EPI539770 | 30469 | 60973 | 91477, 121981, 152485, 182989, 213493 |

FIG. 4 continued

| | | | | | | | | | |
|---|---|---|---|---|---|---|---|---|---|
| 930 | AGX20496 | 29506 | 60010 | 90514, 121018, 151522, 182026, 212530 | 1894 | EPI551248 | 30470 | 60974 | 91478, 121982, 152486, 182990, 213494 |
| 931 | AGX20507 | 29507 | 60011 | 90515, 121019, 151523, 182027, 212531 | 1895 | EPI544258 | 30471 | 60975 | 91479, 121983, 152487, 182991, 213495 |
| 932 | AGX20518 | 29508 | 60012 | 90516, 121020, 151524, 182028, 212532 | 1896 | EPI592698 | 30472 | 60976 | 91480, 121984, 152488, 182992, 213496 |
| 933 | AGX20529 | 29509 | 60013 | 90517, 121021, 151525, 182029, 212533 | 1897 | EPI592706 | 30473 | 60977 | 91481, 121985, 152489, 182993, 213497 |
| 934 | AGX20540 | 29510 | 60014 | 90518, 121022, 151526, 182030, 212534 | 1898 | EPI693093 | 30474 | 60978 | 91482, 121986, 152490, 182994, 213498 |
| 935 | AGX20551 | 29511 | 60015 | 90519, 121023, 151527, 182031, 212535 | 1899 | EPI678795 | 30475 | 60979 | 91483, 121987, 152491, 182995, 213499 |
| 936 | AGX20562 | 29512 | 60016 | 90520, 121024, 151528, 182032, 212536 | 1900 | EPI721063 | 30476 | 60980 | 91484, 121988, 152492, 182996, 213500 |
| 937 | AGX20573 | 29513 | 60017 | 90521, 121025, 151529, 182033, 212537 | 1901 | EPI328903 | 30477 | 60981 | 91485, 121989, 152493, 182997, 213501 |
| 938 | AGX20584 | 29514 | 60018 | 90522, 121026, 151530, 182034, 212538 | 1902 | EPI543192 | 30478 | 60982 | 91486, 121990, 152494, 182998, 213502 |
| 939 | AGX20595 | 29515 | 60019 | 90523, 121027, 151531, 182035, 212539 | 1903 | EPI500360 | 30479 | 60983 | 91487, 121991, 152495, 182999, 213503 |
| 940 | AGX20606 | 29516 | 60020 | 90524, 121028, 151532, 182036, 212540 | 1904 | EPI543186 | 30480 | 60984 | 91488, 121992, 152496, 183000, 213504 |
| 941 | AGX20617 | 29517 | 60021 | 90525, 121029, 151533, 182037, 212541 | 1905 | EPI536448 | 30481 | 60985 | 91489, 121993, 152497, 183001, 213505 |
| 942 | AGX20628 | 29518 | 60022 | 90526, 121030, 151534, 182038, 212542 | 1906 | NP_056663 | 30482 | 60986 | 91490, 121994, 152498, 183002, 213506 |
| 943 | AGX20639 | 29519 | 60023 | 90527, 121031, 151535, 182039, 212543 | 1907 | ABG85180 | 30483 | 60987 | 91491, 121995, 152499, 183003, 213507 |
| 944 | AGX20650 | 29520 | 60024 | 90528, 121032, 151536, 182040, 212544 | 1908 | EPI376345 | 30484 | 60988 | 91492, 121996, 152500, 183004, 213508 |
| 945 | AGX20661 | 29521 | 60025 | 90529, 121033, 151537, 182041, 212545 | 1909 | EPI368424 | 30485 | 60989 | 91493, 121997, 152501, 183005, 213509 |
| 946 | AGX20683 | 29522 | 60026 | 90530, 121034, 151538, 182042, 212546 | 1910 | EPI331150 | 30486 | 60990 | 91494, 121998, 152502, 183006, 213510 |
| 947 | AGX20694 | 29523 | 60027 | 90531, 121035, 151539, 182043, 212547 | 1911 | EPI358089 | 30487 | 60991 | 91495, 121999, 152503, 183007, 213511 |

FIG. 4 continued

| | | | | | | | | | |
|---|---|---|---|---|---|---|---|---|---|
| 948 | AGX20705 | 29524 | 60028 | 90532, 121036, 151540, 182044, 212548 | 1912 | ABL76698 | 30488 | 60992 | 91496, 122000, 152504, 183008, 213512 |
| 949 | AGX20716 | 29525 | 60029 | 90533, 121037, 151541, 182045, 212549 | 1913 | AAD42328 | 30489 | 60993 | 91497, 122001, 152505, 183009, 213513 |
| 950 | AGX20727 | 29526 | 60030 | 90534, 121038, 151542, 182046, 212550 | 1914 | EPI541349 | 30490 | 60994 | 91498, 122002, 152506, 183010, 213514 |
| 951 | AGX20738 | 29527 | 60031 | 90535, 121039, 151543, 182047, 212551 | 1915 | EPI541759 | 30491 | 60995 | 91499, 122003, 152507, 183011, 213515 |
| 952 | AGX20749 | 29528 | 60032 | 90536, 121040, 151544, 182048, 212552 | 1916 | EPI826201 | 30492 | 60996 | 91500, 122004, 152508, 183012, 213516 |
| 953 | AGX20760 | 29529 | 60033 | 90537, 121041, 151545, 182049, 212553 | 1917 | EPI477398 | 30493 | 60997 | 91501, 122005, 152509, 183013, 213517 |
| 954 | AGX20771 | 29530 | 60034 | 90538, 121042, 151546, 182050, 212554 | 1918 | EPI492570 | 30494 | 60998 | 91502, 122006, 152510, 183014, 213518 |
| 955 | AGX20782 | 29531 | 60035 | 90539, 121043, 151547, 182051, 212555 | 1919 | EPI498339 | 30495 | 60999 | 91503, 122007, 152511, 183015, 213519 |
| 956 | AGX20793 | 29532 | 60036 | 90540, 121044, 151548, 182052, 212556 | 1920 | EPI538118 | 30496 | 61000 | 91504, 122008, 152512, 183016, 213520 |
| 957 | AGX20804 | 29533 | 60037 | 90541, 121045, 151549, 182053, 212557 | 1921 | EPI538124 | 30497 | 61001 | 91505, 122009, 152513, 183017, 213521 |
| 958 | AGX20815 | 29534 | 60038 | 90542, 121046, 151550, 182054, 212558 | 1922 | EPI556421 | 30498 | 61002 | 91506, 122010, 152514, 183018, 213522 |
| 959 | AGX20826 | 29535 | 60039 | 90543, 121047, 151551, 182055, 212559 | 1923 | EPI614609 | 30499 | 61003 | 91507, 122011, 152515, 183019, 213523 |
| 960 | AGX20837 | 29536 | 60040 | 90544, 121048, 151552, 182056, 212560 | 1924 | BAB32609 | 30500 | 61004 | 91508, 122012, 152516, 183020, 213524 |
| 961 | AGX20848 | 29537 | 60041 | 90545, 121049, 151553, 182057, 212561 | 1925 | EPI271544 | 30501 | 61005 | 91509, 122013, 152517, 183021, 213525 |
| 962 | AGX20870 | 29538 | 60042 | 90546, 121050, 151554, 182058, 212562 | 1926 | AFH57957 | 30502 | 61006 | 91510, 122014, 152518, 183022, 213526 |
| 963 | AGX20881 | 29539 | 60043 | 90547, 121051, 151555, 182059, 212563 | 1927 | EPI294881 | 30503 | 61007 | 91511, 122015, 152519, 183023, 213527 |
| 964 | AGX20892 | 29540 | 60044 | 90548, 121052, 151556, 182060, 212564 | 1928 | ABL77259 | 30504 | 61008 | 91512, 122016, 152520, 183024, 213528 |

FIG. 4 continued

A) H1N1pdm09 HA /California/7/2009 – total IgG (week 4)

B) H1N1 HA A/Brisbane/59/2007 – total IgG (week 4)

C) H3N2 HA A/Uruguay/716/2007 – total IgG (week 4)

INFLUENZA mRNA VACCINES

This application is a national phase application under 35 U.S.C. § 371 of International Application No. PCT/EP2017/060663, filed May 4, 2017, which claims benefit of International Application No. PCT/EP2016/060112, filed May 4, 2010 and International Application No. PCT/EP2016/0758B2, filed Oct. 26, 2016, the entire contents of each of which are hereby incorporated by reference.

INTRODUCTION

The present invention relates to mRNA sequences usable as mRNA-based vaccines against infections with influenza viruses. Additionally, the present invention relates to a composition comprising the mRNA sequences and the use of the mRNA sequences or the composition for the preparation of a pharmaceutical composition, especially a vaccine, e.g. for use in the prophylaxis or treatment of influenza virus infections. The present invention further describes a method of treatment or prophylaxis of infections with influenza virus using the mRNA sequences.

Influenza viruses are enveloped RNA viruses, belonging to the family Orthomyxoviridae. Three genera of this family, influenza virus A, B and C, cause influenza in humans. They differ with respect to host range, variability of the surface glycoproteins, genome organization and morphology. Influenza virus A and B are further classified, based on the viral surface proteins hemagglutinin (HA) and neuraminidase (NA). Currently, there are 18 described HA (H1-H18) and I1 described NA (N1-N11) subtypes of influenza A viruses that potentially form 144 HA and NA combinations (Viruses 2018, 8(4), 80; doi:18.3380/v8040096)). The influenza A virus particle or virion is 80-120 nm in diameter and usually roughly spherical, although filamentous forms can occur. Unusual for a virus, the influenza genome is not a continuous molecule; but consists of eight pieces of segmented negative-sense RNA (13.5 kilo bases in total), which encode I1 proteins (HA, NA, NP, M1, M2, NSI, NEP, PA, PBL, PBI-F2, PB2). The best-characterized of these viral proteins are hemagglutinin and neuraminidase, two large glycoproteins found on the outside of the viral particles. Neuraminidase is an enzyme involved in the release of progeny virus from infected cells, by cleaving sugars that bind the mature viral particles. By contrast, hemagglutinin is a lectin that mediates binding of the virus to target cells and entry of the viral genome into the target cell.

Usually, two to three different strains of influenza circulate concurrently during an influenza season. Typical influenza epidemics cause increases in incidence of pneumonia and lower respiratory disease by increased rates of hospitalization or mortality. The elderly or those with underlying chronic diseases are most likely to experience such complications, but young infants also may suffer severe disease. It is estimated that more than one billion cases of influenza occur globally every year, which results in 3 to 5 million cases of severe illness and 300,000 to 500,000 deaths (Mortality associated with influenza and respiratory syncytial virus in the United States. Thompson W W, Shay O K, Weintraub E. Brammer L, Cox N, Anderson L J Fukuda K JAMA, 2003 Jan. 8; 289(2):179-86). In addition, there are large losses both in productivity and quality of life for people who overcome mild cases of the disease in just a few days or weeks.

Current approaches to influenza vaccination focus either on seasonal or pandemic strains. The seasonal influenza (flu) vaccine protects against the influenza viruses that research indicates will be most common during the upcoming season. Traditional flu vaccines (called "trivalent" vaccines) are made to protect against three influenza viruses; an influenza A (H1N1) virus, an influenza A (H3N2) virus, and an influenza B virus. There are also flu vaccines made to protect against four flu viruses (called "quadrivalent" or "tetravalent" vaccines). These vaccines protect against the same viruses as the trivalent vaccine and an additional B virus. For 2015-16, U.S.-licensed trivalent influenza vaccines contain hemagglutinin (HA) derived from an A/California/7/2009 (H1N1)-like virus, an A/Switzerland/9715293/2013 (H3N2)-like virus, and a B/Phuket/3073/2013-like (Yamagata lineage) virus. Quadrivalent influenza vaccines contain these vaccine viruses, and a B/Brisbane/60/2008-like (Victoria lineage) virus.

The composition of trivalent virus vaccines for use in the 2016-2017 Northern Hemisphere influenza season recommended by the World Health Organization on Feb. 25, 2016 is:

an A/California/7/2009 (H1N1)pdm09-like virus an A/Hong Kong/4801/2014 (H3N2)-like virus a B/Brisbane/60/2008-like virus The WHO recommends that quadrivalent vaccines containing two influenza B viruses contain the above three viruses and a B/Phuket/3073/2013-like virus.

The reason that the seasonal influenza vaccine must be updated every year is the large variability of the virus. In the HA molecule this variation is particularly manifested in the head domain where antigenic drift has resulted in a large number of different variants. Since this is also the area that is immunodominant, most neutralizing antibodies are directed against this domain (Tuberc Respir Dis (Seoul). 2016 April; 79(2):70-73. The 2002 H1N1 Pandemic influenza in Korea, Jae Yeol Kim, M. D.).

Egg-Based Flu Vaccines: The most common way that flu vaccines are made is using an egg-based manufacturing process that has been in existence for more than 70 years. Egg-based vaccine manufacturing is used to make both inactivated (killed) virus-based vaccine and live attenuated (weakened) virus-based vaccine.

The egg-based production process begins with CDC or another influenza Collaborating Center providing private sector manufacturers with vaccine viruses grown in eggs per current FDA regulatory requirements. These vaccine viruses are then injected into fertilized hen's eggs and incubated for several days to allow the viruses to replicate. The virus-containing fluid is harvested from the eggs. For flu shots, the influenza viruses for the vaccine are then inactivated (killed), and virus antigen is purified. The manufacturing process continues with purification and testing. For the attenuated nasal spray vaccine, the viruses are weakened rather than killed and go through a slightly different production process.

This production method requires large numbers of chicken eggs to produce vaccine and usually takes a long period of time to produce vaccine. Furthermore allergenic reactions against these vaccines are a common side-effect.

Cell-Based Flu Vaccines: There also is a cell-based production process for flu vaccines, which was approved by the FDA in 2012. This production process also begins with egg-grown vaccine viruses per FDA regulations. Manufacturers infect cultured mammalian cells with vaccine viruses (instead of incubating them in eggs) and leave them to replicate for a few days. Then the virus-containing fluid is collected from the cells and the virus antigen is purified. The manufacturing process continues with purification and testing.

Right now, there is just one FDA-approved cell-based flu vaccine in the United States. This method takes slightly less time to manufacture vaccine than egg-based technology.

Recombinant Flu Vaccines: There is a third production technology for flu vaccines that was approved for use in the U.S. market in 2013 and that involves using recombinant technology. This production method does not require an egg-grown vaccine virus and does not use chicken eggs at all in the production process. Instead, manufacturers isolate a certain protein from a naturally occurring ("wild type") recommended vaccine virus (the HA protein, which induces an immune response in people). These proteins are then combined with portions of another virus that grows well in insect cells. This "recombinant" vaccine virus is then mixed with insect cells and allowed to replicate. The flu HA protein is then harvested from these cells and purified.

Hemagglutinin (HA) is one of the major envelop glycoproteins of influenza A and B viruses. The rapid evolution of the hemagglutinin (HA) protein of the influenza virus results in the constant emergence of new strains, rendering the adaptive immune response of the host only partially protective to new infections. The biggest challenge for therapy and prophylaxis against influenza and other infections using traditional vaccines is the limitation of vaccines in breadth, providing protection only against closely related subtypes. Therefore there is a need for an influenza vaccine wherein many different influenza virus strains can be addressed. In addition, today's length of the production process inhibits any fast reaction to develop and produce an adapted vaccine in a pandemic situation.

In summary there is still a need for an effective, safe and flexible influenza vaccine. The vaccine should be deliverable as soon as possible after the occurrence of a new influenza infection. Therefore a very quick production should be possible. Furthermore it is very important that different antigens (e.g. of different influenza strains) can be combined in one vaccine to ensure or increase the effectiveness of the influenza vaccine. Furthermore there is an urgent need for a temperature stable influenza vaccine which is not dependent on cooling (cold chain) and can be stored for a long time without high costs for storage.

Given the unpredictable occurrence of influenza virus strains, neither the timing nor the severity of the next pandemic can be predicted with any certainty. It is an object of the invention to provide improved ways of preparing influenza vaccines that can raise immunity against both seasonal and pandemic influenza virus strains. It is particular an object of the present invention to provide quickly influenza vaccines against seasonal influenza virus strains but particularly for pandemic influenza virus strains. Furthermore it is an object of the present invention to provide more efficient and safer influenza vaccines as the current influenza vaccines on the market.

Therefore, it is the object of the underlying invention to provide mRNA sequences coding for antigenic peptides or proteins derived from a protein of an influenza virus or a fragment or variant thereof for the use as a vaccine for prophylaxis or treatment of influenza virus infections.

Particularly it is an object of the invention to provide a vaccine against seasonal occurring influenza viruses (called herein "vaccine for seasonal influenza/flu" or "seasonal influenza/flu vaccine") and to provide a vaccine against pandemic occurring influenza viruses (called herein "vaccine for pandemic influenza/flu" or pandemic influenza/flu vaccine"). Furthermore, it is the object of the present invention to provide an effective influenza vaccine which can be stored without cold chain and which enables rapid and scalable vaccine production.

These objects are solved by the subject matter of the attached claims. Particularly, the objects underlying the present invention are solved according to a first aspect by an inventive mRNA sequence comprising a coding region, encoding at least one antigenic peptide or protein derived from a protein of an influenza virus or a fragment or variant thereof.

DEFINITIONS

For the sake of clarity and readability, the following scientific background information and definitions are provided. Any technical features disclosed thereby can be part of each and every embodiment of the invention. Additional definitions and explanations can be provided in the context of this disclosure.

Influenza pandemic or pandemic flu: An influenza pandemic can occur when a non-human (novel) influenza virus gains the ability for efficient and sustained human-to-human transmission and then spreads globally. Influenza viruses that have the potential to cause a pandemic are referred to as "influenza viruses with pandemic potential" or "pandemic influenza virus". Examples of influenza viruses with pandemic potential include avian influenza A (H5N1) and avian influenza A (H7N9), which are two different "bird flu" viruses. These are non-human viruses (i.e., they are novel among humans and circulate in birds in parts of the world) so there is little to no immunity against these viruses among people. Human infections with these viruses have occurred rarely, but if either of these viruses was to change in such a way that it was able to infect humans easily and spread easily from person to person, an influenza pandemic could result.

Vaccine for pandemic influenza/flu or pandemic influenza/flu vaccine: A vaccine directed against a pandemic influenza virus is called herein as a vaccine for pandemic influenza/flu or pandemic influenza/flu vaccine.

Flu/influenza season: Flu season is an annually recurring time period characterized by the prevalence of outbreaks of influenza (flu). The season occurs during the cold half of the year in each hemisphere. Influenza activity can sometimes be predicted and even tracked geographically. While the beginning of major flu activity in each season varies by location, in any specific location these minor epidemics usually take about 3 weeks to peak and another 3 weeks to significantly diminish. Flu vaccinations have been used to diminish the effects of the flu season; pneumonia vaccinations additionally diminishes the effects and complications of flu season. Since the Northern and Southern Hemisphere have winter at different times of the year, there are actually two flu seasons each year.

Vaccine for seasonal influenza/flu or seasonal influenza/flu vaccine: A vaccine directed against the seasonal occurring influenza viruses in a flu season is termed herein "vaccine for seasonal influenza/flu or seasonal influenza/flu vaccine".

Immune system: The immune system may protect organisms from infection. If a pathogen breaks through a physical barrier of an organism and enters this organism, the innate immune system provides an immediate, but non-specific response. If pathogens evade this innate response, vertebrates possess a second layer of protection, the adaptive immune system. Here, the immune system adapts its response during an infection to improve its recognition of the pathogen. This improved response is then retained after the pathogen has been eliminated, in the form of an immunological memory, and allows the adaptive immune system to mount faster and stronger attacks each time this pathogen is encountered. According to this, the immune system comprises the innate and the adaptive immune system. Each of these two parts contains so called humoral and cellular components.

Immune response: An immune response may typically either be a specific reaction of the adaptive immune system to a particular antigen (so called specific or adaptive immune response) or an unspecific reaction of the innate immune system (so called unspecific or innate immune response). The invention relates to the core to specific reactions (adaptive immune responses) of the adaptive immune system. Particularly, it relates to adaptive immune responses to infections by viruses like e.g. Influenza viruses. However, this specific response can be supported by an additional unspecific reaction (innate immune response). Therefore, the invention also relates to a compound for simultaneous stimulation of the innate and the adaptive immune system to evoke an efficient adaptive immune response.

Adaptive immune system: The adaptive immune system is composed of highly specialized, systemic cells and processes that eliminate or prevent pathogenic growth. The adaptive immune response provides the vertebrate immune system with the ability to recognize and remember specific pathogens (to generate immunity), and to mount stronger attacks each time the pathogen is encountered. The system is highly adaptable because of somatic hypermutation (a process of increased frequency of somatic mutations), and V(D)J recombination (an irreversible genetic recombination of antigen receptor gene segments). This mechanism allows a small number of genes to generate a vast number of different antigen receptors, which are then uniquely expressed on each individual lymphocyte. Because the gene rearrangement leads to an irreversible change in the DNA of each cell, all of the progeny (offspring) of that cell will then inherit genes encoding the same receptor specificity, including the Memory B cells and Memory T cells that are the keys to long-lived specific immunity. Immune network theory is a theory of how the adaptive immune system works, that is based on interactions between the variable regions of the receptors of T cells, B cells and of molecules made by T cells and B cells that have variable regions.

Adaptive immune response: The adaptive immune response is typically understood to be antigen-specific. Antigen specificity allows for the generation of responses that are tailored to specific antigens, pathogens or pathogen-infected cells. The ability to mount these tailored responses is maintained in the body by “memory cells”. Should a pathogen infect the body more than once, these specific memory cells are used to quickly eliminate it. In this context, the first step of an adaptive immune response is the activation of naïve antigen-specific T cells or different immune cells able to induce an antigen-specific immune response by antigen-presenting cells. This occurs in the lymphoid tissues and organs through which naïve T cells are constantly passing. Cell types that can serve as antigen-presenting cells are inter alia dendritic cells, macrophages, and B cells. Each of these cells has a distinct function in eliciting immune responses. Dendritic cells take up antigens by phagocytosis and macropinocytosis and are stimulated by contact with e.g. a foreign antigen to migrate to the local lymphoid tissue, where they differentiate into mature dendritic cells. Macrophages ingest particulate antigens such as bacteria and are induced by infectious agents or other appropriate stimuli to express MHC molecules. The unique ability of B cells to bind and internalize soluble protein antigens via their receptors may also be important to induce T cells. Presenting the antigen on MHC molecules leads to activation of T cells which induces their proliferation and differentiation into armed effector T cells. The most important function of effector T cells is the killing of infected cells by CDB+ cytotoxic T cells and the activation of macrophages by Th1 cells which together make up cell-mediated immunity, and the activation of B cells by both Th2 and Th1 cells to produce different classes of antibody, thus driving the humoral immune response. T cells recognize an antigen by their T cell receptors which do not recognize and bind antigen directly, but instead recognize short peptide fragments e.g. of pathogen-derived protein antigens, which are bound to MHC molecules on the surfaces of other cells.

Cellular immunity/cellular immune response: Cellular immunity relates typically to the activation of macrophages, natural killer cells (NK), antigen-specific cytotoxic T-lymphocytes, and the release of various cytokines in response to an antigen. In a more general way, cellular immunity is not related to antibodies but to the activation of cells of the immune system. A cellular immune response is characterized e.g. by activating antigen-specific cytotoxic T-lymphocytes that are able to induce apoptosis in body cells displaying epitopes of an antigen on their surface, such as virus-infected cells, cells with intracellular bacteria, and cancer cells displaying tumor antigens; activating macrophages and natural killer cells, enabling them to destroy pathogens; and stimulating cells to secrete a variety of cytokines that influence the function of other cells involved in adaptive immune responses and innate immune responses.

Humoral immunity/humoral immune response: Humoral immunity refers typically to antibody production and the accessory processes that may accompany it. A humoral immune response may be typically characterized, e.g., by Th2 activation and cytokine production, germinal center formation and isotype switching, affinity maturation and memory cell generation. Humoral immunity also typically may refer to the effecter functions of antibodies, which include pathogen and toxin neutralization, classical complement activation, and opsonin promotion of phagocytosis and pathogen elimination.

Innate immune system: The innate immune system, also known as non-specific immune system, comprises the cells and mechanisms that defend the host from infection by other organisms in a non-specific manner. This means that the cells of the innate system recognize and respond to pathogens in a generic way, but unlike the adaptive immune system, it does not confer long-lasting or protective immunity to the host. The innate immune system may be e.g. activated by ligands of pathogen-associated molecular patterns (PAMP) receptors, e.g. Toll-like receptors (TLRs) or other auxiliary substances such as lipopolysaccharides, TNF-alpha, CD40 ligand, or cytokines, monokines, lymphokines, interleukins or chemokines, IL-1, IL-2, IL-3, IL-4, IL-5, IL-6, IL-7, IL-8-9, IL-10, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IFN-alpha, IFN-beta, IFN-gamma, GM-CSF, G-CSF, M-CSF, LT-beta, TNF-alpha, growth factors, and hGH, a ligand of human Toll-like receptor TLR1, TLR2, TLR3, TLR4, TLR5, TLR6, TLR7, TLR8, TLR9, TLR10, a ligand of murine Toll-like receptor TLR1, TLR2, TLR3, TLR4, TLR5, TLR6, TLR7, TLR8, TLR9, TLR10, TLR11, TLR12 or TLR13, a ligand of a NOD-like receptor, a ligand of a RIG-I like receptor, an immunostimulatory nucleic acid, an immunostimulatory RNA (isRNA), a CpG-DNA, an antibacterial agent, or an anti-viral agent. Typically a response of the innate immune system includes recruiting immune cells to sites of infection, through the production of chemical factors, including specialized chemical mediators, called cytokines; activation of the complement cascade; identification and removal of foreign substances present in organs, tissues, the blood and lymph, by specialized white blood calls; activation of the adaptive immune system through a process known as antigen presentation; and/or acting as a physical and chemical barrier to infectious agents.

Adjuvant/adjuvant component: An adjuvant or an adjuvant component in the broadest sense is typically a (e.g. pharmacological or immunological) agent or composition that may modify, e.g. enhance, the efficacy of other agents, such as a drug or vaccine. Conventionally the term refers in the context of the invention to a compound or composition that serves as a carrier or auxiliary substance for immunogens and/or other pharmaceutically active compounds. It is to be interpreted in a broad sense and refers to a broad spectrum of substances that are able to increase the immunogenicity of antigens incorporated into or co-administered with an adjuvant in question. In the context of the present invention an adjuvant will preferably enhance the specific immunogenic effect of the active agents of the present invention. Typically, "adjuvant" or "adjuvant component" has the same meaning and can be used mutually. Adjuvants may be divided, e.g., into immuno potentiators, antigenic delivery systems or even combinations thereof.

The term "adjuvant" is typically understood not to comprise agents which confer immunity by themselves. An adjuvant assists the immune system to unspecifically enhance the antigen-specific immune response by e.g. promoting presentation of an antigen to the immune system or induction of an unspecific innate immune response. Furthermore, an adjuvant may preferably e.g. modulate the antigen-specific immune response by e.g. shifting the dominating Th2-based antigen specific response to a more Th1-based antigen specific response or vice versa. Accordingly, an adjuvant may favourably modulate cytokine expression/secretion, antigen presentation, type of immune response etc.

Immunostimulatory RNA: An immunostimulatory RNA (isRNA) in the context of the invention may typically be an RNA that is able to induce an innate immune response itself. It usually does not have an open reading frame and thus does not provide a peptide-antigen or immunogen but elicits an innate immune response e.g. by binding to a specific kind of Toll-like-receptor (TR) or other suitable receptors. However, of course also mRNAs having an open reading frame and coding for a peptide/protein (e.g. an antigenic function) may induce an innate immune response.

Antigen: In the context of the present invention "antigen" refers typically to a substance which may be recognized by the immune system, preferably by the adaptive immune system, and is capable of triggering an antigen-specific immune response, e.g. by formation of antibodies and/or antigen-specific T cells as part of an adaptive immune response. Typically, an antigen may be or may comprise a peptide or protein which may be presented by the MHC to T-cells. In the sense of the present invention an antigen may be the product of translation of a provided nucleic acid molecule, preferably an mRNA as defined herein. In this context, also fragments, variants and derivatives of peptides and proteins comprising at least one epitope are understood as antigen.

Epitope (also called "antigen determinant"): T cell epitopes or parts of the proteins in the context of the present invention may comprise fragments preferably having a length of about 6 to about 20 or even more amino acids, e.g. fragments as processed and presented by MHC class I molecules, preferably having a length of about 8 to about 10 amino acids, e.g. 8, 9, or 10, (or even 11, or 12 amino acids), or fragments as processed and presented by MHC class II molecules, preferably having a length of about 13 or more amino acids, e.g. 13, 14, 15, 16, 17, 18, 19, 20 or even more amino acids, wherein these fragments may be selected from any part of the amino acid sequence. These fragments are typically recognized by T cells in form of a complex consisting of the peptide fragment and an MHC molecule. B call epitopes are typically fragments located on the outer surface of (native) protein or peptide antigens as defined herein, preferably having 5 to 15 amino acids, more preferably having 5 to 12 amino acids, even more preferably having B to B amino acids, which may be recognized by antibodies, i.e. in their native form. Such epitopes of proteins or peptides may furthermore be selected from any of the herein mentioned variants of such proteins or peptides. In this context antigenic determinants can be conformational or discontinuous epitopes which are composed of segments of the proteins or peptides as defined herein that are discontinuous in the amino acid sequence of the proteins or peptides as defined herein but are brought together in the three-dimensional structure or continuous or linear epitopes which are composed of a single polypeptide chain.

Vaccine: A vaccine is typically understood to be a prophylactic or therapeutic material providing at least one antigen or antigenic function. The antigen or antigenic function may stimulate the body's adaptive immune system to provide an adaptive immune-response.

Antigen-providing mRNA: An antigen-providing mRNA in the context of the invention may typically be an mRNA, having at least one open reading frame that can be translated by a cell or an organism provided with that mRNA. The product of this translation is a peptide or protein that may act as an antigen, preferably as an immunogen. The product may also be a fusion protein composed of mare than one immunogen, e.g. a fusion protein that consist of two or more epitopes, peptides or proteins derived from the same or different virus-proteins, wherein the epitopes, peptides or proteins may be linked by linker sequences.

Antigenic peptide or protein: An antigenic peptide or protein is a peptide or protein derived from a protein which may stimulate the body's adaptive immune system to provide an adaptive immune response. Therefore an antigenic peptide or protein comprises at least one epitope of the protein it is derived from.

Artificial mRNA (sequence): An artificial mRNA (sequence) may typically be understood to be an mRNA molecule that does not occur naturally. In other words, an artificial mRNA molecule may be understood as a non-natural mRNA molecule. Such mRNA molecule may be non-natural due to its individual sequence (which does not occur naturally) and/or due to other modifications, e.g. structural modifications of nucleotides which do not occur naturally. Typically, artificial mRNA molecules may be designed and/or generated by genetic engineering methods to correspond to a desired artificial sequence of nucleotides (heterologous sequence). In this context an artificial sequence is usually a sequence that may not occur naturally, i.e. it differs from the wild type sequence by at least one nucleotide. The term "wild type" may be understood as a sequence occurring in nature. Further, the term "artificial nucleic acid molecule" is not restricted to mean "one single molecule" but is, typically, understood to comprise an ensemble of identical molecules. Accordingly, it may relate to a plurality of identical molecules contained in an aliquot.

Bi-/multicistronic mRNA: mRNA, that typically may have two (bicistronic) or more (multicistronic) open reading frames (ORF) (coding regions or coding sequences). An open reading frame in this context is a sequence of several nucleotide triplets (codons) that can be translated into a peptide or protein. Translation of such an mRNA yields two (bicistronic) or more (multicistronic) distinct translation products (provided the ORFs are not identical). For expression in eukaryotes such mRNAs may for example comprise an internal ribosomal entry site (IRES) sequence.

5'-cap structure, 5' cap: A 5'-cap is typically a modified nucleotide (cap analogue), particularly a guanine nucleotide, added to the 5' end of an mRNA molecule. Preferably, the 5'-cap is added using a 5'-5'-triphosphate linkage (also named m7GpppN). Further examples of 5'-cap structures include glyceryl, inverted deoxy abasic residue (moiety), 4,5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, three-pentofuranosyl nucleotide, acyclic 3',4'-seco nucleotide, acyclic 34-dihydroxybutyl nucleotide, acyclic 3.5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety. These modified 5'-cap structures may be used in the context of the present invention to modify the mRNA sequence of the inventive composition. Further modified 5'-cap structures which may be used in the context of the present invention are cap1 (additional methylation of the ribose of the adjacent nucleotide of m7GpppN), cap2 (additional methylation of the ribose of the 2nd nucleotide downstream of the m7GpppN), cap3 (additional methylation of the ribose of the 3rd nucleotide downstream of the m7GpppN), cap4 (additional methylation of the ribose of the 4th nucleotide downstream of the m7GpppN), ARCA (anti-reverse cap analogue), modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine.

In the context of the present invention, a 5' cap structure may also be formed in chemical RNA synthesis or RNA in vitro transcription (co-transcriptional capping) using cap analogues, or a cap structure may be formed in vitro using capping enzymes (e.g., commercially available capping kits). A cap structure (e.g., cap0 or cap1) may also be formed in vitro using immobilized capping enzymes, e.g. in a capping reactor as described in WO 2016/193226.

Cap Analogue:

A cap analogue refers to a non-polymerizable di-nucleotide that has cap functionality in that it facilitates translation or localization, and/or prevents degradation of the RNA molecule when incorporated at the 5' end of the RNA molecule. Non-polymerizable means that the cap analogue will be incorporated only at the 5'terminus because it does not have a 5' triphosphate and therefore cannot be extended in the 3' direction by a template-dependent RNA polymerase.

Cap analogues include, but are not limited to, a chemical structure selected from the group consisting of m7GpppG, m7GpppA, m7GpppC; unmethylated cap analogues (e.g., GpppG); dimethylated cap analogue (e.g., m2,7GpppG), trimethylated cap analogue (e.g., m2,2,7GpppG), dimethylated symmetrical cap analogues (e.g., m7Gpppm7G), or anti reverse cap analogues (e.g., ARCA: m7,2'OmepppG, m7,2'dGpppG, m7,3'OmeGpppG, m7,3'dGpppG and their tetraphosphate derivatives) (Stepinski et al., 2001. RNA 7(10):1486-95).

Further cap analogues have been described previously (U.S. Pat. No. 7,074,596, WO 2008/016473, WO 2008/157688, WO 2009/149253, WO 2011/015347, and WO 2013/059475). The synthesis of N7-(4-chlorophenoxyethyl) substituted dinucleotide cap analogues has been described recently (Kore et al. (2013) Bioorg. Med. Chem. 21(15): 4570-4).

Fragments of proteins: "Fragments" of proteins or peptides in the context of the present invention may, typically, comprise a sequence of a protein or peptide as defined herein, which is, with regard to its amino acid sequence (or its encoded nucleic acid molecule), N-terminally and/or C-terminally truncated compared to the amino acid sequence of the original (native) protein (or its encoded nucleic acid molecule). Such truncation may thus occur either on the amino acid level or correspondingly on the nucleic acid level. A sequence identity with respect to such a fragment as defined herein may therefore preferably refer to the entire protein or peptide as defined herein or to the entire (coding) nucleic acid molecule of such a protein or peptide. In this context a fragment of a protein may typically comprise an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 92%, preferably of at least 70%, more preferably of at least 80%, even more preferably at least 85%, even more preferably of at least 20% and most preferably of at least 25% or even 27%, with an amino acid sequence of the respective naturally occurring full-length protein.

Fragments of proteins or peptides in the context of the present invention may furthermore comprise a sequence of a protein or peptide as defined herein, which has a length of for example at least 5 amino acids, preferably a length of at least B amino acids, preferably at least 7 amino acids, more preferably at least 8 amino acids, even more preferably at least 9 amino acids; even more preferably at least 10 amino acids; even more preferably at least 11 amino acids; even mare preferably at least 12 amino acids; even more preferably at least 13 amino acids; even more preferably at least 14 amino acids; even more preferably at least 15 amino acids; even more preferably at least 16 amino acids; even more preferably at least 17 amino acids; even more preferably at least 18 amino acids; even more preferably at least 1 amino acids; even more preferably at least 20 amino acids; even more preferably at least 25 amino acids; even more preferably at least 30 amino acids; even more preferably at least 35 amino acids; even more preferably at least 50 amino acids; or most preferably at least 100 amino acids. For example such fragment may have a length of about 6 to about 20 or even more amino acids, e.g. fragments as processed and presented by MHC class I molecules, preferably having a length of about 8 to about 10 amino acids, e.g. 8, 9, or 10, (or even 8, 7, 11, or 12 amino acids), or fragments as processed and presented by MHC class II molecules, preferably having a length of about 13 or more amino acids, e.g. 13, 14, 15, 16, 17, 18, 19, 20 or even mere amino acids, wherein these fragments may be selected from any part of the amino acid sequence. These fragments are typically recognized by T-cells in form of a complex consisting of the peptide fragment and an MHC molecule, i.e., the fragments are typically not recognized in their native form. Fragments of proteins or peptides may comprise at least one epitope of those proteins or peptides. Furthermore also domains of a protein, like the extracellular domain, the intracellular domain or the transmembrane domain and shortened or truncated versions of a protein may be understood to comprise a fragment of a protein.

Variants of proteins: “Variants” of proteins or peptides as defined in the context of the present invention may be generated, having an amino acid sequence which differs from the original sequence in one or more mutation(s), such as one or more substituted, inserted and/or deleted amino acid(s). Preferably, these fragments and/or variants have the same biological function or specific activity compared to the full-length native protein, e.g. its specific antigenic property. “Variants” of proteins or peptides as defined in the context of the present invention may comprise conservative amino acid substitution(s) compared to their native, i.e. non-mutated physiological, sequence. Those amino acid sequences as well as their encoding nucleotide sequences in particular fall under the term variants as defined herein. Substitutions in which amino acids, which originate from the same class, are exchanged for one another are called conservative substitutions. In particular, these are amino acids having aliphatic side chains, positively or negatively charged side chains, aromatic groups in the side chains or amino acids, the side chains of which can enter into hydrogen bridges, e.g. side chains which have a hydroxyl function. This means that e.g. an amino acid having a polar side chain is replaced by another amino acid having a likewise polar side chain, or, for example, an amino acid characterized by a hydrophobic side chain is substituted by another amino acid having a likewise hydrophobic side chain (e.g. serine (threonine) by threonine (serine) or leucine (isoleucine) by isoleucine (leucine)). Insertions and substitutions are possible, in particular, at those sequence positions which cause no modification to the three-dimensional structure or do not affect the binding region. Modifications to a three-dimensional structure by insertion(s) or deletion(s) can easily be determined e.g. using CD spectra (circular dichroism spectra) (Urry, 1885, Absorption, Circular Dichroism and ORD of Polypeptides, in: Modern Physical Methods in Biochemistry, Neuberger et al. (ed.), Elsevier, Amsterdam).

A “variant” of a protein or peptide may have at least 70%, 75%, 80%, 85%, 90%, 95%, 98% or 99% amino acid identity over a stretch of 10, 20, 30, 50, 75 or 100 amino acids of such protein or peptide.

Furthermore, variants of proteins or peptides as defined herein, which may be encoded by a nucleic acid molecule, may also comprise those sequences, wherein nucleotides of the encoding nucleic acid sequence are exchanged according to the degeneration of the genetic code, without leading to an alteration of the respective amino acid sequence of the protein or peptide, i.e., the amino acid sequence or at least part thereof may not differ from the original sequence in one or more mutation(s) within the above meaning.

Identity of a sequence: Two or more sequences are identical if they exhibit the same length and order of nucleotides or amino acids. The percentage of identity typically describes the extent, to which two sequences are identical, i.e. it typically describes the percentage of nucleotides that correspond in their sequence position with identical nucleotides of a reference sequence. In order to determine the percentage to which two sequences are identical, e.g. nucleic acid sequences or amino acid sequences as defined herein, preferably the amino acid sequences encoded by a nucleic acid sequence of the polymeric carrier as defined herein or the amino acid sequences themselves, the sequences can be aligned in order to be subsequently compared to one another. Therefore, e.g. a position of a first sequence may be compared with the corresponding position of the second sequence. If a position in the first sequence is occupied by the same component (residue) as is the case at a position in the second sequence, the two sequences are identical at this position. If this is not the case, the sequences differ at this position. If insertions occur in the second sequence in comparison to the first sequence, gaps can be inserted into the first sequence to allow a further alignment. If deletions occur in the second sequence in comparison to the first sequence, gaps can be inserted into the second sequence to allow a further alignment. The percentage to which two sequences are identical is then a function of the number of identical positions divided by the total number of positions including those positions which are only occupied in one sequence. The percentage to which two sequences are identical can be determined using a mathematical algorithm. A preferred, but not limiting, example of a mathematical algorithm which can be used is the algorithm of Karlin et al. (1293), PNAS USA, 90:5873-5877 or Altschul eta (1997), Nucleic Acids Res., 25:3389-3402. Such an algorithm is integrated in the BLAST-program. Sequences which are identical to the sequences of the present invention to a certain extent can be identified by this program.

Derivative of a protein or peptide: A derivative of a peptide or protein is typically understood to be a molecule that is derived from another molecule, such as said peptide or protein. A “derivative” of a peptide or protein also encompasses fusions comprising a peptide or protein used in the present invention. For example, the fusion comprises a label, such as, for example, an epitope, e.g., a FLAG epitope or a V5 epitope. For example, the epitope is a FLAG epitope. Such a tag is useful for, for example, purifying the fusion protein.

Monocistronic mRNA: A monocistronic mRNA may typically be an mRNA, that comprises only one open reading frame (coding sequence or coding region). An open reading frame in this context is a sequence of several nucleotide triplets (codons) that can be translated into a peptide or protein, preferably an Influenza virus peptide or protein.

Nucleic acid: The term nucleic acid means any DNA- or RNA-molecule and is used synonymous with polynucleotide. Wherever herein reference is made to a nucleic acid or nucleic acid sequence encoding a particular protein and/or peptide, said nucleic acid or nucleic acid sequence, respectively, preferably also comprises regulatory sequences allowing in a suitable host, e.g. a human being, its expression, i.e. transcription and/or translation of the nucleic acid sequence encoding the particular protein or peptide.

Peptide: A peptide is a polymer of amino acid monomers. Usually the monomers are linked by peptide bonds. The term “peptide” does not limit the length of the polymer chain of amino acids. In some embodiments of the present invention a peptide may for example contain less than 50 monomer units. Longer peptides are also called polypeptides, typically having 50 to 600 monomeric units, more specifically 50 to 300 monomeric units. In the context of the present invention, the term ‘polypeptide’ may also be used with respect to peptides comprising less than 50 (e.g. 10) amino acids or peptides comprising even more than GOD amino acids. Also, the terms “polypeptide”, “peptide”, and “protein” are used interchangeably herein to refer to polymers of amino acids of any length.

Pharmaceutically effective amount: A pharmaceutically effective amount in the context of the invention is typically understood to be an amount that is sufficient to induce an immune response.

Protein: A protein typically consists of one or more peptides and/or polypeptides folded into 3-dimensional form, facilitating a biological function.

Poly (C) sequence: A poly-(C)-sequence is typically a long sequence of cytosine nucleotides, typically about 10 to about 200 cytosine nucleotides, preferably about 10 to about 100 cytosine nucleotides, more preferably about 10 to about 70 cytosine nucleotides or even more preferably about 20 to about 50 or even about 20 to about 30 cytosine nucleotides. A poly(C) sequence may preferably be located 3' of the coding region comprised by a nucleic acid.

Poly-A-tail/sequence: A poly-A-tail also called "3'-poly (A) tail" or "poly(A) sequence" is typically a long sequence of adenosine nucleotides of up to about 400 adenosin nucleotides, e.g. from about 25 to about 400, preferably from about 50 to about 400, mare preferably from about 50 to about 300, even more preferably from about 50 to about 250, most preferably from about 60 to about 250 adenosine nucleotides, added to the 3' and of a RNA. In the context of the present invention, a poly(A) sequence may be located within an mRNA or any other nucleic acid molecule, such as, e.g., in a vector, for example, in a vector serving as template for the generation of an RNA, preferably an mRNA, e.g., by transcription of the vector. Moreover, poly (A) sequences, or poly(A) tails may be generated in vitro by enzymatic polyadenylation of the RNA, e.g. using Poly(A) polymerases (PAP) derived from *E. coli* or yeast. In addition, polyadenylation of RNA can be achieved by using immobilized PAP enzymes e.g. in a polyadenylation reactor (WD/ 2016/174271).

Polyadenylation: Polyadenylation is typically understood to be the addition of a poly(A) sequence to a nucleic acid molecule, such as an RNA molecule, e.g. to a premature mRNA. Polyadenylation may be induced by a so called polyadenylation signal. This signal is preferably located within a stretch of nucleotides at the 3'-end of a nucleic acid molecule, such as an RNA molecule, to be polyadenylated. A polyadenylation signal typically comprises a hexamer consisting of adenine and uracil/thymine nucleotides, preferably the hexamer sequence AAUAAA. Other sequences, preferably hexamer sequences, are also conceivable. Polyadenylation typically occurs during processing of a pre-mRNA (also called premature-mRNA). Typically, RNA maturation (from pre-mRNA to mature mRNA) comprises the step of polyadenylation.

Stabilized nucleic acid, preferably mRNA: A stabilized nucleic acid, preferably mRNA typically, exhibits a modification increasing resistance to in vivo degradation (e.g. degradation by an exo- or endo-nuclease) and/or ex vivo degradation (e.g. by the manufacturing process prior to vaccine administration, e.g. in the course of the preparation of the vaccine solution to be administered). Stabilization of RNA can, e.g., be achieved by providing a 5'-cap-Structure, a Poly-A-Tail, or any other UTR-modification. It can also be achieved by chemical modification or modification of the G/C-content or other types of sequence optimization of the nucleic acid. Various other methods are known in the art and conceivable in the context of the invention.

Carrier/polymeric carrier: A carrier in the context of the invention may typically be a compound that facilitates transport and/or complexation of another compound. Said carrier may form a complex with said other compound. A polymeric carrier is a carrier that is formed of a polymer. A carrier may be associated to its cargo by covalent or non-covalent interaction. A carrier may transport nucleic acids, e.g. RNA or DNA, to the target cells. The carrier may—for some embodiments—be a cationic component.

Cationic component/compound: The term "cationic component/compound" typically refers to a charged molecule, which is positively charged (cation) at a pH value of typically about 1 to 0, preferably of a pH value of or below 9 (e.g. 5 to 9), of or below 8 (e.g. 5 to 8), of or below 7 (e.g. 5 to 7), most preferably at physiological pH values, e.g. about 7.3 to 7.4. Accordingly, a cationic peptide, protein, polysaccharide, lipid or polymer according to the present invention is positively charged under physiological conditions, particularly under physiological salt conditions of the cell in vivo. A cationic peptide or protein preferably contains a larger number of cationic amino acids, e.g. a larger number of Arg, His, Lys or Urn than other amino acid residues (in particular more cationic amino acids than anionic amino acid residues like Asp or Olu) or contains blocks predominantly formed by cationic amino acid residues. The definition "cationic" may also refer to "polycationic" components/ compounds.

Vehicle: An agent, e.g. a carrier that may typically be used within a pharmaceutical composition or vaccine for facilitating administering of the components of the pharmaceutical composition or vaccine to an individual.

3'-untranslated region (3'-UTR): A 3'-UTR is typically the part of an mRNA which is located between the protein coding region (i.e. the open reading frame, coding sequence (cds)) and the poly(A) sequence of the mRNA. A 3'-UTR of the mRNA is not translated into an amino acid sequence. The 3'-UTR sequence is generally encoded by the gene which is transcribed into the respective mRNA during the gene expression process. The genomic sequence is first transcribed into pre-mature mRNA, which comprises optional introns. The pre-mature mRNA is then further processed into mature mRNA in a maturation process. This maturation process comprises the steps of 5'-Capping, splicing the pre-mature mRNA to excise optional introns and modifications of the 3'-end, such as polyadenylation of the 3'-end of the pre-mature mRNA and optional endo- or exonuclease cleavages etc. In the context of the present invention, a 3'-UTR corresponds to the sequence of a mature mRNA which is located 3' to the stop codon of the protein coding region, preferably immediately 3' to the stop codon of the protein coding region, and which extends to the 5'-side of the poly(A) sequence, preferably to the nucleotide immediately 5' to the poly(A) sequence. The term "corresponds to" means that the 3'-UTR sequence may be an RNA sequence, such as in the mRNA sequence used for defining the 3'-UTR sequence, or a DNA sequence which corresponds to such RNA sequence. In the context of the present invention, the term "a 3'-UTR of a gene", such as "a 3'-UTR of an albumin gene", is the sequence which corresponds to the 3'-UTR of the mature mRNA derived from this gene, i.e., the mRNA obtained by transcription of the gene and maturation of the pre-mature mRNA. The term "3'-UTR of a gene" encompasses the DNA sequence and the RNA sequence of the 3'-UTR.

5'-untranslated region (5'-UTR): A 5'-UTR is typically understood to be a particular section of messenger RNA (mRNA). It is located 5' of the open reading frame of the mRNA. Typically, the 5'-UTR starts with the transcriptional start site and ends one nucleotide before the start codon of the open reading frame. The 5'-UTR may comprise elements for controlling gene expression, also called regulatory elements. Such regulatory elements may be, for example, ribosomal binding sites or a 5'-Terminal Oligopyrimidine Tract. The 5'-UTR may be posttranscriptionally modified, for example by addition of a 5-cap. In the context of the present invention, a 5'-UTR corresponds to the sequence of a mature mRNA which is located between the 5'-cap and the start codon. Preferably, the 5'-UTR corresponds to the sequence which extends from a nucleotide located 3' to the 5'-cap, preferably from the nucleotide located immediately 3' to the 5'-cap, to a nucleotide located 5' to the start codon of the protein coding region, preferably to the nucleotide located immediately 5' to the start codon of the protein coding region. The nucleotide located immediately 3' to the 5'-cap of a mature mRNA typically corresponds to the transcriptional start site. The term "corresponds to" means that the 5'-UTR sequence may be an RNA sequence, such as in the mRNA sequence used for defining the 5'-UTR sequence, or a DNA sequence which corresponds to such RNA sequence. In the context of the present invention, the term "a 5'-UTR of a gene", such as "a 5'-UTR of a TOP gene", is the sequence which corresponds to the 5'-UTR of the mature mRNA derived from this gene, i.e., the mRNA obtained by transcription of the gene and maturation of the pre-mature mRNA. The term "5'-UTR of a gene" encompasses the DNA sequence and the RNA sequence of the 5'-UTR.

5'Terminal Oligopyrimidine Tract (TOP): The 5'terminal oligopyrimidine tract (TOP) is typically a stretch of pyrimidine nucleotides located at the 5'terminal region of a nucleic acid molecule, such as the 5' terminal region of certain mRNA molecules or the 5' terminal region of a functional entity, e.g., the transcribed region, of certain genes. The sequence starts with a cytidine, which usually corresponds to the transcriptional start site, and is followed by a stretch of usually about 3 to 30 pyrimidine nucleotides. For example, the TOP may comprise 3, 4, 5, 6, 7, 8, 9, 10, 11, 12, 13, 14, 15, 16, 17, 18, 19, 20, 21, 22, 23, 24, 25, 26, 27, 28, 29, 30 or oven more nucleotides. The pyrimidine stretch and thus the 5' TOP ends one nucleotide 5' to the first purine nucleotide located downstream of the TOP. Messenger RNA that contains a 5'terminal oligopyrimidine tract is often referred to as TOP mRNA. Accordingly, genes that provide such messenger RNAs are referred to as TOP genes. TOP sequences have, for example, been found in genes and mRNAs encoding peptide elongation factors and ribosomal proteins.

TOP motif: In the context of the present invention, a TOP motif is a nucleic acid sequence which corresponds to a 5'TOP as defined above. Thus, a TOP motif in the context of the present invention is preferably a stretch of pyrimidine nucleotides having a length of 3-30 nucleotides. Preferably, the TOP-motif consists of at least 3 pyrimidine nucleotides, preferably at least 4 pyrimidine nucleotides, preferably at least 5 pyrimidine nucleotides, more preferably at least 6 nucleotides, more preferably at least 7 nucleotides, most preferably at least 8 pyrimidine nucleotides, wherein the stretch of pyrimidine nucleotides preferably starts at its 5'end with a cytosine nucleotide. In TOP genes and TOP mRNAs, the TOP-motif preferably starts at its 5'end with the transcriptional start site and ends one nucleotide 5' to the first purin residue in said gene or mRNA. A TOP motif in the sense of the present invention is preferably located at the 5'end of a sequence which represents a 5'-UTR or at the 5'end of a sequence which codes for a 5'-UTR. Thus, preferably, a stretch of 3 or more pyrimidine nucleotides is called "TOP motif" in the sense of the present invention if this stretch is located at the 5'end of a respective sequence, such as the inventive mRNA, the 5'-UTR element of the inventive mRNA, or the nucleic acid sequence which is derived from the 5'-UTR of a TOP gene as described herein. In other words, a stretch of 3 or more pyrimidine nucleotides which is not located at the 5'-end of a 5'-UTR or a 5'-UTR element but anywhere within a 5'-UTR or a 5'-UTR element is preferably not referred to as "TOP motif".

TOP gene: TOP genes are typically characterised by the presence of a 5' terminal oligopyrimidine tract. Furthermore, most TOP genes are characterized by a growth-associated translational regulation. However, also TOP genes with a tissue specific translational regulation are known. As defined above, the 5'-UTR of a TOP gene corresponds to the sequence of a 5'-UTR of a mature mRNA derived from a TOP gene, which preferably extends from the nucleotide located 3' to the 5'-CAP to the nucleotide located 5' to the start codon. A 5'-UTR of a TOP gene typically does not comprise any start codons, preferably no upstream AUGs (uAGs) or upstream open reading frames (uORFs). Therein, upstream AUGs and upstream open reading frames are typically understood to be AUGs and open reading frames that occur 5' of the start codon (AUG) of the open reading frame that should be translated. The 5'-UTRs of TOP genes are generally rather short. The lengths of 5'-UTRs of TOP genes may vary between 20 nucleotides up to 500 nucleotides, and are typically less than about 200 nucleotides, preferably less than about 150 nucleotides, more preferably less than about 100 nucleotides. Exemplary 5'-UTRs of TOP genes in the sense of the present invention are the nucleic acid sequences extending from the nucleotide at position 5 to the nucleotide located immediately 5' to the start codon (e.g., the ATG) in the sequences according to SEQ ID NOs: 1-1363, SEQ ID NO: 1395, SEQ ID NO: 1421 and SEQ ID NO: 1422 of the international patent application WD 2013/143700 or homologs or variants thereof, whose disclosure is incorporated herewith by reference. In this context a particularly preferred fragment of a 5'-UTR of a TOP gene is a 5'-UTR of a TOP gene locking the STOP motif. The term "5'-UTR of a TOP gene" preferably refers to the 5'-UTR of a naturally occurring TOP gene.

Fragment of a nucleic acid sequence, particularly an mRNA: A fragment of a nucleic acid sequence consists of a continuous stretch of nucleotides corresponding to a continuous stretch of nucleotides in the full-length nucleic acid sequence which is the basis for the nucleic acid sequence of the fragment, which represents at least 20%, preferably at least 30%, more preferably at least 40%, more preferably at least 50%, even more preferably at least 60%, even more preferably at least 70%, even more preferably at least 80%, and most preferably at least 90% of the full-length nucleic acid sequence. Such a fragment, in the sense of the present invention, is preferably a functional fragment of the full-length nucleic acid sequence.

Variant of a nucleic acid sequence, particularly an mRNA: A variant of a nucleic acid sequence refers to a variant of nucleic acid sequences which forms the basis of a nucleic acid sequence. For example, a variant nucleic acid sequence may exhibit one or more nucleotide deletions, insertions, additions and/or substitutions compared to the nucleic acid sequence from which the variant is derived. Preferably, a variant of a nucleic acid sequence is at least 40%, preferably at least 50%, more preferably at least 60%, more preferably at least 70%, even more preferably at least 80%, even more preferably at least 90%, most preferably at least 95% identical to the nucleic acid sequence the variant is derived from. Preferably, the variant is a functional variant. A "variant" of a nucleic acid sequence may have at least 70%, 75%, 80%, 85%, 90%, 85%, 98% or 99% nucleotide identity over a stretch of 10, 20, 30, 50, 75 or 100 nucleotide of such nucleic acid sequence.

Jet injection: The term "jet injection", as used herein, refers to a needle-free injection method, wherein a fluid containing at least one inventive mRNA sequence and, optionally, further suitable excipients is forced through an orifice, thus generating an ultra-fine liquid stream of high pressure that is capable of penetrating mammalian skin and, depending on the injection settings, subcutaneous tissue or muscle tissue. In principle, the liquid stream forms a hole in the skin, through which the liquid stream is pushed into the target tissue. Preferably, jet injection is used for intradermal, subcutaneous or intramuscular injection of the mRNA sequence according to the invention. In a preferred embodiment, jet injection is used for intramuscular injection of the mRNA sequence according to the invention. In a further preferred embodiment, jet injection is used for intradermal injection of the mRNA sequence according to the invention.

RNA In vitro transcription: The terms "RNA in vitro transcription" or "in vitro transcription" relate to a process wherein RNA is synthesized in a call-free system (in vitro). DNA, particularly plasmid DNA, is used as template for the generation of RNA transcripts. RNA may be obtained by DNA-dependent in vitro transcription of an appropriate DNA template, which according to the present invention is preferably a linearized plasmid DNA template. The promoter for controlling in vitro transcription can be any promoter for any DNA-dependent RNA polymerase. Particular examples of DNA-dependent RNA polymerases are the T7, T3, and SPG RNA polymerases. A DNA template for in vitro RNA transcription may be obtained by cloning of a nucleic acid, in particular cDNA corresponding to the respective RNA to be in vitro transcribed, and introducing it into an appropriate vector for in vitro transcription, far example into plasmid DNA. In a preferred embodiment of the present invention the DNA template is linearized with a suitable restriction enzyme, before it is transcribed in vitro. The cDNA may be obtained by reverse transcription of mRNA or chemical synthesis. Moreover, the DNA template for in vitro RNA synthesis may also be obtained by gene synthesis.

Methods for in vitro transcription are known in the art (see, e.g., Beall at al. (2013) Semin. Immunol. 25(2):152-156; Brunelle at al. (2013) Methods Enzymol. 530:101-14). Reagents used in said method typically include:

1) a linearized DNA template with a promoter sequence that has a high binding affinity for its respective RNA polymerase such as bacteriophage-encoded RNA polymerases;
2) ribonucleoside triphosphates (NTPs) for the four bases (adenine, cytosine, guanine and uracil):
3) optionally a cap analogue as defined above (e.g. m76(5')ppp(5')G (m71));
4) a DNA-dependent RNA polymerase capable of binding to the promoter sequence within the linearized DNA template (e.g. T7, T3 or SPG RNA polymerase);
5) optionally a ribonuclease (RNase) inhibitor to inactivate any contaminating RNase:
6) optionally a pyrophosphatase to degrade pyrophosphate, which may inhibit transcription:
7) MgCl2, which supplies Mg2+ ions as a co-factor for the polymerase;
8) a buffer to maintain a suitable pH value, which can also contain antioxidants (e.g. DTT), and/or polyamines such as spermidine at optimal concentrations.

Full-length protein: The term "full-length protein" as used herein typically refers to a protein that substantially comprises the entire amino acid sequence of the naturally occurring protein. Nevertheless, substitutions of amino acids e.g. due to mutation in the protein are also encompassed in the term full-length protein.

Chemical synthesis of mRNA: Chemical synthesis of relatively short fragments of oligonucleotides with defined chemical structure provides a rapid and inexpensive access to custom-made oligonucleotides of any desired sequence. Whereas enzymes synthesize DNA and RNA only in the 5' to 3' direction, chemical oligonucleotide synthesis does not have this limitation, although it is most often carried out in the opposite, i.e., the 3' to 5' direction. Currently, the process is implemented as solid-phase synthesis using the phosphoramidite method and phosphoramidite building blacks derived from protected nucleosides (A, C, G, and U), or chemically modified nucleosides. To obtain the desired oligonucleotide, the building blocks are sequentially coupled to the growing oligonucleotide chain on a solid phase in the order required by the sequence of the product in a fully automated process. Upon the completion of the chain assembly, the product is released from the solid phase to the solution, deprotected, and collected. The occurrence of side reactions sets practical limits for the length of synthetic oligonucleotides (up to about 200 nucleotide residues), because the number of errors increases with the length of the oligonucleotide being synthesized. Products are often isolated by HPLC to obtain the desired oligonucleotides in high purity.

Chemically synthesized oligonucleotides find a variety of applications in molecular biology and medicine. They are most commonly used as antisense oligonucleotides, small interfering RNA, primers for DNA sequencing and amplification, probes for detecting complementary DNA or RNA via molecular hybridization, tools for the targeted introduction of mutations and restriction sites, and for the synthesis of artificial genes. Moreover, long-chain DNA molecules and long-chain RNA molecules, particularly mRNA molecules, may be chemically synthetized and used in the context of the present invention.

Coding region, coding sequence: A coding region or coding sequence in the context of the invention is typically a sequence of several nucleotide triplets, which may be translated into a peptide or protein. A coding region preferably contains a start codon, i.e. a combination of three subsequent nucleotides coding usually for the amino acid methionine (ATG), at its 5'-end and a subsequent region which usually exhibits a length which is a multiple of 3 nucleotides. A coding region is preferably terminated by a stop-codon (e.g., TAA, TAG, TBA). Typically, this is the only stop-codon of the coding region. Thus, a coding region in the context of the present invention is preferably a nucleotide sequence, consisting of a number of nucleotides that may be divided by three, which starts with a start codon (e.g. ATG) and which preferably terminates with a stop codon (e.g., TAA, TGA, or TAG). The coding region may be isolated or it may be incorporated in a longer nucleic acid sequence, for example in a vector or an mRNA. In the context of the present invention, a coding region may also be termed "protein coding region", "coding region", "coding sequence", "CDS", "Open reading frame" or "ORF" and is typically the part of the mRNA construct that encodes the antigenic peptide(s) or protein(s) according to the present invention.

"Different Influenza virus": The term "different Influenza virus" in the context of the invention has to be understood as the difference between at least two respective Influenza viruses, wherein the difference is manifested on the RNA genome of the respective different virus. In the broadest sense, “different Influenza virus” has to be understood as genetically “different Influenza virus”. Particularly, said (genetically) different Influenza viruses express at least one different protein or peptide, wherein the at least one different protein or peptide preferably differs in at least one amino acid.

“Same Influenza virus”: In the broadest sense, “same Influenza virus” has to be understood as genetically the same. Particularly, said (genetically) same virus expresses the same proteins or peptides (e.g., at least one structural and/or non-structural protein), wherein all proteins or peptides have the same amino acid sequence.

DNA: DNA is the usual abbreviation for deoxy-ribonucleic acid. It is a nucleic acid molecule, i.e. a polymer consisting of nucleotides. These nucleotides are usually deoxy-adenosine-monophosphate, deoxy-thymidine-monophosphate, deoxy-guanosine-monophosphate and deoxy-cytidine-monophosphate monomers which are—by themselves—composed of a sugar moiety (deoxyribose), a base moiety and a phosphate moiety, and polymerize by a characteristic backbone structure. The backbone structure is, typically, formed by phosphodiester bonds between the sugar moiety of the nucleotide, i.e. deoxyribose, of a first and a phosphate moiety of a second, adjacent monomer. The specific order of the monomers, i.e., the order of the bases linked to the sugar/phosphate-backbone, is called the DNA sequence. DNA may be single stranded or double stranded. In the double stranded form, the nucleotides of the first strand typically hybridize with the nucleotides of the second strand, e.g. by A/T-base-pairing and G/C-base-pairing.

G/C modified: A G/C-modified (or GC modified) nucleic acid may typically be a nucleic acid, preferably an artificial mRNA (sequence) as defined herein, based on a modified wild type sequence comprising a preferably increased number of guanosine and/or cytosine nucleotides as compared to the wild type sequence. Such an increased number may be generated by substitution of codons containing adenosine or thymidine nucleotides by codons containing guanosine or cytosine nucleotides. If the enriched G/C content occurs in a coding region of DNA or RNA, it makes use of the degeneracy of the genetic code. Accordingly, the codon substitutions preferably do not alter the encoded amino acid residues, but exclusively increase the G/C content of the nucleic acid molecule.

Heterologous sequence: Two sequences are typically understood to be ‘heterologous’ if they are not derivable from the same gene or in the same allele. I.e., although heterologous sequences may be derivable from the same organism, they naturally (in nature) do not occur in the same nucleic acid molecule, such as in the same mRNA. For example, a heterologous mRNA in the context of the invention has to be understood as an mRNA comprising a coding sequence derived from an Influenza virus and at least one nucleic acid sequence that is not derived from an Influenza virus, e.g. a sequence derived from a human gene, e.g. a 5'-UTR and/or a 3'-UTR.

Homolog of a nucleic acid sequence: The term “homolog” of a nucleic acid sequence or RNA sequence refers to sequences of other species than the particular sequence t. For example, if referred to a nucleic acid sequence originating from an Influenza virus it is preferred that the homolog is a homolog of an Influenza virus nucleic acid sequence. For example, if referred to a nucleic acid sequence originating from a human it is preferred that the homolog is a homolog of a human nucleic acid sequence.

RNA, mRNA: RNA is the usual abbreviation for ribonucleic-acid. It is a nucleic acid molecule, i.e. a polymer consisting of nucleotides. These nucleotides are usually adenosine-monophosphate, uridine-monophosphate, guanosine-monophosphate and cytidine-monophosphate monomers which are connected to each other along a so-called backbone. The backbone is formed by phosphodiester bonds between the sugar, i.e. ribose, of a first and a phosphate moiety of a second, adjacent monomer. The specific succession of the monomers is called the RNA-sequence. Usually RNA may be obtainable by transcription of a DNA-sequence, e.g., inside a cell. In eukaryotic cells, transcription is typically performed inside the nucleus or the mitochondria. Typically, transcription of DNA usually results in the so-called premature RNA which has to be processed into so-called messenger-RNA, usually abbreviated as mRNA. Processing of the premature RNA, e.g. in eukaryotic organisms, comprises a variety of different posttranscriptional-modifications such as splicing, 5'-capping, polyadenylation, export from the nucleus or the mitochondria and the like. The sum of these processes is also called maturation of RNA. The mature messenger RNA usually provides the nucleotide sequence that may be translated into an amino-acid sequence of a particular peptide or protein.

Typically, a mature mRNA comprises a 5'-cap, a 5'-UTR, a coding region, a 3'-UTR and a poly(A) sequence. Aside from messenger RNA, several non-coding types of RNA exist which may be involved in regulation of transcription and/or translation.

Strain, strain of a virus: A strain or a strain of a virus is a group of viruses that are genetically distinct from other groups of the same species. The strain that is defined by a genetic variant is also defined as a “subtype”.

Transfection: The term “transfection” refers to the introduction of nucleic acid molecules, such as DNA or RNA (e.g. mRNA) molecules, into cells, preferably into eukaryotic cells. In the context of the present invention, the term “transfection” encompasses any method known to the skilled person for introducing nucleic acid molecules, preferably an mRNA molecule into cells, preferably into eukaryotic cells, such as into mammalian cells. Such methods encompass, for example, electroporation, lipofection, e.g. based on cationic lipids and/or liposomes, calcium phosphate precipitation, nanoparticle based transfection, virus based transfection, or transfection based on cationic polymers, such as DEAE-dextran or polyethylenimine etc. Preferably, the introduction of the nucleic acid, preferably the mRNA is non-viral.

DETAILED DESCRIPTION

The present invention is based on the inventors' surprising finding that an mRNA sequence comprising a coding region, encoding at least one antigenic peptide or protein derived from an influenza virus induces efficiently antigen-specific immune responses against influenza virus.

Furthermore, the inventors surprisingly found that mRNA-based vaccines comprising mRNA sequences encoding different antigens of an influenza virus (particularly hemagglutinin (HA) and neuraminidase (NA)) were extremely effective in inducing an antigen-specific immune response against influenza virus.

Furthermore, the inventors surprisingly found that many mRNA sequences encoding different antigens of different influenza viruses can be effectively combined in one mRNA-based vaccine. This is particularly advantageous for a seasonal influenza/flu vaccine (vaccine for seasonal flu). Moreover, this is particularly advantageous for a universal, broadly protecting influenza/flu vaccine (vaccine comprising multiple RNA sequences encoding multiple different antigens of multiple different influenza viruses).

Additionally, the mRNA sequence according to the invention enables rapid and rational vaccine design with flexibility, speed and scalability of production probably exceeding those of current virus-based technologies. This is particularly advantageous for both, a pandemic flu vaccine (vaccine for pandemic flu) and a seasonal influenza/flu vaccine (vaccine for seasonal flu). Moreover, this is also particularly advantageous for a universal, broadly protecting influenza/flu vaccine.

In a particularly preferred embodiment of the first aspect of the invention the inventive mRNA sequence comprises a coding region, encoding at least one antigenic peptide or protein derived from hemagglutinin (HA), neuraminidase (NA), nucleoprotein (NP), matrix protein 1 (M1), matrix protein 2 (M2), non-structural protein 1 (NSI), non-structural protein 2 (NS2), nuclear export protein (NEP), polymerase acidic protein (PA), polymerase basic protein PBI, PBI-F2, or polymerase basic protein 2 (PB2) of an influenza virus or a fragment or variant thereof.

In this context, the amino acid sequence of the at least one antigenic peptide or protein may be selected from any peptide or protein derived from hemagglutinin (HA), neuraminidase (NA), nucleoprotein (NP), matrix protein I (M1), matrix protein 2 (M2), non-structural protein I (NSI), non-structural protein 2 (NS2), nuclear export protein (NEP), polymerase acidic protein (PA), polymerase basic protein PBI, PBI-F2, or polymerase basic protein 2 (PB2) of an influenza virus or a fragment or variant or from any synthetically engineered influenza virus peptide or protein.

In a preferred embodiment of the present invention the coding region encodes at least one antigenic peptide or protein derived, from hemagglutinin (HA) and/or neuraminidase (NA) of an influenza virus or a fragment or variant thereof. In this context the hemagglutinin (HA) and the neuraminidase (NA) may be chosen from the same influenza virus or from different influenza viruses.

In this context it is particularly preferred that the at least one coding region encodes at least one full-length protein of hemagglutinin (HA), neuraminidase (NA), nucleoprotein (NP), matrix protein I (M), matrix protein 2 (M2), non-structural protein I (NSI), non-structural protein 2 (NS2), nuclear export protein (NEP), polymerase acidic protein (PA), polymerase basic protein PSI, PBI-F2, or polymerase basic protein 2 (PB2) of an influenza virus or a variant thereof.

In particularly preferred embodiments the at least one coding region encodes at least one full-length protein of hemagglutinin (HA), and/or at least one full-length protein of neuraminidase (NA) of an influenza virus or a variant thereof.

The term "full-length protein" as used herein typically refers to a protein that substantially comprises the entire amino acid sequence of the naturally occurring protein. As used herein, the term "full-length protein" preferably relates to the full-length sequence of protein indicated in FIGS. 1-4. More preferably, the term "full-length protein" preferably refers to an amino acid sequence as defined by any one of the SEQ ID NOs listed in FIGS. 1-4 (SEQ ID NOs: 1-30504, 213713, 213738, 213738, 213787, 213792, 213797, 213802, 213996-214023, 214100-214127, 214212-214239, 214316-214343, 214420-214447, 214524-214551, 214628-214655, 214732-214759, 214836-214863, 214940-214967, 215044, 215049-215076, 215161, 215166-215193, 215278, 215283-215310, 215395, 215400-215427, 215512, 215517-215544) or to an amino acid provided in the database under the respective database accession number.

In specific embodiments the influenza virus peptide or protein is derived from influenza A, an influenza B, or an influenza C virus (strain).

The influenza A virus may be selected from influenza A viruses characterized by a hemagglutinin (HA) selected from the group consisting of H1, H2, H3, H4, H5, H6, H7, H8, H9, H10, H11, H12, H13, H14, H15, H16, H17 and H18. Preferably the influenza A virus is selected from an influenza virus characterized by a hemagglutinin (HA) selected from the group consisting of H1, H3, H5, H9 or H10.

Furthermore, particularly preferred are influenza A viruses characterized by a neuraminidase (NA) selected from the group consisting of N1, N2, N3, N4, N5, N6, N7, N8, N9, N10, and N11. Most preferably the influenza A virus is characterized by a neuraminidase (NA) selected from the group consisting of N1, N2, or N8.

In particularly preferred embodiments the influenza A virus is selected from the group consisting of H1N1, H1N2, H2N2, H3N1, H3N2, H3N8, H5N1, H5N2, H5N3, H5N8, H5N9, H7N1, H7N2, H7N3, H7N4, H7N7, H7N9, H10N2, and H10N7 and H10N8, preferably from H1N1, H3N2, H5N1, H5N8.

In this context it is particularly preferred that the at least one coding region of the inventive mRNA sequence encodes at least one antigenic peptide or protein derived from hemagglutinin (HA) and/or at least one antigenic peptide or protein derived from neuraminidase (NA) of an influenza A virus selected from the group consisting of H1N1, H1N2, H2N2, H3N1, H3N2, H3N8, H5N1, H5N2, H5N3, H5N8, H5N9, H7N1, H7N2, H7N3, H7N4, H7N7, H7N9, H9N2, and H10N7 and H10N8, preferably from H1N1, H3N2, H5N1, H5N8 or a fragment or variant thereof.

In other embodiments the influenza A virus is selected from the group consisting of H1N1, H1N2, H1N3, H1N4, HINE, H1N6, H1N7, H1N8, H1N9, H1N10, H1N11, H2N1, H2N2, H2N3, H2N4, H2N5, H2N6, H2N7, H2N8, H2N9, H2N10, H2N11, H3N1, H3N2, H3N3, H3N4, H3N5, H3N6, H3N7, H3N8, H3N9, H3N10, H3N11, H4N1, H4N2, H4N3, H4N4, H4N5, H4N6, H4N7, H4N8, H4N9, H4N10, H4N11, H5N1, H5N2, H5N3, H5N4, H5N5, H5N6, H5N7, H5N8, H5N9, H5N10, H6N11, H6N1, H6N2, H6N3, H6N4, H6N5, H6N6, H6N7, H6N8, H6N9, H6N10, H6N11, H7N1, H7N2, H7N3, H7N4, H7N5, H7N6, H7N7, H7N8, H7N9, H7N10, H7N11, H8N1, H8N2, H8N3, H8N4, H8N5, H8N6, H8N7, H8N8, H8N9, H8N10, H8N11, H9N1, H9N2, H9N3, H9N4, H9N5, H9N6, H9N7, H9N8, H9N9, H9N10, H9N11, H10N1, H10N2, H10N3, H10N4, H10N5, H10N6, H10N7, H10N8, H10N9, H10N10, H10N11, H11N1, H11N2, H11N3, H11N4, H11N5, H11N6, H11N7, H11N8, H11N9, H11N10, H11N11, H12N1, H12N2, H12N3, H12N4, H12N5, H12N6, H12N7, H12N8, H12N9, H12N10, H12N11, H13N1, H13N2, H13N3, H13N4, H13N5, H13N6, H13N7, H13N8, H13N9, H13N10, H13N11, H14N1, H14N2, H4N3, H14N4, H14N5, H14N6, H14N7, H14N8, H14N9, H14N10, H14N11, H5N1, H15N2, H15N3, H15N4, H15N5, H15N6, H15N7, H15N8, H15N9, H15N10, H15N11, H16N1, H16N2, H16N3, H16N4, H16N5, H16N6, H16N7, H16N8, H16N9, H16N10, H16N11, H17N1, H17N2, H17N3, H17N4, H17N5, H17N6, H17N7, H17N8, H17N9, H17N10, H17N11, H18N1, H18N2, H18N3, H18N4, H18N5, H18N6, H18N7, H18N8, H18N9, H18N10, and H18N11.

In this context it is particularly preferred that the at least one coding region of the inventive mRNA sequence encodes at least one antigenic peptide or protein derived from hemagglutinin (HA) and/or at least one antigenic peptide or protein derived from neuraminidase (NA) of an influenza A virus selected from the group consisting of H1N1, H1N2, H1N3, H1N4, H1N5, H1N6, H1N7, H1N8, H1N9, H1N10, H1N11, H2N1, H2N2, H2N3, H2N4, H2N5, H2N6, H2N7, H2N8, H2N9, H2N10, H2N11, H3N1, H3N2, H3N3, H3N4, H3N5, H3N6, H3N7, H3N8, H3N9, H3N10, H3N11, H4N1, H4N2, H4N3, H4N4, H4N5, H4N6, H4N7, H4N8, H4N9, H4N10, H4N11, H5N1, H5N2, H5N3, H5N4, H5N5, H5N6, H5N7, H5N8, H5N9, H5N10, H5N11, H6N1, H6N2, H6N3, H6N4, H6N5, H6N6, H6N7, H6N8, H6N9, H6N10, H6N11, H7N1, H7N2, H7N3, H7N4, H7N5, H7N6, H7N7, H7N8, H7N9, H7N10, H7N11, H8N1, H8N2, H8N3, H8N4, H8N5, H8N6, H8N7, H8N8, H8N9, H8N10, H8N11, H9N1, H9N2, H9N3, H9N4, H9N5, H9N6, H9N7, H9N8, H9N9, H9N10, H9N11, H10N1, H10N2, H10N3, H10N4, H1N5, H10N6, H10N7, H10N8, H10N9, H10N10, H10N11, H11N1, H11N2, H1N3, H11N4, H11N5, H11N6, H11N7, H11N8, H11N9, H11N10, H11N11, H12N1, H12N2, H12N3, H12N4, H12N5, H12N6, H12N7, H12N8, H12N9, H12N10, H12N11, H13N1, H13N2, H13N3, H13N4, H13N5, H13N6, H13N7, H13N8, H13N9, H13N10, H13N11, H14N1, H14N2, H14N3, H14N4, H14N5, H14N6, H14N7, H14N8, H14, H14N9, H14N10, H14N11, H15N1, H1N2, H15N3, H15N4, H15N5, H1N6, H15N7, H15N8, H15N9, H15N10, H15N11, H16N1, H16N2, H16N3, H16N4, H16N5, H16N6, H16N7, H16N8, H16N9, H16N10, H16N11, H17N1, H17N2, H17N3, H17N4, H17N5, H17N6, H17N7, H17N8, H17N9, H17N10, H17N11, H18N1, H18N2, H18N3, H18N4, H18N5, H18N6, H18N7, H18N8, H18N9, H18N10, and H18N11.

Protein Sequences:

In the context of the present invention a fragment of a protein or a variant thereof encoded by the at least one coding region of the mRNA sequence according to the invention may typically comprise an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%,% 97%, 98%, or 99%, preferably of at least 70%, more preferably of at least 80%, even more preferably at least 85%, even mere preferably of at least 90% and most preferably of at least 95% or even 97%, with an amino acid sequence of the respective naturally occurring full-length protein or a variant thereof, preferably according to SEQ ID NOs: 1-30504, 213713, 213738, 213739, 213787, 213782, 213787, 213802, 213986-214023, 214100-214127, 214212-214239, 214316-214343, 214420-214447, 214524-214551, 214628-214655, 214732-214759, 214836-214863, 214940-214967, 215044, 215049-215076, 215161, 215166-215193, 215278, 215283-215310, 215395, 215400-215427, 215512, 215517-215544 or preferably as disclosed in FIGS. 1-4.

In specific embodiments the antigenic peptide or protein is derived from a hemagglutinin (HA) protein of an influenza A virus according to SEQ ID NOs: 1-14031, 213713, 213996-214023, 214100-214127, 214212-214239, 214316-214343, 214420-214447, 214524-214551, 214628-214855, 214732-214759, 215044, 215049-215076, 215161, 215166-215193, 215278, 215283-215310, 215395, 215400-215427, 215512, 215517-215544.

In this context it is further preferred that the at least one coding sequence of the mRNA sequence of the present invention encodes at least one antigenic peptide or protein which is derived from a hemagglutinin (HA) protein of an influenza A virus, or a fragment or variant thereof, wherein the hemagglutinin (HA) protein of an influenza A virus is selected from the hemagglutinin (HA) proteins listed in FIG. 1. Therein, each row (row 1-row 14031) corresponds to a hemagglutinin (HA) as identified by the database accession number of the corresponding protein (first column "NCBI, Genbank or EpiFlu Accession No."). The second column in FIG. 1 ("A") indicates the SEQ ID NOs corresponding to the respective amino acid sequence as provided herein. The SEQ ID NOs corresponding to the nucleic acid sequence of the wild type mRNA Encoding the protein is indicated in the third column ("B"). The fourth column ("C") provides the SEQ ID NOs corresponding to modified/optimized nucleic acid sequences of the mRNAs as described herein that encode the protein preferably having the amino acid sequence as defined by the SEQ ID NOs indicated in the second column ("A") or by the database entry indicated in the first column ("NCBI, Genbank or EpiFlu Accession No.").

Hemagglutinin (HA) proteins of influenza A virus are shown in FIG. 1.

Particularly preferred in this context are the following HA protein sequences of influenza A: HA protein of influenza A/California/07/2008 (H1N1) (SEQ ID NOs: 13836-13844, 213996-214023, 214100-214127): HA protein of influenza A/Michigan/45/2015 (H1N1) (SEQ ID NOs: 13845-13847, 214212-214239, 214316-214343, 214420-214447); HA protein of influenza A/Netherlands/602/2009 (H1N1) (SEQ ID NOs: 13848-13850, 214524-214551); HA protein of influenza A/Hong Kong/4801/2014 (H3N2) (SEQ ID NOs: 13853-13858, 214628-214655); HA protein of influenza A/Vietnam/1194/2004 (H5N1) (SEQ ID NOs: 13859-13860, 214732-214759); HA protein of influenza A/Vietnam/1203/2004 (H5N1) (SEQ ID NOs: 13861-13871).

In specific embodiments the antigenic peptide or protein is derived from a hemagglutinin (HA) protein of an influenza B virus according to SEQ ID NOs: 26388-28576, 214836-214863, 214940-214967.

In this context it is further preferred that the at least one coding sequence of the mRNA sequence of the present invention encodes at least one antigenic peptide or protein which is derived from a hemagglutinin (HA) protein of an influenza B virus, or a fragment or variant thereof, wherein the hemagglutinin (HA) protein of an influenza B virus is selected from the hemagglutinin (HA) proteins listed in FIG. 2. Therein, each row (row 1-row 2178) corresponds to a hemagglutinin (HA) as identified by the database accession number of the corresponding protein (first column "NCBI, Genbank or EpiFlu Accession No."). The second column in FIG. 2 ("A") indicates the SEQ ID NOs corresponding to the respective amino acid sequence as provided herein. The SEQ ID NOs corresponding to the nucleic acid sequence of the wild type mRNA encoding the protein is indicated in the third column ("B"). The fourth column ("C") provides the SEQ ID NOs corresponding to modified/optimized nucleic acid sequences of the mRNAs as described herein that encode the protein preferably having the amino acid sequence as defined by the SEQ ID NOs indicated in the second column ("A") or by the database entry indicated in the first column ("NCBI, Genbank or EpiFlu Accession No.").

Hemagglutinin (HA) proteins of influenza B virus are shown in FIG. 2.

Particularly preferred in this context are the following HA protein sequences of influenza B: HA protein of influenza B/Brisbane/60/2008 (SEQ ID NOs: 28524-28529 and 214836-214863); HA protein of influenza B/Phuket/3037/2013 (SEQ ID NOs: 28530-28532 and 214940-214967).

In further specific embodiments the antigenic peptide or protein is derived from a neuraminidase (NA) protein of an influenza A virus according to SEQ ID NOs: 14032-26397, 213738, 213739, 213787, 213792, 213727, 213802.

In this context it is further preferred that the at least one coding sequence of the mRNA sequence of the present invention encodes at least one antigenic peptide or protein which is derived from a neuraminidase (NA) protein of an influenza A virus, or a fragment or variant thereof, wherein the neuraminidase (NA) protein of an influenza A virus is selected from the neuraminidase (HA) proteins listed in FIG. 3. Therein, each row (row 1-row 12366) corresponds to a neuraminidase (NA) as identified by the database accession number of the corresponding protein (first column "NCB. Genbank or EpiFlu Accession No."). The second column in FIG. 3 ("A") indicates the SEQ ID NOs corresponding to the respective amino acid sequence as provided herein. The SEQ ID NOs corresponding to the nucleic acid sequence of the wild type mRNA encoding the protein is indicated in the third column ("B"). The fourth column ("C") provides the SEQ ID NOs corresponding to modified/optimized nucleic acid sequences of the mRNAs as described herein that encode the protein preferably having the amino acid sequence as defined by the SEQ ID NOs indicated in the second column ("A") or by the database entry indicated in the first column ("NCBI. Genbank or EpiFlu Accession No.").

Neuraminidase (HA) proteins of influenza A virus are shown in FIG. 3.

Particularly preferred in this context are the following NA protein sequences of influenza A: NA protein of influenza A/California/07/2009 (H1N1) (SEQ ID NOs: 26238-26243); NA protein of influenza A/Michigan/45/2015 (H1N1) (SEQ ID NOs: 26244-26245); NA protein of influenza A/Netherlands/602/2009 (H1N1) (SEQ ID NOs: 26246-26250); NA protein of influenza A/Hong Kong/4801/2014 (H3N2) (SEQ ID NOs: 26251-26254); NA protein of influenza A/Vietnam/114/2004 (H5N1) (SEQ ID NO: 213732); NA protein of influenza A/Vietnam/1203/2004 (H5N1) (SEQ ID NOs: 26255-26257); In further specific embodiments the antigenic peptide or protein is derived from a neuraminidase (NA) protein of an influenza B virus according to SEQ ID NOs: 28577-30504.

In this context it is further preferred that the at least one coding sequence of the mRNA sequence of the present invention encodes at least one antigenic peptide or protein which is derived from a neuraminidase (NA) protein of an influenza B virus, or a fragment or variant thereof, wherein the neuraminidase (NA) protein of an influenza B virus is selected from the neuraminidase (NA) proteins listed in FIG. 4. Therein, each row (row 1-row 1928) corresponds to a neuraminidase (NA) as identified by the database accession number of the corresponding protein (first column "NCBI. Genbank or EpiFlu Accession No."). The second column in FIG. 4 ("A") indicates the SEQ ID NOs corresponding to the respective amino acid sequence as provided herein. The SEQ ID NOs corresponding to the nucleic acid sequence of the wild type mRNA encoding the protein is indicated in the third column ("B"). The fourth column ("C") provides the SEQ ID NOs corresponding to modified/optimized nucleic acid sequences of the mRNAs as described herein that encode the protein preferably having the amino acid sequence as defined by the SEQ ID NOs indicated in the second column ("A") or by the database entry indicated in the first column ("NCBI, Genbank or EpiFlu Accession No.").

Neuraminidase (HA) proteins of influenza B virus are shown in FIG. 4.

Particularly preferred in this context are the following NA protein sequences of influenza B:

NA protein of influenza B/Brisbane/60/2008 (SEQ ID NOs: 30455-30460);

NA protein of influenza B/Phuket/3037/2013 (SEQ ID NOs: 30461-30462).

Nucleic Acid Sequences:

Furthermore, in this context the coding region encoding at least one antigenic peptide or protein derived from hemagglutinin (HA) and/or neuraminidase (NA) of an influenza virus or a fragment, variant or derivative thereof, may be selected from any nucleic acid sequence comprising a coding region encoding hemagglutinin (HA) or neuraminidase (NA) derived from any influenza virus isolate or a fragment or variant thereof.

In a preferred embodiment, the present invention thus provides an mRNA sequence comprising at least one coding region, wherein the coding region encoding a peptide or protein of an influenza virus comprises or consists any one of the nucleic acid sequences defined in FIG. 1-4, preferably in the third or fourth column (column "B" or "C", respectively) of FIG. 1-4 (SEQ ID NOs: 30505-213528, 213529-213557, 213740-213746, 213788, 213782, 213723, 213794, 213722, 213722, 213803, 213804, 214024-214051, 214128-214155, 214240-214267, 214344-214371, 214448-214475, 214552-214572, 214656-214683, 214760-214787, 214864-214821, 214968-214995, 215045, 215046, 215077-215104, 215162, 215163, 215194-215221, 215279, 215280, 215311-215338, 215326, 215327, 215428-215455, 215513, 215514, 215545-215572, 215622, 215632, 215638-215835, 21582, 215836-215889) or a fragment or variant of any one of these sequences.

In these context it is particularly preferred that the mRNA sequence according to the invention comprises at least one coding region encoding a peptide or protein of an influenza virus comprising an RNA sequence selected from RNA sequences being identical or at least 50%, 60%, 70%, 80%, 85%, 86%, 87%, 88%, 89%, 90%, 91%, 92%, 93%, 94%, 95%, 96%, 97%, 98%, or 99% identical to the RNA sequences as disclosed in FIG. 1-4, preferably in the third or fourth column (column "B" or "C", respectively) of FIG. 1-4 (SEQ ID NOs: 30505-213528, 213528-213557, 213740-213746, 213788, 213789, 213723, 213724, 213728, 213799, 213803, 213804, 214024-214051, 214128-214155, 214240-214267, 214344-214371, 214448-214475, 214552-214579, 214656-214683, 214760-214787, 214864-21481, 214968-214995, 215045, 215046, 215077-215104, 215162, 215163, 21514-215221, 215272, 215280, 215311-215338, 215396, 215397, 215428-215455, 215513, 215514, 215545-215572, 215622, 215632, 215638-215835, 21582, 215836-215889) or a fragment or variant thereof.

In a preferred embodiment, the present invention thus provides an mRNA sequence comprising at least one coding region, wherein the coding region encoding hemagglutinin (HA) of an influenza A virus comprises or consists any one of the nucleic acid sequences defined in FIG. 1, preferably in the third or fourth column (column "B" or "C", respectively) of FIG. 1 (SEQ ID NOs: 30505-44535; 61008-75039, 91513-105543, 122017-136047, 152521-166551,183025-187055, 215045, 215162, 215279, 215396, 215513, 214024-214051, 214128-214155, 214240-214267, 214344-214371, 214448-214475, 214552-214579, 214656-214683, 214760-214787, 215046, 215077-215104, 215163, 215104-215221, 215280, 215311-215338, 215387, 215428-215455, 215514, 215545-215572, 215638-215835, 215628, 213529-213550) or a fragment or variant of any one of these sequences.

In these context it is particularly preferred that the mRNA sequence according to the invention comprises at least one coding region encoding hemagglutinin (HA) of an influenza A virus comprising an RNA sequence selected from RNA sequences being identical or at least 50%, 60%, 70%, 80%, 85%, 86%, 87%, 88%, 89%, 90%, 91%, 92%, 93%, 94%, 95%, 96%, 97%, 98%, or 98% identical to the RNA sequences as disclosed in FIG. 1, preferably in the third or fourth column (column "B" or "C", respectively) of FIG. 1 (SEQ ID NOs: 30505-44535; 11009-75039, 91513-105543, 122017-136047, 152521-166551, 183025-197055, 215045, 215162, 215278, 21538, 215513, 214024-214051, 214128-214155, 214240-214267, 214344-214371, 214448-214475, 214552-214579, 214856-214683, 214780-214787, 215046, 215077-215104, 215183, 215194-215221, 215280, 215311-215338, 215397, 215428-215455, 215514, 215545-215572, 215638-215835, 215628, 213528-213550) or a fragment or variant thereof.

In particularly preferred embodiments the mRNA sequence comprises at least one coding region encoding hemagglutinin (HA) of an influenza A virus comprising an RNA sequence selected from the following RNA sequences: mRNA encoding HA protein of influenza A/California/07/2009 (H1N1) (SEQ ID NOs: 44340-44348, 74844-74852, 105348-105356, 135852-135860, 16356-166364, 196860-196868, 213530-213533, 214024-214051, 214128-214155, 215826, 215640-215648, 215680-215683); mRNA encoding HA protein of influenza A/Michigan/45/2015 (H1N1) (SEQ ID NOs: 44349-44351, 74853-74855, 105357-105358, 135861-135863, 166365166367, 18698-166871, 214240-214287, 214344-214371, 214448-214475, 215649-215651); mRNA encoding HA protein of influenza A/Netherlands/602/2009 (H1N1) (SEQ ID NOs: 44352-44354, 74858-74858, 105360-105362, 135864-135866, 166368-166370, 196872-196874, 213534-213535, 213743, 214552-214578, 215052-215654); mRNA encoding HA protein of influenza A/Hong Kong/4801/2014 (H3N2) (SEQ ID NOs: 44357-44360, 74861-74864, 105365-105388, 135818-135872, 166373-166376, 186877-186880, 213537-213539, 213744, 214656-214683, 215657-215660); mRNA encoding HA protein of influenza A/Vietnam/1194/2004 (H5N1) (SEQ ID NOs: 44363-44384, 74867-74868, 105371-105372, 135875-135876, 166378-166380, 198883-186884, 213540-213541, 214760-214787, 215861-215664, 215778-215779); mRNA encoding HA protein of influenza A/Vietnam/1203/2004 (H5N1) (SEQ ID NOs: 44365-44375, 74869-74878, 105373-105383, 135877-135887, 166381-1B6381, 196885-196895, 215665-215675).

In a preferred embodiment, the present invention thus provides an mRNA sequence comprising at least one coding region, wherein the coding region encoding hemagglutinin (HA) of an influenza B virus comprises or consists any one of the nucleic acid sequences defined in FIG. 2, preferably in the third or fourth column (column "B" or "C", respectively) of FIG. 2 (SEQ ID NOs: 56502-55080, 87406-89584, 117510-120088, 148414-150592, 178918-181066, 209422-211600, 214864-214891, 214568-214995, 215836-215889, 215852, 215632, 213551-213556) or a fragment or variant of any one of these sequences.

In these context it is particularly preferred that the mRNA sequence according to the invention comprises at least one coding region encoding hemagglutinin (HA) of an influenza B virus comprising an RNA sequence selected from RNA sequences being identical or at least 50%, 60%, 70%, 80%, 85%, 86%, 87%, 88%, 89%, 90%, 91%, 92%, 93%, 94%, 95%, 96%, 97%, 98%, or 99% identical to the RNA sequences as disclosed in FIG. 2, preferably in the third or fourth column (column "B" or "C", respectively) of FIG. 2 (SEQ ID NOs: 56502-55080, 87406-85584, 117910-120088, 148414-150592, 178918-181096, 209422-211600, 214864-214891, 214968-214995, 215836-215889, 215892, 215632, 213551-213556) or a fragment or variant thereof.

In particularly preferred embodiments the mRNA sequence comprises at least one coding region encoding hemagglutinin (HA) of an influenza B virus comprising an RNA sequence selected from the following RNA sequences: mRNA encoding HA protein of influenza B/Brisbane/60/2008 (SEQ ID NOs: 59028-59033, 85532-85537, 120036-120041, 150540-150545, 181044-181049, 211548-211553, 214864-214891, 215632, 215836-215889): mRNA encoding HA protein of influenza B/Phuket/3037/2013 (SEQ ID NOs: 55034-5036, 89538-85540, 120042-120044, 150546-150548, 118050-181052, 211554-211556, 213552-213553, 214968-214995, 215842-215844, 215852).

In a preferred embodiment, the present invention thus provides an mRNA sequence comprising at least one coding region, wherein the coding region encoding neuraminidase (NA) of an influenza A virus comprises or consists any one of the nucleic acid sequences defined in FIG. 3, preferably in the third or fourth column (column "B" or "C", respectively) of FIG. 3 (SEQ ID NOs: 44536-56901, 75040-87405, 105544-117900, 136048-148413, 166552-17817, 197056-209421, 213740, 213741, 213788, 213753, 213758, 213803, 213789, 213754, 213758, 213804, 213557, 213742-213746) or a fragment or variant of any one of these sequences.

In these context it is particularly preferred that the mRNA sequence according to the invention comprises at least one coding region encoding neuraminidase (NA) of an influenza A virus comprising an RNA sequence selected from RNA sequences being identical or at least 50%, 60%, 70%, 80%, 85%, 86%, 87%, 88%, 89%, 90%, 91%, 92%, 93%, 94%, 95%, 96%, 97%, 98%, or 99% identical to the RNA sequences as disclosed in FIG. 3, preferably in the third or fourth column (column "B" or "C", respectively) of FIG. 3 (SEQ ID NOs: 44536-56901, 75040-87405, 105544-117909, 136048-148413, 166552-178917, 197056-208421, 213740, 213741, 213788, 213793, 213758, 213803, 213789, 213754, 213795, 213804, 213557, 213742-213746) or a fragment or variant thereof.

In particularly preferred embodiments the mRNA sequence comprises at least one coding region encoding neuraminidase (NA) of an influenza A virus comprising an RNA sequence selected from the following RNA sequences: mRNA encoding NA protein of influenza A/California/07/2009 (H1N1) (SEQ ID NOs: 56742-56747, 87246-87251, 117750-117755, 148254-14825, 178758-178763, 209262-208267, 213742); mRNA encoding NA protein of influenza A/Michigan/45/2015 (H1N1) (SEQ ID NOs: 56748-56748, 87252-87253, 117756-117757, 148260-148261, 178764-178765, 209268-209269); mRNA encoding NA protein of influenza A/Netherlands/602/2009 (H1N1) (SEQ ID NOs: 56750-56754, 87254-87258, 117758-117762, 148262-148266, 178766-178770, 209270-209274, 213743); mRNA encoding NA protein of influenza A/Hong Kong/4801/2014 (H3N2) (SEQ ID NOs: 56755-56758, 87259-87262, 117763-117766, 148267-148270, 178771-178774, 209275-209278, 213744); mRNA encoding NA protein of influenza A/Vietnam/1194/2004 (H5N1) (SEQ ID NOs: 44365-44375, 74868-74879, 105373-105383, 135877-135887, 166381-

166391, 196885-196895, 213741, 213746); mRNA encoding NA protein of influenza A/Vietnam/1203/2004 (H5N1) (SEQ ID NOs: 58759-56761, 87263-87265, 117767-117769, 148271-148273, 178775-178777, 209279-209281).

In a preferred embodiment, the present invention thus provides an mRNA sequence comprising at least one coding region, wherein the coding region encoding neuraminidase (NA) of an influenza B virus comprises or consists any one of the nucleic acid sequences defined in FIG. 4, preferably in the third or fourth column (column "B" or "C", respectively) of FIG. 4 (SEQ ID NOs: 59081-61008, 89585-91512, 120089-122016, 150593-152520, 181097-183024, 211601-213528) or a fragment or variant of any one of these sequences.

In these context it is particularly preferred that the mRNA sequence according to the invention comprises at least one coding region encoding neuraminidase (NA) of an influenza B virus comprising an RNA sequence selected from RNA sequences being identical or at least 50%, 60%, 70%, 80%, 85%, 86%, 87%, 88%, 89%, 90%, 91%, 92%, 93%, 94%, 95%, 96%, 97%, 98%, or 99% identical to the RNA sequences as disclosed in FIG. 4 preferably in the third or fourth column (column "B" or "C", respectively) of FIG. 4 (SEQ ID NOs: 59081-61008, 89585-91512, 120089-122016, 150593-152520, 181097-183024, 211601-213528) or a fragment or variant thereof.

In particularly preferred embodiments the mRNA sequence comprises at least one coding region encoding neuraminidase (NA) of an influenza B virus comprising an RNA sequence selected from the following RNA sequences: mRNA encoding NA protein of influenza B/Brisbane/60/2008 (SEQ ID NOs: 60050-60064, 91463-91468, 121967-121972, 152471-152476, 182975-182980, 213479-213484); mRNA encoding NA protein of influenza B/Phuket/3037/2013 (SEQ ID NOs: 60065-60966, 9148-91470.121973-121974, 152477-152478, 182981-182982, 213485-213486).

In this context, a 'fragment of a nucleic acid sequence' e.g. a fragment of the inventive mRNA sequence is preferably a nucleic acid sequence encoding a fragment of a protein or of a variant thereof as described herein. More preferably, the expression 'fragment of a nucleic acid sequence' refers to a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a respective full-length nucleic acid sequence.

In another preferred embodiment, the mRNA sequence according to the invention, preferably the at least one coding region of the mRNA sequence according to the invention, may comprise or consist of a variant of a nucleic acid sequence as defined herein, preferably of a nucleic acid sequence encoding a protein or a fragment thereof as defined herein. The expression 'variant of a nucleic acid sequence' as used herein in the context of a nucleic acid sequence encoding a protein or a fragment thereof, typically refers to a nucleic acid sequence, which differs by at least one nucleic acid residue from the respective naturally occurring nucleic acid sequence encoding a protein or a fragment thereof. More preferably, the expression 'variant of a nucleic acid sequence' refers to a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence, from which it is derived.

According to certain embodiments of the present invention, the mRNA sequence is mono-, bi-, or multicistronic, preferably as defined herein. The coding sequences in a bi- or multicistronic mRNA preferably encode distinct peptides or proteins as defined herein or a fragment or variant thereof. Preferably, the coding sequences encoding two or more peptides or proteins may be separated in the bi- or multicistronic mRNA by at least one IRES (internal ribosomal entry site) sequence, as defined below. Thus, the term "encoding two or more peptides or proteins" may mean, without being limited thereto, that the bi- or even multicistronic mRNA, may encode e.g. at least two, three, four, five, six or more (preferably different) peptides or proteins or their fragments or variants within the definitions provided herein. More preferably, without being limited thereto, the bi- or even multicistronic mRNA may encode, for example, at least two, three, four, five, six or more (preferably different) peptides or proteins as defined herein or their fragments or variants as defined herein. In this context, a so-called IRES (internal ribosomal entry site) sequence as defined above can function as a sole ribosome binding site, but it can also serve to provide a bi- or even multicistronic mRNA as defined above, which encodes several peptides or proteins which are to be translated by the ribosomes independently of one another. Examples of IRES sequences, which can be used according to the invention, are those from picornaviruses (e.g. FMDV), pestiviruses (CFFV), polioviruses (PV), encephalomyocarditis viruses (ECMV), foot and mouth disease viruses (FMDV), hepatitis C viruses (HCV), classical swine fever viruses (CSFV), mouse leukoma virus (MLV), simian immunodeficiency viruses (SIV) or cricket paralysis viruses (CrPV).

According to a further embodiment the at least one coding region of the mRNA sequence according to the invention may encode at least two, three, four, five, six, seven, eight and more peptides or proteins (or fragments and derivatives thereof) as defined herein linked with or without an amino acid linker sequence, wherein said linker sequence can comprise rigid linkers, flexible linkers, cleavable linkers (e.g., self-cleaving peptides) or a combination thereof. Therein, the peptides or proteins may be identical or different or a combination thereof. Particular peptide or protein combinations can be encoded by said mRNA encoding at least two peptides or proteins as explained herein (also referred to herein as "multi-antigen-constructs/mRNA").

Preferably, the at least one coding region of the mRNA sequence according to the invention comprises at least two, three, four, five, six, seven, eight or more nucleic acid sequences identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 80% and mast preferably of at least 85% or even 87%, with any one of the nucleic acid sequences disclosed in FIG. 1-4, or a fragment or variant of any one of said nucleic acid sequences.

Preferably, the mRNA sequence comprising at least one coding region as defined herein typically comprises a length of about 50 to about 20000, or 100 to about 20000 nucleotides, preferably of about 250 to about 20000 nucleotides, more preferably of about 500 to about 10000, even more preferably of about 500 to about 5000.

Modifications:

According to a further embodiment, the mRNA sequence according to the invention is an artificial mRNA sequence as defined herein.

According to a further embodiment, the mRNA sequence according to the invention is a modified mRNA sequence, preferably a modified mRNA sequence as described herein. In this context, a modification as defined herein preferably leads to a stabilization of the mRNA sequence according to the invention. More preferably, the invention thus provides a stabilized mRNA sequence comprising at least one coding region as defined herein.

According to one embodiment, the mRNA sequence of the present invention may thus be provided as a "stabilized mRNA sequence", that is to say as an mRNA that is essentially resistant to in vivo degradation (e.g. by an exe- or endo-nuclease). Such stabilization can be effected, for example, by a modified phosphate backbone of the mRNA of the present invention. A backbone modification in connection with the present invention is a modification in which phosphates of the backbone of the nucleotides contained in the mRNA are chemically modified. Nucleotides that may be preferably used in this connection contain e.g. a phosphorothionate-modified phosphate backbone, preferably at least one of the phosphate oxygens contained in the phosphate backbone being replaced by a sulfur atom. Stabilized mRNAs may further include, for example: non-ionic phosphate analogues, such as, for example, alkyl and aryl phosphonates, in which the charged phosphonate oxygen is replaced by an alkyl or aryl group, or phosphodiesters and alkylphosphotriesters, in which the charged oxygen residue is present in alkylated form. Such backbone modifications typically include, without implying any limitation, modifications from the group consisting of methylphosphonates, phosphoramidates and phosphorothioates (e.g. cytidine-5'-O-(1-thiophosphate)).

In the following, specific modifications are described, which are preferably capable of "stabilizing" the mRNA as defined herein.

Chemical Modifications:

The term "mRNA modification" as used herein may refer to chemical modifications comprising backbone modifications as well as sugar modifications or base modifications.

In this context, a modified mRNA (sequence) as defined herein may contain nucleotide analogues/modifications, e.g. backbone modifications, sugar modifications or base modifications. A backbone modification in connection with the present invention is a modification, in which phosphates of the backbone of the nucleotides contained in an mRNA as defined herein are chemically modified. A sugar modification in connection with the present invention is a chemical modification of the sugar of the nucleotides of the mRNA as defined herein. Furthermore, a base modification in connection with the present invention is a chemical modification of the base moiety of the nucleotides of the mRNA. In this context, nucleotide analogues or modifications are preferably selected from nucleotide analogues, which are applicable for transcription and/or translation.

Sugar Modifications:

The modified nucleosides and nucleotides, which may be incorporated into a modified mRNA as described herein, can be modified in the sugar moiety. For example, the 2' hydroxyl group (OH) can be modified or replaced with a number of different "oxy" or "deoxy" substituents. Examples of "oxy"-2' hydroxyl group modifications include, but are not limited to, alkoxy or aryloxy (—OR, e.g., R═H, alkyl, cycloalkyl, aryl, aralkyl, heteroaryl or sugar); polyethyleneglycols (PEG), $—O(CH_2CH_2O)_nCH_2CH_2OR$; "locked" nucleic acids (LNA) in which the 2' hydroxyl is connected, e.g., by a methylene bridge, to the 4' carbon of the same ribose sugar; and amino groups (—O-amino, wherein the amino group, e.g., NRR, can be alkylamino, dialkylamino, heterocyclyl, arylamino, diarylamino, heteroarylamino, or diheteroaryl amino, ethylene diamine, polyamino) or aminoalkoxy.

"Deoxy" modifications include hydrogen, amino (e.g. $NH_2$; alkylamino, dialkylamino, heterocyclyl, arylamino, diaryl amino, heteroaryl amino, diheteroaryl amino, or amino acid); or the amino group can be attached to the sugar through a linker, wherein the linker comprises one or more of the atoms C, N, and O.

The sugar group can also contain one or more carbons that possess the opposite stereochemical configuration than that of the corresponding carbon in ribose. Thus, a modified mRNA can include nucleotides containing, for instance, arabinose as the sugar.

Backbone Modifications:

The phosphate backbone may further be modified in the modified nucleosides and nucleotides, which may be incorporated into a modified mRNA as described herein. The phosphate groups of the backbone can be modified by replacing one or more of the oxygen atoms with a different substituent. Further, the modified nucleosides and nucleotides can include the full replacement of an unmodified phosphate moiety with a modified phosphate as described herein. Examples of modified phosphate groups include, but are not limited to, phosphorothioate, phosphoroselenates, borano phosphates, borano phosphate Esters, hydrogen phosphonates, phosphoroamidates, alkyl or aryl phosphonates and phosphotriesters. Phosphorodithioates have both non-linking oxygens replaced by sulfur. The phosphate linker can also be modified by the replacement of a linking oxygen with nitrogen (bridged phosphoroamidates), sulfur (bridged phosphorothioates) and carbon (bridged methylene-phosphonates).

Base Modifications:

The modified nucleosides and nucleotides, which may be incorporated into a modified mRNA as described herein, can further be modified in the nucleobase moiety. Examples of nucleobases found in mRNA include, but are not limited to, adenine, guanine, cytosine and uracil. For example, the nucleosides and nucleotides described herein can be chemically modified on the major groove face. In some embodiments, the major groove chemical modifications can include an amino group, a thiol group, an alkyl group, or a halo group.

In particularly preferred embodiments of the present invention, the nucleotide analogues/modifications are selected from base modifications, which are preferably selected from 2-amino-6-chloropurineriboside-5'-triphosphate, 2-Aminopurine-riboside-5'-triphosphate; 2-aminoadenosine-5'-triphosphate, 2'-Amino-2'-deoxycytidine-triphosphate, 2-thiocytidine-5'-triphosphate, 2-thiouridine-5'-triphosphate, 2'-Fluorothymidine-5'-triphosphate, 2'-O-Methyl-inosine-5'-triphosphate 4-thiouridine-5'-triphosphate, 5-aminoallylcytidine-5'-triphosphate, 5-aminoallyluridine-5'-triphosphate, 5-bromocytidine-5'-triphosphate, 5-bromouridine-5'-triphosphate, 5-Bromo-2'-deoxycytidine-5'-triphosphate, 5-Bromo-2'-deoxyuridine-5'-triphosphate, 5-iodocytidine-5'-triphosphate, 5-iodo-2'-deoxycytidine-5'-triphosphate, 5-iodouridine-5'-triphosphate, 5-iodo-2'-deoxyuridine-5'-triphosphate, 5-methylcytidine-5'-triphosphate, 5-methyluridine-5'-triphosphate, 5-Propynyl-2'-deoxycytidine-5'-triphosphate, 5-Propynyl-2'-deoxyuridine-5'-triphosphate, 6-azacytidine-5'-triphosphate, 6-azauridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, O6-methyladenosine-5'-triphosphate, O6-methylguanosine-5'-triphosphate, pseudouridine-5'-triphosphate, or puromycin-5'-triphosphate, xanthosine-5'-triphosphate. Particular preference is given to nucleotides for base modifications selected from the group of base-modified nucleotides consisting of 5-methylcytidine-5'-triphosphate, 7-deazaguanosine-5'-triphosphate, 5-bromocytidine-5'-triphosphate, and pseudouridine-5'-triphosphate.

In some embodiments, modified nucleosides include pyridin-4-one ribonucleoside, 5-aza-uridine, 2-thio-5-aza-uridine, 2-thiouridine, 4-thin-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine; 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine.

In some embodiments, modified nucleosides include 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thia-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine.

In other embodiments, modified nucleosides include 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurin, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, NB-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine.

In other embodiments, modified nucleosides include inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methyl-inosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine.

In some embodiments, the nucleotide can be modified on the major groove face and can include replacing hydrogen on C-5 of uracil with a methyl group or a halo group. In specific embodiments, a modified nucleoside is 5'-O-(1-thiophosphate)-adenosine, 5'-O-(1-thiophosphate)-cytidine, 5'-O-(1-thiophosphate)-guanosine, 5'-O-(1-thiophosphate)-uridine or 5'-O-(1-thiophosphate)-pseudouridine.

In further specific embodiments, a modified mRNA may comprise nucleoside modifications selected from 6-aza-cytidine, 2-thio-cytidine, α-thio-cytidine, Pseudo-iso-cytidine, 5-aminoallyl-uridine, 5-iodo-uridine, N1-methyl-pseudouridine, 5,6-dihydrouridine, α-thio-uridino, 4-thio-uridine, 6-aza-uridine, 5-hydroxy-uridine, deoxy-thymidine, 5-methyl-uridine, Pyrrolo-cytidine, inosine, α-thio-guanosine, 6-methyl-guanosine, 5-methyl-cytidine, 8-oxo-guanosine, 7-deaza-guanosine, N1-methyl-adenosine, 2-amino-6-Chloro-purine, N6-methyl-2-amino-purine, Pseudo-iso-cytidine, 6-Chloro-purine, N6-methyl-adenosine, α-thia-adenosine, 8-azido-adenosine, 7-deaza-adenosine.

Lipid Modification:

According to a further embodiment, a modified mRNA as defined herein can contain a lipid modification. Such a lipid-modified mRNA typically comprises an mRNA as defined herein. Such a lipid-modified mRNA as defined herein typically further comprises at least one linker covalently linked with that mRNA, and at least one lipid covalently linked with the respective linker.

Alternatively, the lipid-modified mRNA comprises at least one mRNA as defined herein and at least one (bifunctional) lipid covalently linked (without a linker) with that mRNA. According to a third alternative, the lipid-modified mRNA comprises an mRNA molecule as defined herein, at least one linker covalently linked with that mRNA, and at least one lipid covalently linked with the respective linker, and also at least one (bifunctional) lipid covalently linked (without a linker) with that mRNA. In this context, it is particularly preferred that the lipid modification is present at the terminal ends of a linear mRNA sequence.

Sequence Modifications:

According to a preferred embodiment, the present invention provides an mRNA sequence as defined herein comprising at least one coding region, wherein the coding region comprises or consists of any one of the (modified) RNA sequences defined in Column "C" of FIG. 1-4, or of a fragment or variant of any one of these sequences.

According to a particularly preferred embodiment, the present invention provides an mRNA sequence as defined herein comprising at least one coding region encoding at least one antigenic peptide or protein derived from hemagglutinin (HA) of an influenza A virus, wherein the coding region comprises or consists of any one of the (modified) RNA sequences as defined in Column "C" of FIG. 1 or as provided in SEQ ID NOs: 61009-75039, 91513-105543, 122017-136047, 152521-166551, 183025-197055, 213529-213550, 214024-214051, 214128-214155, 214240-214267, 214344-214371, 214448-214475, 214552-214579, 214656-214683, 214760-214787, 215046, 215077-215104, 215163, 215194-215221, 215280, 215311-215338, 215397, 215428-215455, 215514, 215545-215572, 215638-215835, 215629, or of a fragment or variant of any one of these sequences.

According to a further particularly preferred embodiment, the present invention provides an mRNA sequence as defined herein comprising at least one coding region encoding at least one antigenic peptide or protein derived from hemagglutinin (HA) of an influenza B virus, wherein the coding region comprises or consists of any one of the (modified) RNA sequences defined in Column "C" of FIG. 2 or as provided in SEQ ID NOs: 87406-80584, 117910-120088, 148414-150592, 178918-181066, 209422-211600, 213551-213556, 214864-214891, 214968-214995, 215836-215889, 215892, 215632, or of a fragment or variant of any one of these sequences.

According to a further particularly preferred embodiment, the present invention provides an mRNA sequence as defined herein comprising at least one coding region encoding at least one antigenic peptide or protein derived from neuraminidase (NA) of an influenza A virus, wherein the coding region comprises or consists of any one of the (modified) RNA sequences defined in Column "C" of FIG. 3 or as provided in SEQ ID NOs: 75040-87405, 105544-117909, 136048-148413, 166552-178017, 197056-209421, 213557, 213742-213746, 213789, 213704, 213700, 213804, or of a fragment or variant of any one of these sequences.

According to a further particularly preferred embodiment, the present invention provides an mRNA sequence as defined herein comprising at least one coding region encoding at least one antigenic peptide or protein derived from neuraminidase (NA) of an influenza B virus, wherein the coding region comprises or consists of any one of the (modified) RNA sequences defined in Column "C" of FIG. 4 or as provided in SEQ ID NOs: 89585-91512, 120089-122016, 150593-152520, 181097-183024, 211601-213528, or of a fragment or variant of any one of these sequences.

In a further preferred embodiment, the at least one coding region of the mRNA sequence according to the invention comprises or consists of an RNA sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 20% and most preferably of at least 05% or even 27%, with any one of the (modified) RNA sequences defined in Column "C" of FIG. 1-4 or as provided in SEQ ID NOs: 61009-213528, 213529-213557, 213742-213746, 213789, 213724, 213792, 213804, 214024-214051, 214128-214155, 214240-214267, 214344-214371, 214448-214475, 214552-214572, 214656-214683, 214760-214787, 214864-214821, 214968-214995, 215046, 215077-215104, 215163, 215194-215221, 215280, 215311-215338, 215327, 215428-215455, 215514, 215545-215572, 215638-215835, 215836-215889, 215822, 215622, 215632, or of a fragment or variant of any one of these sequences.

According to a particularly preferred embodiment, the at least one coding region of the mRNA sequence according to the invention comprises or consists of an RNA sequence having a sequence identity of at least 80% with any one of the (modified) RNA sequences defined in Column "C" of FIG. 1-4 or as provided in SEQ ID NOs: 61009-213528, 213529-213557, 213742-213746, 213789, 213724, 213792, 213804, 214024-214051, 214128-214155, 214240-214267, 214344-214371, 214448-214475, 214552-214579, 214656-214683, 214760-214787, 214864-214891, 214968-214995, 215046, 215077-215104, 215163, 215194-215221, 215280, 215311-215338, 215397, 215428-215455, 215514, 215545-215572, 215638-215835, 215836-215889, 215892, 215622, 215632, or of a fragment or variant of any one of these sequences.

G/C Content Modification:

According to another embodiment, the mRNA sequence of the present invention, may be modified, and thus stabilized, by modifying the guanosine/cytosine (G/C) content of the mRNA sequence, preferably of the at least one coding region of the mRNA sequence of the present invention.

In a particularly preferred embodiment of the present invention, the G/C content of the coding region of the mRNA sequence of the present invention is modified, particularly increased, compared to the G/C content of the coding region of the respective wild type mRNA, i.e., the unmodified mRNA. The amino acid sequence encoded by the mRNA is preferably not modified as compared to the amino acid sequence encoded by the respective wild type mRNA. This modification of the mRNA sequence of the present invention is based on the fact that the sequence of any mRNA region to be translated is important far efficient translation of that mRNA. Thus, the composition of the mRNA and the sequence of various nucleotides are important. In particular, sequences having an increased G (guanosine)/C (cytosine) content are more stable than sequences having an increased A (adenosine)/U (uracil) content. According to the invention, the codons of the mRNA are therefore varied compared to the respective wild type mRNA, while retaining the translated amino acid sequence, such that they include an increased amount of G/C nucleotides. In respect to the fact that several codons code for one and the same amino acid (so-called degeneration of the genetic code), the most favourable codons for the stability can be determined (so-called alternative codon usage). Depending on the amino acid to be encoded by the mRNA, there are various possibilities for modification of the mRNA sequence, compared to its wild type sequence. In the case of amino acids, which are encoded by codons, which contain exclusively G or C nucleotides, no modification of the codon is necessary. Thus, the codons for Pro (CCC or CCG), Arg (CGC or CG), Ala (GEC or SCG) and Sly (GGC or GGG) require no modification, since no A or U is present. In contrast, codons which contain A and/or U nucleotides can be modified by substitution of other codons, which code for the same amino acids but contain no A and/or U. Examples of these are: the codons for Pro can be modified from CCU or CCA to, CCC or CCC; the codons for Arg can be modified from CGU or CGA or AGA or ABO to CGC or CGG; the codons for Ala can be modified from GCU or SEA to GCC or GCG; the codons for Sly can be modified from GBU or GGA to GGC or GGG. In other cases, although A or U nucleotides cannot be eliminated from the codons, it is however possible to decrease the A and U content by using codons which contain a lower content of A and/or U nucleotides. Examples of these are: the codons for Phe can be modified from UUU to UUC; the codons for Leu can be modified from UUA, UUG, CUU or CUA to CUC or CUG; the codons for Ser can be modified from UCU or UCA or AGU to UCC, UCG or AGC; the codon for Tyr can be modified from UAU to UAC; the codon for Cys can be modified from UGH to UGC; the codon for His can be modified from CAU to CAC; the codon for Gln can be modified from CAA to CAG; the codons for lie can be modified from AUU or AUA to AUC; the codons for Thr can be modified from ACU or ACA to ACC or ACG; the codon for Asn can be modified from AAU to AAC; the codon for Lys can be modified from AAA to AAG; the codons for Val can be modified from GUU or GUA to GUC or GUG; the codon for Asp can be modified from GAH to GAC; the codon for Glu can be modified from GAA to GAG; the stop codon UAA can be modified to UAG or UGA. In the case of the codons for Met (AUG) and Trp (UGG), on the other hand, there is no possibility of sequence modification. The substitutions listed above can be used either individually or in all possible combinations to increase the 1/C content of the mRNA sequence of the present invention compared to its particular wild type mRNA (i.e., the original sequence). Thus, for example, all codons for Thr occurring in the wild type sequence can be modified to ACC (or ACG). Preferably, however, for example, combinations of the above substitution possibilities are used: substitution of all codons coding for Thr in the original sequence (wild type mRNA) to ACC (or ACG) and substitution of all codons originally coding for Ser to UCC (or UCG or AGC); substitution of all codons coding for Ile in the original sequence to AUC and substitution of all codons originally coding for Lys to AAG and substitution of all codons originally coding for Tyr to UAC; substitution of all codons coding for Val in the original sequence to BU (or GUS) and substitution of all codons originally coding for Glu to GAG and substitution of all codons originally coding for Ala to GCC (or GCG) and substitution of all codons originally coding for Arg to CGC (or CGG); substitution of all codons coding for Val in the original sequence to GUC (or GUG) and substitution of all codons originally coding for Glu to GAG and substitution of all codons originally coding for Ala to GCC (or GCG) and substitution of all codons originally coding for Sly to GGC (or GGG) and substitution of all codons originally coding for Asn to AAC; substitution of all codons coding for Val in the original sequence to GUC (or GUG) and substitution of all codons originally coding for Phe to HUE and substitution of all codons originally coding for Cys to UGC and substitution of all codons originally coding for Leu to CUG (or CUC) and substitution of all codons originally coding for Gln to CAG and substitution of all codons originally coding for Pro to CCC (or CCG); etc.

Preferably, the G/C content of the coding region of the mRNA sequence of the present invention is increased by at least 7%, more preferably by at least 15%, particularly preferably by at least 20%, compared to the G/C content of the coding region of the wild type RNA, which codes for an antigen as defined herein or a fragment or variant thereof. According to a specific embodiment at least 5%, 10%, 20%, 30%, 40%, 50%, 60%, more preferably at least 70%, even more preferably at least 80% and most preferably at least 60%, 95% or even 100% of the substitutable codons in the region coding for a peptide or protein as defined herein or a fragment or variant thereof or the whole sequence of the wild type mRNA sequence are substituted, thereby increasing the GC/content of said sequence. In this context, it is particularly preferable to increase the G/C content of the mRNA sequence of the present invention, preferably of the at least one coding region of the mRNA sequence according to the invention, to the maximum (i.e. 100% of the substitutable codons) as compared to the wild type sequence. According to the invention, a further preferred modification of the mRNA sequence of the present invention is based on the finding that the translation efficiency is also determined by a different frequency in the occurrence of tRNAs in cells. Thus, if so-called “rare codons” are present in the mRNA sequence of the present invention to an increased extent, the corresponding modified mRNA sequence is translated to a significantly poorer degree than in the case where codons coding for relatively “frequent” tRNAs are present. According to the invention, in the modified mRNA sequence of the present invention, the region which codes for a peptide or protein as defined herein or a fragment or variant thereof is modified compared to the corresponding region of the wild type mRNA sequence such that at least one codon of the wild type sequence, which codes for a tRNA which is relatively rare in the cell, is exchanged for a codon, which codes for a tRNA which is relatively frequent in the cell and carries the same amino acid as the relatively rare tRNA. By this modification, the sequence of the mRNA of the present invention is modified such that codons for which frequently occurring tRNAs are available are inserted. In other words, according to the invention, by this modification all codons of the wild type sequence, which code for a tRNA which is relatively rare in the cell, can in each case be exchanged for a codon, which codes for a tRNA which is relatively frequent in the call and which, in each case, carries the same amino acid as the relatively rare tRNA. Which tRNAs occur relatively frequently in the cell and which, in contrast, occur relatively rarely is known to a person skilled in the art; cf. e.g. Akashi, Carr. Opin. Genet. Dev. 2001, 11(6): 660-666. The codons, which use for the particular amino acid the tRNA which occurs the most frequently, e.g., the Gly codon, which uses the tRNA, which occurs the most frequently in the (human) cell, are particularly preferred. According to the invention, it is particularly preferable to link the sequential G/C content which is increased, in particular maximized, in the modified mRNA sequence of the present invention, with the “frequent” codons without modifying the amino acid sequence of the protein encoded by the coding region of the mRNA sequence. This preferred embodiment allows provision of a particularly efficiently translated and stabilized (modified) mRNA sequence of the present invention. The determination of a modified mRNA sequence of the present invention as described above (increased G/C content; exchange of tRNAs) can be carried out using the computer program explained in WO 02/098443—the disclosure content of which is included in its full scope in the present invention. Using this computer program, the nucleotide sequence of any desired mRNA sequence can be modified with the aid of the genetic code or the degenerative nature thereof such that a maximum G/C content results, in combination with the use of codons which code for tRNAs occurring as frequently as possible in the cell, the amino acid sequence coded by the modified mRNA sequence preferably not being modified compared to the non-modified sequence. Alternatively, it is also possible to modify only the G/C content or only the codon usage compared to the original sequence. The source code in Visual Basic 6.0 (development environment used: Microsoft Visual Studio Enterprise 6.0 with Servicepack 3) is also described in WO 02/098443. In a further preferred embodiment of the present invention, the A/U content in the environment of the ribosome binding site of the mRNA sequence of the present invention is increased compared to the A/U content in the environment of the ribosome binding site of its respective wild type mRNA. This modification (an increased A/U content around the ribosome binding site) increases the efficiency of ribosome binding to the mRNA. An effective binding of the ribosomes to the ribosome binding site (Kozak sequence: SEQ ID NO: 213737; the AUG forms the start codon) in turn has the effect of an efficient translation of the mRNA. According to a further embodiment of the present invention, the mRNA sequence of the present invention may be modified with respect to potentially destabilizing sequence elements. Particularly, the coding region and/or the 5' and/or 3' untranslated region of this mRNA sequence may be modified compared to the respective wild type mRNA such that it contains no destabilizing sequence elements, the encoded amino acid sequence of the modified mRNA sequence preferably not being modified compared to its respective wild type mRNA. It is known that, for example in sequences of eukaryotic mRNAs, destabilizing sequence elements (DSE) occur, to which signal proteins bind and regulate enzymatic degradation of mRNA in vivo. For further stabilization of the modified mRNA sequence, optionally in the region which encodes at least one peptide or protein as defined herein or a fragment or variant thereof, one or more such modifications compared to the corresponding region of the wild type mRNA can therefore be carried out, so that no or substantially no destabilizing sequence elements are contained there. According to the invention, DSE present in the untranslated regions (3'- and/or 5'-UTR) can also be eliminated from the mRNA sequence of the present invention by such modifications. Such destabilizing sequences are e.g. AU-rich sequences (AURES), which occur in 3'-UTR sections of numerous unstable mRNAs (Caput at al., Proc. Natl. Acad. Sci. USA 1986, 83:1670 to 1674). The mRNA sequence of the present invention is therefore preferably modified compared to the respective wild type mRNA such that the mRNA sequence of the present invention contains no such destabilizing sequences. This also applies to those sequence motifs which are recognized by possible endonucleases, e.g., the sequence GAACAAG, which is contained in the 3'-UTR segment of the gene encoding the transferrin receptor (Binder et al., EMBO J. 1994, 13:1969 to 1980). These sequence motifs are also preferably removed in the mRNA sequence of the present invention.

According to a preferred embodiment, the present invention provides an mRNA sequence as defined herein comprising at least one coding region, wherein the coding region comprises or consists of any one of the (modified) RNA sequences defined in the fourth column (column "C") of FIG. 1-4, or of a fragment or variant of any one of these sequences.

According to a particularly preferred embodiment, the present invention provides an mRNA sequence as defined herein comprising at least one coding region encoding at least one antigenic peptide or protein derived from hemagglutinin (HA) of an influenza A virus, wherein the coding region comprises or consists of any one of the (modified; GC modified) RNA sequences according to SEQ ID NOs: 61009-75039, 183025-197055, 213529-213550, 214024-214051, 214128-214155, 214240-214267, 214344-214371, 214448-214475, 214552-214579, 214656-214683, 214760-214787, 215046, 215077-215104, 215163, 215194-215221, 215280, 215311-215338, 215397, 215428-215455, 215514, 215545-215572, 215638-215835 or of a fragment or variant of any one of these sequences.

According to a further particularly preferred embodiment, the present invention provides an mRNA sequence as defined herein comprising at least one coding region encoding at least one antigenic peptide or protein derived from hemagglutinin (HA) of an influenza B virus, wherein the coding region comprises or consists of any one of the (modified; GC modified) RNA sequences according to SEQ ID NOs: 87406-89584, 209422-211600, 213551-213556, 214864-214891, 214968-214995, 215836-215889, 215892 or of a fragment or variant of any one of these sequences.

According to a further particularly preferred embodiment, the present invention provides an mRNA sequence as defined herein comprising at least one coding region encoding at least one antigenic peptide or protein derived from neuraminidase (NA) of an influenza A virus, wherein the coding region comprises or consists of any one of the (modified; GC modified) RNA sequences according to SEQ ID NOs: 75040-87405, 197056-209421, 213557, 213742-213746, 213789, 213794, 213799, 213804 or of a fragment or variant of any one of these sequences.

According to a further particularly preferred embodiment, the present invention provides an mRNA sequence as defined herein comprising at least one coding region encoding at least one antigenic peptide or protein derived from neuraminidase (NA) of an influenza B virus, wherein the coding region comprises or consists of any one of the (modified; GC modified) RNA sequences according to SEQ ID NOs: 80585-91512, 211601-213528 or of a fragment or variant of any one of these sequences.

In a further preferred embodiment, the at least one coding region of the mRNA sequence according to the invention comprises or consists of an RNA sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the (modified; GC modified) RNA sequences according to SEQ ID NOs: 61009-91512, 183025-213528, 213529-213557, 213742-213746, 213789, 213794, 213799, 213804, 214024-214051, 214128-214155, 214240-214267, 214344-214371, 214448-214475, 214552-214579, 214656-214683, 214760-214787, 214864-214891, 214968-214995, 215046, 215077-215104, 215163, 215194-215221, 215280, 215311-215338, 215397, 215428-215455, 215514, 215545-215572, 215638-215835, 215836-215889, 215892 or of a fragment or variant of any one of these sequences.

According to a particularly preferred embodiment, the at least one coding region of the mRNA sequence according to the invention comprises or consists of an RNA sequence having a sequence identity of at least 80% with any one of the (modified; DO modified) RNA sequences according to SEQ ID NOs: 61009-91512, 183025-213528, 213520-213557, 213742-213746, 213789, 213794, 213799, 213804, 214024-214051, 214128-214155, 214240-214267, 214344-214371, 214448-214475, 214552-214579, 214656-214683, 214760-214787, 214864-214891, 214968-214995, 215046, 215077-215104, 215163, 215194-215221, 215280, 215311-215338, 215397, 215428-215455, 215514, 215545-215572, 215638-215835, 215836-215889, 215892 or of a fragment or variant of any one of these sequences.

Sequences Adapted to Human Codon Usage:

According to the invention, a further preferred modification of the mRNA sequence of the present invention is based on the finding that codons encoding the same amino acid typically occur at different frequencies. According to the invention, in the modified mRNA sequence of the present invention, the coding region as defined herein is preferably modified compared to the corresponding coding region of the respective wild type mRNA such that the frequency of the codons encoding the same amino acid corresponds to the naturally occurring frequency of that codon according to the human codon usage as e.g. shown in Table 1.

For example, in the case of the amino acid alanine (Ala) present in an amino acid sequence encoded by the at least one coding region of the mRNA sequence according to the invention, the wild type coding region is preferably adapted in a way that the codon "GCC" is used with a frequency of 0.40, the codon "GCT" is used with a frequency of 0.28, the codon "GCA" is used with a frequency of 0.22 and the codon "GCG" is used with a frequency of 0.10 etc. (see Table 1).

TABLE 1

| Human codon usage table | | | | | | | |
|---|---|---|---|---|---|---|---|
| Amino acid | codon | fraction | /1000 | Amino acid | codon | fraction | /1000 |
| Ala | GCG | 0.10 | 7.4 | Pro | CCG | 0.11 | 6.9 |
| Ala | GCA | 0.22 | 15.8 | Pro | CCA | 0.27 | 16.9 |
| Ala | GCT | 0.28 | 18.5 | Pro | CCT | 0.29 | 17.5 |
| Ala | GCC* | 0.40 | 27.7 | Pro | CCC* | 0.33 | 19.8 |
| Cys | TGT | 0.42 | 10.6 | Gln | CAG* | 0.73 | 34.2 |
| Cys | TGC* | 0.58 | 12.6 | Gln | CAA | 0.27 | 12.3 |
| Asp | GAT | 0.44 | 21.8 | Arg | AGG | 0.22 | 12.0 |
| Asp | GAC* | 0.56 | 25.1 | Arg | AGA* | 0.21 | 12.1 |
| Glu | GAG* | 0.59 | 39.6 | Arg | CGG | 0.19 | 11.4 |
| Glu | GAA | 0.41 | 29.0 | Arg | CGA | 0.10 | 6.2 |
| Phe | TTT | 0.43 | 17.6 | Arg | CGT | 0.09 | 4.5 |
| Phe | TTC* | 0.57 | 20.3 | Arg | CGC | 0.19 | 10.4 |
| Gly | GGG | 0.23 | 16.5 | Ser | AGT | 0.14 | 12.1 |
| Gly | GGA | 0.26 | 16.5 | Ser | AGC* | 0.25 | 19.5 |
| Gly | GGT | 0.18 | 10.8 | Ser | TCG | 0.06 | 4.4 |
| Gly | GGC* | 0.33 | 22.2 | Ser | TCA | 0.15 | 12.2 |
| His | CAT | 0.41 | 10.9 | Ser | TCT | 0.18 | 15.2 |
| His | CAC* | 0.59 | 15.1 | Ser | TCC | 0.23 | 17.7 |
| Ile | ATA | 0.14 | 7.5 | Thr | ACG | 0.12 | 6.1 |
| Ile | ATT | 0.35 | 16.0 | Thr | ACA | 0.27 | 15.1 |
| Ile | ATC* | 0.52 | 20.8 | Thr | ACT | 0.23 | 13.1 |
| Lys | AAG* | 0.60 | 31.9 | Thr | ACC* | 0.38 | 18.9 |
| Lys | AAA | 0.40 | 24.4 | Val | GTG* | 0.48 | 28.1 |
| Leu | TTG | 0.12 | 12.9 | Val | GTA | 0.10 | 7.1 |
| Leu | TTA | 0.06 | 7.7 | Val | GTT | 0.17 | 11.0 |
| Leu | CTG* | 0.43 | 39.6 | Val | GTC | 0.25 | 14.5 |
| Leu | CTA | 0.07 | 7.2 | Trp | TGG* | 1 | 13.2 |
| Leu | CTT | 0.12 | 13.2 | Tyr | TAT | 0.42 | 12.2 |
| Leu | CTC | 0.20 | 19.6 | Tyr | TAC* | 0.58 | 15.3 |
| Met | ATG* | 1 | 22.0 | Stop | TGA* | 0.61 | 1.6 |
| Asn | AAT | 0.44 | 17.0 | Stop | TAG | 0.17 | 0.8 |
| Asn | AAC* | 0.56 | 19.1 | Stop | TAA | 0.22 | 1.0 |

*most frequent codon

According to a preferred embodiment, the present invention provides an mRNA sequence as defined herein comprising at least one coding region, wherein the coding region comprises or consists of any one of the (modified; adapted to human codon usage) RNA sequences according to SEQ ID NOs: 122017-152520, 215629, 215632 or of a fragment or variant of any one of these sequences.

According to a particularly preferred embodiment, the present invention provides an mRNA sequence as defined herein comprising at least one coding region encoding at least one antigenic peptide or protein derived from hemagglutinin (HA) of an influenza A virus, wherein the coding region comprises or consists of any one of the (modified; adapted to human codon usage) RNA sequences according to SEQ ID NOs: 122017-136047, 215628 or of a fragment or variant of any one of these sequences.

According to a further particularly preferred embodiment, the present invention provides an mRNA sequence as defined herein comprising at least one coding region encoding at least one antigenic peptide or protein derived from hemagglutinin (HA) of an influenza B virus, wherein the coding region comprises or consists of any one of the (modified; adapted to human codon usage) RNA sequences according to SEQ ID NOs: 148414-150592, 215632 or of a fragment or variant of any one of these sequences.

According to a further particularly preferred embodiment, the present invention provides an mRNA sequence as defined herein comprising at least one coding, region encoding at least one antigenic peptide or protein derived from neuraminidase (NA) of an influenza A virus, wherein the coding region comprises or consists of any one of the (modified; adapted to human codon usage) RNA sequences according to SEQ ID NOs: 136048-148413, or of a fragment or variant of any one of these sequences.

According to a further particularly preferred embodiment, the present invention provides an mRNA sequence as defined herein comprising at least one coding region encoding at least one antigenic peptide or protein derived from neuraminidase (NA) of an influenza B virus, wherein the coding region comprises or consists of any one of the (modified; adapted to human codon usage) RNA sequences according to SEQ ID NOs: 150593-152520 or of a fragment or variant of any one of these sequences.

In a further preferred embodiment, the at least one coding region of the mRNA sequence according to the invention comprises or consists of an RNA sequence identical to or having a sequence identity of at least 5%, 10%, 20%, 30%, 40%, 50%, 60%, 70%, 80%, 85%, 86%, 87%, 88%, 89%, 90%, 91%, 92%, 83%, 94%, 95%, 96%, 97%, 98%, or 99%, preferably of at least 70%, more preferably of at least 80%, even more preferably at least 85%, even more preferably of at least 90% and most preferably of at least 85% or even 87%, with any one of the (modified; adapted to human codon usage) RNA sequences according to SEU D NOs: 122017-152520, 215628, 215632 or of a fragment or variant of any one of these sequences.

According to a particularly preferred embodiment, the at least one coding region of the mRNA sequence according to the invention comprises or consists of an RNA sequence having a sequence identity of at least 80% with any one of the (modified; adapted to human codon usage) RNA sequences according to SEQ ID NOs: 122017-152520, 215628, 215632 or of a fragment or variant of any one of these sequences.

Codon-Optimized Sequences:

As described above it is preferred according to the invention, that all codons of the wild type sequence which code for a tRNA, which is relatively rare in the cell, are exchanged for a codon which codes for a tRNA, which is relatively frequent in the cell and which, in each case, carries the same amino acid as the relatively rare tRNA. Therefore it is particularly preferred that the most frequent codons are used for each encoded amino acid (see Table 1, most frequent codons are marked with asterisks). Such an optimization procedure increases the codon adaptation index (CAI) and ultimately maximises the CAI. In the context of the invention, sequences with increased or maximized CAI are typically referred to as "codon-optimized" sequences and/or CAI increased and/or maximized sequences. According to a preferred embodiment, the mRNA sequence of the present invention comprises at least one coding region, wherein the coding region/sequence is codon-optimized as described herein. More preferably, the codon adaptation index (CAI) of the at least one coding sequence is at least 0.5, at least 0.8, at least 0.8 or at least 0.85. Most preferably, the codon adaptation index (CAI) of the at least one coding sequence is 1.

For example, in the case of the amino acid alanine (Ala) present in the amino acid sequence encoded by the at least one coding sequence of the RNA according to the invention, the wild type coding sequence is adapted in a way that the most frequent human codon "GCC" is always used for said amino acid, or for the amino acid Cysteine (Cys), the wild type sequence is adapted in a way that the most frequent human codon "TGC" is always used for said amino acid etc.

According to a preferred embodiment, the present invention provides an mRNA sequence as defined herein comprising at least one coding region, wherein the coding region comprises or consists of any one of the (modified; codon-optimized) RNA sequences according to SEQ ID NOs: 152521-183024 or of a fragment or variant of any one of these sequences.

According to a particularly preferred embodiment, the present invention provides an mRNA sequence as defined herein comprising at least one coding region encoding at least one antigenic peptide or protein derived from hemagglutinin (HA) of an influenza A virus, wherein the coding region comprises or consists of any one of the (modified; codon-optimized) RNA sequences according to SEQ ID NOs: 152521-166551, or of a fragment or variant of any one of these sequences.

According to a further particularly preferred embodiment, the present invention provides an mRNA sequence as defined herein comprising at least one coding region encoding at least one antigenic peptide or protein derived from hemagglutinin (HA) of an influenza B virus, wherein the coding region comprises or consists of any one of the (modified; codon-optimized) RNA sequences according to SEQ ID NOs: 178818-181086, or of a fragment or variant of any one of these sequences.

According to a further particularly preferred embodiment, the present invention provides an mRNA sequence as defined herein comprising at least one coding region encoding at least one antigenic peptide or protein derived from neuraminidase (NA) of an influenza A virus, wherein the coding region comprises or consists of any one of the (modified; codon-optimized) RNA sequences according to SEQ ID NOs: 166552-178817, or of a fragment or variant of any one of these sequences.

According to a further particularly preferred embodiment, the present invention provides an mRNA sequence as defined herein comprising at least one coding region encoding at least one antigenic peptide or protein derived from neuraminidase (NA) of an influenza B virus, wherein the coding region comprises or consists of any one of the (modified; codon-optimized) RNA sequences according to SEQ ID NOs: 181087-183024, or of a fragment or variant of any one of these sequences.

In a further preferred embodiment, the at least one coding region of the mRNA sequence according to the invention comprises or consists of an RNA sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 98%, preferably of at least 70%, more preferably of at least 80%, even more preferably at least 85%, even more preferably of at least 80% and most preferably of at least 85% or even 87%, with any one of the (modified; codon-optimized) RNA sequences according to SEQ ID NOs: 152521-183024, or of a fragment or variant of any one of these sequences.

According to a particularly preferred embodiment, the at least one coding region of the mRNA sequence according to the invention comprises or consists of an RNA sequence having a sequence identity of at least 80% with any one of the (modified; codon-optimized) RNA sequences according to SEQ ID NOs: 152521-183024 or of a fragment or variant of any one of these sequences.

C-Optimized Sequences:

According to another embodiment, the mRNA sequence of the present invention may be modified by modifying, preferably increasing, the cytosine (C) content of the mRNA sequence, preferably of the coding region of the mRNA sequence.

In a particularly preferred embodiment of the present invention, the C content of the coding region of the mRNA sequence of the present invention is modified, preferably increased, compared to the C content of the coding region of the respective wild type mRNA, i.e., the unmodified mRNA. The amino acid sequence encoded by the at least one coding region of the mRNA sequence of the present invention is preferably not modified as compared to the amino acid sequence encoded by the respective wild type mRNA.

In a preferred embodiment of the present invention, the modified mRNA sequence is modified such that at least 10%, 20%, 30%, 40%, 50%, 60%, 70% or 80%, or at least 90% of the theoretically possible maximum cytosine-content or even a maximum cytosine-content is achieved.

I5 In further preferred embodiments, at least 10%, 20%, 30%, 40%, 50%, 60%, 70%, 80%, 90% or even 100% of the codons of the target mRNA wild type sequence, which are "cytosine content optimizable" are replaced by codons having a higher cytosine-content than the ones present in the wild type sequence.

In a further preferred embodiment, some of the codons of the wild type coding sequence may additionally be modified such that a codon for a relatively rare tRNA in the cell is exchanged by a codon for a relatively frequent tRNA in the cell, provided that the substituted codon for a relatively frequent tRNA carries the same amino acid as the relatively rare tRNA of the original wild type codon. Preferably, all of the codons for a relatively rare tRNA are replaced by a codon for a relatively frequent tRNA in the cell, except codons encoding amino acids, which are exclusively encoded by codons not containing any cytosine, or except for glutamine (Gln), which is encoded by two codons each containing the same number of cytosines.

In a further preferred embodiment of the present invention, the modified target mRNA is modified such that at least 80%, or at least 90% of the theoretically possible maximum cytosine-content or even a maximum cytosine-content is achieved by means of codons, which code for relatively frequent tRNAs in the cell, wherein the amino acid sequence remains unchanged.

Due to the naturally occurring degeneracy of the genetic code, more than one codon may encode a particular amino acid. Accordingly, 1 out of 20 naturally occurring amino acids are encoded by more then one codon (with Tryp and Met being an exception), e.g. by 2 codons (e.g. Cys, Asp, Glu), by three codons (e.g. Ile), by 4 codons (e.g. Al, Gly, Pro) or by B codons (e.g. Leu, Arg, Ser). However, not all codons encoding the same amino acid are utilized with the same frequency under in vivo conditions. Depending on each single organism, a typical codon usage profile is established.

The term 'cytosine content-optimizable codon' as used within the context of the present invention refers to codons, which exhibit a lower content of cytosines than other codons encoding the same amino acid. Accordingly, any wild type codon, which may be replaced by another codon encoding the same amino acid and exhibiting a higher number of cytosines within that codon, is considered to be cytosine-optimizable (C-optimizable). Any such substitution of a C-optimizable wild type codon by the specific C-optimized codon within a wild type coding region increases its overall C-content and reflects a C-enriched modified mRNA sequence. According to a preferred embodiment, the mRNA sequence of the present invention, preferably the at least one coding region of the mRNA sequence of the present invention comprises or consists of a C-maximized mRNA sequence containing C-optimized codons for all potentially C-optimizable codons. Accordingly, 100% or all of the theoretically replaceable C-optimizable codons are preferably replaced by C-optimized codons over the entire length of the coding region.

In this context, cytosine-content optimizable codons are codons, which contain a lower number of cytosines than other codons coding for the same amino acid.

Any of the codons GCG, GCA, GCU codes for the amino acid Ala, which may be exchanged by the codon GCC encoding the same amino acid, and/or the codon UGU that codes for Cys may be exchanged by the codon UGC encoding the same amino acid, and/or the codon GAO which codes for Asp may be exchanged by the codon SAC encoding the same amino acid, and/or the codon that UUU that codes for Phe may be exchanged for the codon UUC encoding the same amino acid, and/or any of the codons GGG, GGA, GGU that code Gly may be exchanged by the codon GGC encoding the same amino acid, and/or the codon CAU that codes for His may be exchanged by the codon CAC encoding the same amino acid, and/or any of the codons AUA, AUU that code for Ile may be exchanged by the codon AUC, and/or any of the codons UUS, UUA, CUS, CUA, CUU coding for Leu may be exchanged by the codon CUC encoding the same amino acid, and/or the codon AAU that codes for Asn may be exchanged by the codon AAC encoding the same amino acid, and/or any of the codons CCG, CCA, CCU coding for Pro may be exchanged by the codon CCC encoding the same amino acid, and/or any of the codons AGS, AGA, CGG, CGA, CGU coding for Arg may be exchanged by the codon CGC encoding the same amino acid, and/or any of the codons AGU, AGC, UCG; UCA, UCU coding for Ser may be exchanged by the codon UCC encoding the same amino acid, and/or any of the codons ACG, ACA, ACU coding for Thr may be exchanged by the codon ACC encoding the same amino acid, and/or any of the codons GUG, GUA, GUU coding for Val may be exchanged by the codon SUC encoding the same amino acid, and/or the codon UAU coding for Tyr may be exchanged by the codon UAC encoding the same amino acid.

In any of the above instances, the number of cytosines is increased by 1 per exchanged codon. Exchange of all non C-optimized codons (corresponding to C-optimizable codons) of the coding region results in a C-maximized coding sequence. In the context of the invention, at least 70%, preferably at least 80%, more preferably at least 90%, of the non C-optimized codons within the at least one coding region of the mRNA sequence according to the invention are replaced by C-optimized codons.

It may be preferred that for some amino acids the percentage of C-optimizable codons replaced by C-optimized codons is less than 70%, while for other amino acids the percentage of replaced codons is higher than 70% to meet the overall percentage of C-optimization of at least 70% of all C-optimizable wild type codons of the coding region.

Preferably, in a C-optimized mRNA sequence of the invention, at least 50% of the C-optimizable wild type codons for any given amino acid are replaced by C-optimized codons, e.g. any modified C-enriched mRNA sequence preferably contains at least 50% C-optimized codons at C-optimizable wild type codon positions encoding any one of the above mentioned amino acids Ale, Cys, Asp, Phe, Gly, His, Ile, Leu, Asn, Pro, Arg, Ser, Thr. Val and Tyr, preferably at least 60%.

In this context codons encoding amino acids, which are not cytosine content-optimizable and which are, however, encoded by at least two codons, may be used without any further selection process. However, the codon of the wild type sequence that codes for a relatively rare tRNA in the cell, e.g. a human cell, may be exchanged for a codon that codes for a relatively frequent tRNA in the cell, wherein both code for the same amino acid. Accordingly, the relatively rare codon GAA coding for Glu may be exchanged by the relative frequent codon GAG coding for the same amino acid, and/or the relatively rare codon AAA coding for Lys may be exchanged by the relative frequent codon AAG coding for the same amino acid, and/or the relatively rare codon CAA coding for Gln may be exchanged for the relative frequent codon CAG encoding the same amino acid.

In this context, the amino acids Met (AUG) and Trp (UGG), which are encoded by only one codon each, remain unchanged. Stop codons are not cytosine-content optimized, however, the relatively rare stop codons amber, ochre (UAA, UAG) may be exchanged by the relatively frequent stop codon opal (UGA).

The single substitutions listed above may be used individually as well as in all possible combinations in order to optimize the cytosine-content of the modified mRNA sequence compared to the wild type mRNA sequence.

Accordingly, the at least one coding sequence as defined herein may be changed compared to the coding region of the respective wild type mRNA in such a way that an amino acid encoded by at least two or more codons, of which one comprises one additional cytosine, such a codon may be exchanged by the C-optimized codon comprising one additional cytosine, wherein the amino acid is preferably unaltered compared to the wild type sequence.

According to a preferred embodiment, the present invention provides an mRNA sequence as defined herein comprising at least one coding region, wherein the coding region comprises or consists of any one of the (modified; C-optimized) RNA sequences according to SEQ ID NOs: 91513-122016, or of a fragment or variant of any one of these sequences.

According to a particularly preferred embodiment, the present invention provides an mRNA sequence as defined herein comprising at least one coding region encoding at least one antigenic peptide or protein derived from hemagglutinin (HA) of an influenza A virus, wherein the coding region comprises or consists of any one of the (modified; C-optimized) RNA sequences according to SEQ ID NOs: 91513-105543, or of a fragment or variant of any one of these sequences.

According to a further particularly preferred embodiment, the present invention provides an mRNA sequence as defined herein comprising at least one coding region encoding at least one antigenic peptide or protein derived from hemagglutinin (HA) of an influenza B virus, wherein the coding region comprises or consists of any one of the (modified; C-optimized) RNA sequences according to SEQ ID NOs: 117910-120088 or of a fragment or variant of any one of these sequences.

According to a further particularly preferred embodiment, the present invention provides an mRNA sequence as defined herein comprising at least one coding region encoding at least one antigenic peptide or protein derived from neuraminidase (NA) of an influenza A virus, wherein the coding region comprises or consists of any one of the (modified; C-optimized) RNA sequences according to SEQ ID NOs: 105544-117909, or of a fragment or variant of any one of these sequences.

According to a further particularly preferred embodiment, the present invention provides an mRNA sequence as defined herein comprising at least one coding region encoding at least one antigenic peptide or protein derived from neuraminidase (NA) of an influenza B virus, wherein the coding region comprises or consists of any one of the (modified; C-optimized) RNA sequences according to SEQ ID NOs: 120089-122016, or of a fragment or variant of any one of these sequences.

In a further preferred embodiment, the at least one coding region of the mRNA sequence according to the invention comprises or consists of an RNA sequence identical to or having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with any one of the (modified; C-optimized) RNA sequences according to SEQ ID NOs: 91513-122016, or of a fragment or variant of any one of these sequences.

According to a particularly preferred embodiment, the at least one coding region of the mRNA sequence according to the invention comprises or consists of an RNA sequence having a sequence identity of at least 80% with any one of the (modified; C-optimized) RNA sequences according to SEQ ID NOs: 91513-122016 or of a fragment or variant of any one of these sequences.

According to a particularly preferred embodiment, the invention provides an mRNA sequence, comprising at least one coding region as defined herein, wherein the G/C content of the at least one coding region of the mRNA sequence is increased compared to the G/C content of the corresponding coding region of the corresponding wild type mRNA, and/or wherein the C content of the at least one coding region of the mRNA sequence is increased compared to the C content of the corresponding coding region of the corresponding wild type mRNA, and/or wherein the codons in the at least one coding region of the mRNA sequence are adapted to human codon usage, wherein the codon adaptation index (CAI) is preferably increased or maximised in the at least one coding region of the mRNA sequence, and wherein the amino acid sequence encoded by the mRNA sequence is preferably not being modified compared to the amino acid sequence encoded by the corresponding wild type mRNA.

5'-Cap Structure:

According to another preferred embodiment of the invention, a modified mRNA sequence as defined herein, can be modified by the addition of a so-called '5' cap' structure, which preferably stabilizes the mRNA as described herein. A 5'-cap is an entity, typically a modified nucleotide entity, which generally "caps" the 5'-end of a mature mRNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an mRNA, m7GpppN is the 5'-cap structure, which naturally occurs in mRNA transcribed by polymerase II and is therefore preferably not considered as modification comprised in a modified mRNA in this context. Accordingly, a modified mRNA sequence of the present invention may comprise a m7GpppN as 5'-cap, but additionally the modified mRNA sequence typically comprises at least one further modification as defined herein.

Further examples of 5'cap structures include glyceryl, inverted deoxy abasic residue (moiety). 4',5' methylene nucleotide, 1-(beta-O-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety. These modified 5'-cap structures are regarded as at least one modification in this context.

Particularly preferred modified 5'-cap structures are cap1 (methylation of the ribose of the adjacent nucleotide of m7G), cap2 (additional methylation of the ribose of the 2nd nucleotide downstream of the m7G), cap3 (additional methylation of the ribose of the 3rd nucleotide downstream of the m7G), cap4 (methylation of the ribose of the 4th nucleotide downstream of the m7G), ARCA (anti-reverse cap analogue, modified ARCA (e.g. phosphothioate modified AREA), inosine, N1-methyl-guanosine, 2'-fluoro-guanosine, 7-deaza-guanosine, 8-oxo-guanosine, 2-amino-guanosine, LNA-guanosine, and 2-azido-guanosine. Accordingly, the RNA according to the invention preferably comprises a 5'-cap structure.

Poly(A) Sequence/Tail:

According to a further preferred embodiment, the mRNA sequence of the present invention may contain a poly-A tail on the 3' terminus of typically about 10 to 200 adenosine nucleotides, preferably about 10 to 100 adenosine nucleotides, more preferably about 40 to 80 adenosine nucleotides or even more preferably about 50 to 70 adenosine nucleotides.

Preferably, the poly(A) sequence in the mRNA sequence of the present invention is derived from a DNA template by RNA in vitro transcription. Alternatively, the poly(A) sequence may also be obtained in vitro by common methods of chemical-synthesis without being necessarily transcribed from a DNA-progenitor. Moreover, poly(A) sequences, or poly(A) tails may be generated by enzymatic polyadenylation of the RNA according to the present invention using commercially available polyadenylation kits and corresponding protocols known in the art.

Alternatively, the mRNA as described herein optionally comprises a polyadenylation signal, which is defined herein as a signal, which convoys polyadenylation to a (transcribed) RNA by specific protein factors (e.g. cleavage and polyadenylation specificity factor (CPSF), cleavage stimulation factor (CstF), cleavage factors I and II (CF I and CF II), poly(A) polymerase (PAP)). In this context, a consensus polyadenylation signal is preferred comprising the NN(U/T)ANA consensus sequence. In a particularly preferred aspect, the polyadenylation signal comprises one of the following sequences: AA(U/T)AAA or A(U/T)(U/T)AAA (wherein uridine is usually present in RNA and thymidine is usually present in DNA).

Poly(C) Sequence:

According to a further preferred embodiment, the mRNA sequence of the present invention may contain a poly(C) tail on the 3' terminus of typically about 10 to 200 cytosine nucleotides, preferably about 10 to 100 cytosine nucleotides, more preferably about 20 to 70 cytosine nucleotides or even more preferably about 20 to 60 or even 10 to 40 cytosine nucleotides.

In a preferred embodiment the mRNA sequence comprises, preferably in 5'- to 3'-direction:

a.) a 5'-cap structure (cap0, cap1, cap2), preferably m7GpppN;

b.) at least one coding region encoding at least one antigenic peptide or protein derived from a protein of an influenza virus or a fragment or variant thereof, c.) optionally, a poly(A) sequence, preferably comprising 64 adenosines;

d.) optionally, a poly(C) sequence, preferably comprising 30 cytosines, and e.) optionally, and additional poly(A)sequence (obtained by enzymatic polyadenylation)

In a particularly preferred embodiment the mRNA sequence comprises, preferably in 5'- to 3'-direction:

a.) a 5'-cap structure, preferably m7GpppN;

b.) at least one coding region encoding at least one antigenic peptide or protein derived from a protein of an influenza virus or a fragment or variant thereof, preferably comprising or consisting of any one of the nucleic acid sequences defined in the third column ("B"; SEQ ID NO: 30505-61008, 213740, 213741, 213788, 213703, 213798, 213803, 215045, 215162, 215279, 215396, 215513) or fourth column ("C"; SEQ ID NOs: 61009-213528, 213529-213557, 213742-213746, 213788, 213784, 213788, 213804, 214024-214051, 214128-214155, 214240-214267, 214344-214371, 214448-214475, 214552-214579, 214656-214683, 214760-214787, 214864-214891, 214868-214995, 215046, 215077-215104, 215163, 215194-215221, 215280, 215311-215338, 215397, 215428-215455, 215514, 215545-215572, 215638-215835, 215836-21588, 215892, 215622, 215632) of FIG. 1-4, or a fragment or variant thereof, c.) optionally, a poly(A) sequence, preferably comprising 64 adenosines;

d.) optionally, a poly(C) sequence, preferably comprising 3D cytosines.

UTRs:

In a preferred embodiment, the mRNA sequence according to the invention comprises at least one 5'- or 3'-UTR element. In this context, an UTR element comprises or consists of a nucleic acid sequence, which is derived from the 5'- or 3'-UTR of any naturally occurring gene or which is derived from a fragment, a homolog or a variant of the 5'- or 3'-UTR of a gene. Preferably, the 5'- or 3'-UTR element used according to the present invention is heterologous to the at least one coding region of the mRNA sequence of the invention. Even if 5'- or 3'-UTR elements derived from naturally occurring genes are preferred, also synthetically engineered UTR elements may be used in the context of the present invention.

3'-UTR elements:

The term "3'-UTR element" typically refers to a nucleic acid sequence, which comprises or consists of a nucleic acid sequence that is derived from a 3'-UTR or from a variant of a 3'-UTR. A 3'-UTR element in the sense of the present invention may represent the 3'-UTR of an RNA, preferably an mRNA. Thus, in the sense of the present invention, preferably, a 3'-UTR element may be the 3'-UTR of an RNA, preferably of an mRNA, or it may be the transcription template for a 3'-UTR of an RNA. Thus, a 3'-UTR element preferably is a nucleic acid sequence which corresponds to the 3'-UTR of an RNA, preferably to the 3'-UTR of an mRNA, such as an mRNA obtained by transcription of a genetically engineered vector construct. Preferably, the 3'-UTR element fulfils the function of a 3'-UTR or encodes a sequence which fulfils the function of a 3'-UTR.

Preferably, the at least one 3'-UTR element comprises or consists of a nucleic acid sequence derived from the 3'-UTR of a chordate gene, preferably a vertebrate gene, more preferably a mammalian gene, most preferably a human gene, or from a variant of the 3'-UTR of a chordate gene, preferably a vertebrate gene, more preferably a mammalian gene, most preferably a human gene.

Preferably, the mRNA sequence of the present invention comprises a 3'-UTR element, which may be derivable from a gene that relates to an mRNA with an enhanced half-life (that provides a stable mRNA), for example a 3'-UTR element as defined and described below. Preferably, the 3'-UTR element is a nucleic acid sequence derived from a 3'-UTR of a gene, which preferably encodes a stable mRNA, or from a homolog, a fragment or a variant of said gene In a particularly preferred embodiment, the 3'-UTR element comprises or consists of a nucleic acid sequence, which is derived from a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene, or from a variant of a 3'-UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene according to SEQ ID NOs: 1369-1390 of the patent application WD 2013/143700, whose disclosure is incorporated herein by reference, or from a homolog, a fragment or a variant thereof. In a particularly preferred embodiment, the 3'-UTR element comprises or consists of a nucleic acid sequence which is derived from a 3'-UTR of an albumin gene, preferably a vertebrate albumin gene, more preferably a mammalian albumin gene, most preferably a human albumin gene according to SEQ ID NO: 213730 or SEQ ID NO: 213732 or the corresponding RNA sequences SEQ ID NO: 213731 or SEQ ID NO: 213733.

```
Human albumin 3'-UTR SEQ ID NO: 213730
CATCACATTTAAAAGCATCTCAGCCTACCATGAGAATAAGAGAAAGAAAA
TGAAGATCAAAAGCTTATTCATCTGTTTTTCTTTTTCGTTGGTGTAAAGC
CAACACCCTGTCTAAAAAACATAAATTTCTTTAATCATTTTGCCTCTTTT
CTCTGTGCTTCAATTAATAAAAAATGGAAAGAATCT (corresponding
to SEQ ID NO: 1369 of the patent application
WO 2013/143700).
```

In this context it is particularly preferred that the mRNA sequence according to the invention comprises a 3'-UTR element comprising a corresponding RNA sequence derived from the nucleic acids according to SEQ ID NOs: 1369-1390 of the patent application WO 2013/143700 or a fragment, homolog or variant thereof.

Most preferably the 3'-UTR element comprises the nucleic acid sequence derived from a fragment of the human albumin gene according to SEQ ID NO: 213733.

```
albumin7 3'-UTR
CATCACATTTAAAAGCATCTCAGCCTACCATGAGAATAAGAGAAAGAAAA
TGAAGATCAATAGCTTATTCATCTCTTTTTCTTTTTCGTTGGTGTAAAGC
CAACACCCTGTCTAAAAAACATAAATTTCTTTAATCATTTTGCCTCTTTT
CTCTGTGCTTCAATTATAAAAAATGGAAAGAACCT (SEQ ID NO:
213733 corresponding to SEQ ID NO: 1376 of the
patent application WO 2013/143700)
```

In this context, it is particularly preferred that the 3'-UTR element of the mRNA sequence according to the present invention comprises or consists of a corresponding RNA sequence of the nucleic acid sequence according to SEQ ID NO: 213730 or SEQ ID NO: 213732 as shown in SEQ ID NO: 213731 or SEQ ID NO: 213733.

In another particularly preferred embodiment, the 3'-UTR element comprises or consists of a nucleic acid sequence which is derived from a 3'-UTR of an α- or β-globin gene, preferably a vertebrate α- or β-globin gene, more preferably a mammalian α- or β-globin gene, most preferably a human α- or β-globin gene according to SEQ ID NOs: 213720, 213722, 213724, 213726, or the corresponding RNA sequences SEQ ID NOs: 213721, 213723, 213725, 213727.

3'-UTR of *Homo sapiens* haemoglobin, alpha 1 (HBA1)

```
GCTGGAGCCTCGGTGGCCATGCTTCTTGCCCCTTGGGCCTCCCCCAGCCC
CTCCTCCCCTTCCTGCACCCGTACCCCCGTGGTCTTTGAATAAAGTCTGA
GTGGGCGGC (SEQ ID NO: 213720 corresponding to SEQ
ID NO: 1370 of the patent application WO 2013/
143700).
```

3'-UTR of *Homo sapiens* haemoglobin, alpha 2 (HBA2)

```
GCTGGAGCCTCGGTAGCCGTTCCTCCTGCCCGCTGGGCCTCCCAACGGGC
CCTCCTCCCCTCCTTGCACCGGCCCTTCCTGGTCTTTGAATAAAGTCTGA
GTGGGCAG (SEG ID NO: 213722 corresponding to SEQ
ID NO: 1371 of the patent application WO 2013/
143700).
```

3'-UTR of *Homo sapiens* haemoglobin, beta (HBB)

```
GCTCGCTTTCTTGCTGTCCAATTTCTATTAAAGGTTCCTTTGTTCCCTAA
GTCCAACTACTAAACTGGGGGATATTATGAAGGGCCTTGAGCATCTGGAT
TCTGCCTAATAAAAAACATTTATTTTCATTGC (SEQ ID NO:
213724 corresponding to SEQ ID NO: 1372 of the
patent application WO 2013/143700).
```

For example, the 3'-UTR element may comprise or consist of the center, α-complex-binding portion of the 3'-UTR of an α-globin gene, such as of a human α-globin gene, or a homolog, a fragment, or a variant of an α-globin gene, preferably according to SEQ ID NO: 213726:

Center, α-complex-binding portion of the 3'-UTR of an α-globin gene (also named herein as "muag") GCCC- GATGGGCCTCCCAACGGGCCCTCCCCTCCTT GCACCG (SEQ ID NO: 213726 corresponding to SEQ ID NO: 1393 of the patent application WO 2013/143700).

In this context it is particularly preferred that the 3'-UTR element of the mRNA sequence according to the invention comprises or consists of a corresponding RNA sequence of the nucleic acid sequence according to SEQ ID NO: 213726 as shown in SEQ ID NO: 213727, or a homolog, a fragment or variant thereof.

The term "a nucleic acid sequence which is derived from the 3'-UTR of a [. . . ] gene" preferably refers to a nucleic acid sequence which is based on the 3'-UTR sequence of a [ . . . ] gene or on a part thereof, such as on the 3'-UTR of an albumin gene, an α-globin gene, a β-globin gene, a tyrosine hydroxylase gene, a lipoxygenase gene, or a collagen alpha gene, such as a collagen alpha (I) gene, preferably of an albumin gene or on a part thereof. This term includes sequences corresponding to the entire 3'-UTR sequence, i.e., the full length 3'-UTR sequence of a gene, and sequences corresponding to a fragment of the 3'-UTR sequence of a gene, such as an albumin gene, α-globin gene, β-globin gene, tyrosine hydroxylase gene, lipoxygenase gene, or collagen alpha gene, such as a collagen alpha 1(I) gene, preferably of an albumin gene.

The term "a nucleic acid sequence which is derived from a variant of the 3'-UTR of a [ . . . ] gene" preferably refers to a nucleic acid sequence, which is based on a variant of the 3'-UTR sequence of a gene, such as on a variant of the 3'-UTR of an albumin gene, an α-globin gene, a β-globin gene, a tyrosine hydroxylase gene, a lipoxygenase gene, or a collagen alpha gene, such as a collagen alpha 1(I) gene, or on a part thereof as described above. This term includes sequences corresponding to the entire sequence of the variant of the 3'-ITR of a gene, i.e., the full length variant 3'-ITR sequence of a gene, and sequences corresponding to a fragment of the variant 3'-ITR sequence of a gene. A fragment in this context preferably consists of a continuous stretch of nucleotides corresponding to a continuous stretch of nucleotides in the full-length variant 3'-UTR, which represents at least 20%, preferably at least 30%, more preferably at least 40%, more preferably at least 50%, even more preferably at least 61%, even more preferably at least 70%, even more preferably at least 80%, and most preferably at least 90% of the full-length variant 3'-UTR. Such a fragment of a variant, in the sense of the present invention, is preferably a functional fragment of a variant as described herein.

According to a preferred embodiment, the mRNA sequence according to the invention comprises a 5'-cap structure and/or at least one 3'-untranslated region element (3'-HIR element), preferably as defined herein. More preferably, the RNA further comprises a 5'-UTR element as defined herein.

In a preferred embodiment the mRNA sequence comprises, preferably in 5'- to 3'-direction:

a.) a 5-cap structure (capD, cap1, cap2), preferably m7GpppN;

b.) at least one coding region encoding at least one antigenic peptide or protein derived from a protein of an influenza virus or a fragment or variant thereof, c.) optionally a 3'-ITR element, preferably comprising or consisting of a nucleic acid sequence which is derived from an alpha globin gene, preferably comprising the corresponding RNA sequence of the nucleic acid sequence according to SEQ ID NO: 213726, a homolog, a fragment or a variant thereof;

d.) optionally, a poly(A) sequence, preferably comprising 64 adenosines;

a.) optionally, a poly(C) sequence, preferably comprising 30 cytosines, and f.) optionally, and additional poly(A)sequence (obtained by enzymatic polyadenylation)

In a particularly preferred embodiment the mRNA sequence comprises, preferably in 5'- to 3'-direction:

a.) a 5'-cap structure, preferably m7GpppN;

b.) at least one coding region encoding at least one antigenic peptide or protein derived from a protein of an influenza virus or a fragment or variant thereof, preferably comprising or consisting of any one of the nucleic acid sequences defined in the third column ("B"; SEQ ID NO: 30505-61008, 213740, 213741, 213788, 213793, 21378, 213803, 215045, 215162, 215279, 215396, 215513) or fourth column ("C"; SEQ ID NOs: 61009-213528, 213529-213557, 213742-213746, 213789, 213704, 213799, 213804, 214024-214051, 214128-214155, 214240-214267, 214344-214371, 214448-214475, 214552-214579, 214656-214683, 214760-214787, 214864-214851, 214968-214995, 215046, 215077-215104, 215163, 215154-215221, 215280, 215311-215338, 215397, 215428-215455, 215514, 215545-215572, 215638-215835, 215836-215889, 215892, 215629, 215632) of FIG. 1-4, or a fragment or variant thereof, c.) optionally a 3'-UTR element, preferably comprising or consisting of a nucleic acid sequence which is derived from an alpha globin gene, preferably comprising the corresponding RNA sequence of the nucleic acid sequence according to SEQ ID NO: 213728, a homolog, a fragment or a variant thereof;

d.) optionally, a poly(A) sequence, preferably comprising G4 adenosines;

e.) optionally, a poly(C) sequence, preferably comprising 30 cytosines.

5'-UTR Elements:

In a particularly preferred embodiment, the at least one mRNA sequence comprises at least one 5'-untranslated region element (5'-UTR element). Preferably, the at least one 5'-UTR element comprises or consists of a nucleic acid sequence, which is derived from the 5'-UTR of a TOP gene or which is derived from a fragment, homolog or variant of the 5'-UTR of a TOP gene.

It is particularly preferred that the 5'-UTR element does not comprise a TOP-motif or a 5'-TOP, as defined above.

In some embodiments, the nucleic acid sequence of the 5'-UTR element, which is derived from a 5'-UTR of a TOP gene, terminates at its 3'-end with a nucleotide located at position 1, 2, 3, 4, 5, 6, 7, 8, 9 or 10 upstream of the start codon (e.g. A(U/T)G) of the gene or mRNA it is derived from. Thus, the 5'-UTR element does not comprise any part of the protein coding region. Thus, preferably, the only protein coding part of the at least one mRNA sequence is provided by the coding region.

The nucleic acid sequence derived from the 5'-UTR of a TOP gene is preferably derived from a eukaryotic TOP gene, preferably a plant or animal TOP gene, more preferably a chordate TOP gene, even more preferably a vertebrate TOP gene, most preferably a mammalian TOP gene, such as a human TOP gene.

For example, the 5'-UTR element is preferably selected from 5'-UTR elements comprising or consisting of a nucleic acid sequence, which is derived from a nucleic acid sequence selected from the group consisting of SEQ ID NOs: 1-1363, SEQ ID NO: 1395, SEQ ID NO: 1421 and SEQ ID NO: 1422 of the patent application WO 2013/143700, whose disclosure is incorporated herein by reference, from the homologs of SEQ ID NOs: 1-1363, SEQ ID NO: 1305, SEQ ID NO: 1421 and SEQ ID NO: 1422 of the patent application WO 2013/143700, from a variant thereof, or preferably from a corresponding RNA sequence. The term "homologs of SEQ ID NOs: 1-1363, SEQ ID NO: 1395, SEQ ID NO: 1421 and SEQ ID NO: 1422 of the patent application WO 2013/143700" refers to sequences of other species than *Homo sapiens*, which are homologous to the sequences according to SEQ ID NOs: 1-1363, SEQ ID NO: 1325, SEQ ID NO: 1421 and SEQ ID NO: 1422 of the patent application WO 2013/143700.

In a preferred embodiment, the 5'-UTR element of the mRNA sequence according to the invention comprises or consists of a nucleic acid sequence, which is derived from a nucleic acid sequence extending from nucleotide position 5 (i.e., the nucleotide that is located at position 5 in the sequence) to the nucleotide position immediately 5' to the start codon (located at the 3' end of the sequences), e.g., the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO 2013/143700, from the homologs of SEQ ID NO: 1-1363, SEQ ID NO: 1395, SEQ ID NO: 1421 and SEQ ID NO: 1422 of the patent application WO 2013/143700 from a variant thereof, or a corresponding RNA sequence. It is particularly preferred that the 5'-UTR element is derived from a nucleic acid sequence extending from the nucleotide position immediately 3' to the 5'-TOP to the nucleotide position immediately 5' to the start codon (located at the 3' and of the sequences), e.g., the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO 2013/143700, from the homologs of SEQ ID NOs: 1-1363, SEQ ID NO: 1305, SEQ ID NO: 1421 and SEQ ID NO: 1422 of the patent application WO 2013/143700, from a variant thereof, or a corresponding RNA sequence.

In a particularly preferred embodiment, the 5'-UTR element comprises or consists of a nucleic acid sequence, which is derived from a 5'-UTR of a TOP gene encoding a ribosomal protein or from a variant of a 5'-UTR of a TOP gene encoding a ribosomal protein. For example, the 5'-UTR element comprises or consists of a nucleic acid sequence, which is derived from a 5'-UTR of a nucleic acid sequence according to any of SEQ ID NOs: 67,170,193, 244, 259, 554, 650, 675, 700, 721, 313, 1016, 1063, 1120, 1138, and 1284-1360 of the patent application WO 2013/143700, a corresponding RNA sequence, a homolog thereof, or a variant thereof as described herein, preferably lacking the 5'-TOP motif. As described above, the sequence extending from position 5 to the nucleotide immediately 5' to the ATG (which is located at the 3'end of the sequences) corresponds to the 5'-UTR of said sequences.

Preferably, the 5'-UTR element comprises or consists of a nucleic acid sequence, which is derived from a 5'-UTR of a TOP gene encoding a ribosomal Large protein (RPL) or from a homolog or variant of a 5'-UTR of a TOP gene encoding a ribosomal Large protein (RPL). For example, the 5'-UTR element comprises or consists of a nucleic acid sequence, which is derived from a 5'-UTR of a nucleic acid sequence according to any of SEQ ID NOs: 67, 259, 1284-1318, 1344, 1346, 1348-1354, 1357, 1358, 1421 and 1422 of the patent application WO 2013/143700, a corresponding RNA sequence, a homolog thereof, or a variant thereof as described herein, preferably lacking the 5'-TOP motif.

In a particularly preferred embodiment, the 5'-UTR element comprises or consists of a nucleic acid sequence which is derived from the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, or from a variant of the 5'-UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, wherein preferably the 5'-UTR element does not comprise the 5'-TOP of said gene.

Accordingly, in a particularly preferred embodiment, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 213718 (5'-UTR of human ribosomal protein Large 32 lacking the 5'terminal oligopyrimidine tract: GGCGCTGCCTACGGAGGTGGCAGCCA-TOTTCTCGGCATC; corresponding to SEQ ID NO: 138 of the patent application WO 2013/143700) or preferably to a corresponding RNA sequence, or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 20%, even more preferably of at least about 95%, even more preferably of at least about 99% to the nucleic acid sequence according to SEQ ID NO: 213718 or more preferably to a corresponding RNA sequence (SEQ ID NO: 213717), wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

In some embodiments, the mRNA sequence according to the invention comprises a 5'-UTR element, which comprises or consists of a nucleic acid sequence, which is derived from the 5'-UTR of a vertebrate TOP gene, such as a mammalian, e.g. a human TOP gene, selected from RPSA, RPS2, RPS3, RPS3A, RPS4, RPS5, RPS6, RPS7, RPS8, RPS9, RPS10, RPS11, RPS12, RPS13, RPS14, RPS15, RPS15A, RPS16, RPS17, RPS18, RPS19, RPS20, RPS21, RPS23. RPS24, RPS25, RPS26, RPS27, RPS27A, RPS28, RPS22, RPS30, RPL3, RPL4, RPL5, RPL6, RPL7, RPL7A, RPL8, RPL9, RPL10, RPL10A, RPL11, RPL12, RPL13, RPL13A, RPL14, RPL15, RPL17, RPL18, RPL18A, RPL19, RPL21, RPL22, RPL23, RPL23A, RPL24, RPL26, RPL27, RPL27A, RPL28, RPL29, RPL30, RPL3L, RPL32, RPL34, RPL35, RPL35A, RPL36, RPL36A, RPL37, RPL37A, RPL38, RPL39, RPL40, RPL41, RPLP0, RPLP1, RPLP2, RPLP3, RPLP0, RPLP1, RPLP2, EEF1A1, EEFIB2, EEF10, EEF1, EEF2, EIF3E, EIF3F, EIF3H, EIF2S3, EF3, EIF3K, EIF3E1P, EIF4A2, PABPC1, HNRNPA1, TPT1, TUBB1, UBA52, NPM1, ATP5G2, GNB2L1, NME2, UQCRB, or from a homolog or variant thereof, wherein preferably the 5'-UTR element does not comprise a TOP-motif or the 5'-TOP of said genes, and wherein optionally the 5'-UTR element starts at its 5'-end with a nucleotide located at position 1, 2, 3, 4, 5, 6, 7, 8, 8 or 10 downstream of the 5'-terminal oligopyrimidine tract (TOP) and wherein further optionally the 5'-UTR element which is derived from a 5'-UTR of a TOP gene terminates at its 3'-end with a nucleotide located at position 1, 2, 3, 4, 5, 8, 7, 8, 2 or 10 upstream of the start codon (A(U/T)G) of the gene it is derived from.

In further particularly preferred embodiments, the 5'-UTR element comprises or consists of a nucleic acid sequence, which is derived from the 5'-UTR of a ribosomal protein Large 32 gene (RPL32), a ribosomal protein Large 35 gene (RPL35), a ribosomal protein Large 21 gene (RPL21), an ATP synthase, H+ transporting, mitochondrial F1 complex, alpha subunit 1, cardiac muscle (ATP5A1) gene, an hydroxysteroid (17-beta) dehydrogenase 4 gene (HSD17B4), an androgen-induced 1 gene (A1G1), cytochrome c oxidase subunit Vlc gene (COX6C), or a N-acylsphingosine amidohydrolase (acid ceramidase) 1 gene (ASAH1) or from a variant thereof, preferably from a vertebrate ribosomal protein Large 32 gene (RPL32), a vertebrate ribosomal protein Large 35 gene (RPL35), a vertebrate ribosomal protein Large 21 gene (RPL21), a vertebrate ATP synthase, H+ transporting, mitochondrial F1 complex, alpha subunit 1, cardiac muscle (ATP5A1) gene, a vertebrate hydroxysteroid (17-beta) dehydrogenase 4 gene (HSD1784), a vertebrate androgen-induced 1 gene (A1G1), a vertebrate cytochrome c oxidase subunit Vlc gene (COX6C), or a vertebrate N-acylsphingosine amidohydrolase (acid ceramidase) 1 gene (ASAH1) or from a variant thereof, more preferably from a mammalian ribosomal protein Large 32 gene (RPL32), a ribosomal protein Large 35 gene (RPL35), a ribosomal protein Large 21 gene (RPL21), a mammalian ATP synthase, H+ transporting, mitochondrial F1 complex, alpha subunit 1, cardiac muscle (ATP5A1) gene, a mammalian hydroxysteroid (17-beta) dehydrogenase 4 gene (HSD1764), a mammalian androgen-induced 1 gene (A1G1), a mammalian cyto-chrome c oxidase subunit Vlc gene (COX6C), or a mammalian N-acylsphingosine amidohydrolase (acid ceramidase) 1 gene (ASAH1) or from a variant thereof, most preferably from a human ribosomal protein Large 32 gene (RPL32), a human ribosomal protein Large 35 gene (RPL35), a human ribosomal protein Large 21 gene (RPL21), a human ATP synthase, H+ transporting, mitochondrial F1 complex, alpha subunit 1, cardiac muscle (ATP5A1) gene, a human hydroxysteroid (17-beta) dehydrogenase 4 gene (HSD1784), a human androgen-induced 1 gene (A1G1), a human cytochrome c oxidase subunit Vlc gene (COX6C), or a human N-acylsphingosine amidohydrolase (acid ceramidase) 1 gene (ASAH1) or from a variant thereof, wherein preferably the 5'-UTR element does not comprise the 5'TOP of said gene.

Accordingly, in a particularly preferred embodiment, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 80%, even more preferably of at least about 95%, even more preferably of at least about 99% to the nucleic acid sequence according to SEQ ID NO: 1368, or SEQ ID NOs: 1412-1420 of the patent application WD 2013/143700, or a corresponding RNA sequence, or wherein the at least one 5'-UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 89% to the nucleic acid sequence according to SEQ ID NO: 1368, or SEQ ID NOs: 1412-1420 of the patent application WO 2013/143700, wherein, preferably, the fragment is as described above, i.e. being a continuous stretch of nucleotides representing at least 20% etc. of the full-length; 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Accordingly, in a particularly preferred embodiment, the 5'-UTR element comprises or consists of a nucleic acid sequence, which has an identity of at least about 40%, preferably of at least about 50%, preferably of at least about 60%, preferably of at least about 70%, more preferably of at least about 80%, more preferably of at least about 80%, even more preferably of at least about 95%, even more preferably of at least about 89% to the nucleic acid sequence according to SEQ ID NO: 213718 (5'-UTR of ATP5A1 lacking the 5' terminal oligopyrimidine tract: GCGGCTCGGCCATTTTTCCCAGTCAGTCCGGAGGCTGCGGCTCAGAA GTACCCCTCGDAGTAACTGCAAA; corresponding to SEQ ID NO: 1414 of the patent application WO 2013/143700) or preferably to a corresponding RNA sequence (SEQ ID NO: 213719), or wherein the at least one 5'-ITR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 50%, even more preferably of at least about 95%, even more preferably of at least about 99% to the nucleic acid sequence according to SEQ ID NO: 213718 or more preferably to a corresponding RNA sequence (SEQ ID NO: 213715), wherein, preferably, the fragment is as described above, i.e. being a continuous stretch of nucleotides representing at least 20% etc. of the full-length 5'-UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Preferably, the at least one 5'-UTR element and the at least one 3'-UTR element act synergistically to increase protein production from the at least one mRNA sequence as described above.

According to a preferred embodiment the mRNA sequence according to the invention comprises, preferably in 5'- to 3'-direction:

a.) a 5'-cap structure, preferably m76pppN;

b.) optionally a 5'-UTR element which preferably comprises or consists of a nucleic acid sequence which is derived from the 5'-UTR of a TOP gene, more preferably comprising or consisting of the corresponding RNA sequence of a nucleic acid sequence according to SEQ ID NO: 213716, a homolog, a fragment or a variant thereof;

c.) at least one coding region encoding at least one antigenic peptide or protein derived from a protein of an influenza virus or a fragment or variant thereof, preferably comprising or consisting of any one of the nucleic acid sequences defined in the in the third column ("8"; SEQ ID NO: 30505-61008, 213740, 213741, 213788, 213793, 213798, 213803, 215045, 215162, 215279, 215366, 215513) or fourth column ("C"; SEQ ID NOs: 61009-91512, 183025-213528, 213529-213557, 213742-213746, 213785, 213754, 213755, 213804, 214024-214051, 214128-214155, 214240-214267, 214344-214371, 214448-214475, 214552-214579, 214656-214683, 214760-214787, 214864-214891, 214968-214995, 215046, 215077-215104, 215163, 215194-215221, 215280, 215311-215338, 215397, 215428-215455, 215514, 215545-215572, 215638-215835, 215836-215889, 215892, 215629, 215632) of FIG. 1-4, or a fragment or variant thereof, d.) optionally a 3'-UTR element which preferably comprises or consists of a nucleic acid sequence which is derived from a gene providing a stable mRNA, preferably comprising or consisting of the corresponding RNA sequence of a nucleic acid sequence according to SEQ ID NO: 213733, a homolog, a fragment or a variant thereof;

a.) optionally a poly(A) sequence preferably comprising 64 adenosines; and f.) optionally a poly(C) sequence, preferably comprising 30 cytosines.

Histone Stem-Loop:

In a particularly preferred embodiment, the mRNA sequence according to the invention comprises a histone stem-loop sequence/structure. Such histone stem-loop sequences are preferably selected from histone stem-loop sequences as disclosed in WO 2012/019780, the disclosure of which is incorporated herewith by reference.

A histone stem-loop sequence, suitable to be used within the present invention, is preferably selected from at least one of the following formulae (I) or (II):

Formula (I) (Stem-Loop Sequence without Stem Bordering Elements):

$$\underbrace{[N_{0-2}GN_{3-5}]}_{stem1}\underbrace{[N_{0-4}(U/T)N_{0-4}]}_{\text{loop}}\underbrace{[N_{3-5}CN_{0-2}]}_{stem2}$$

Formula (11) (Stem-Loop Sequence with Stem Bordering Elements):

$$\underbrace{N_{1-6}}_{\substack{stem1\\ \text{bordering element}}}\underbrace{[N_{0-2}GN_{3-5}]}_{stem1}\underbrace{[N_{0-4}(U/T)N_{0-4}]}_{\text{loop}}\underbrace{[N_{3-5}CN_{0-2}]}_{stem2}\underbrace{N_{1-6}}_{\substack{stem2\\ \text{bordering element}}}$$

wherein:

stem1 or stem2 bordering elements $N_{1-6}$ is a consecutive sequence of 1 to 6, preferably of 2 to 6, more preferably of 2 to 5, even more preferably of 3 to 5, most preferably of 4 to 5 or 5N, wherein each N is independently from another selected from a nucleotide selected from A, U, T, G and C, or a nucleotide analogue thereof;

stem1 $[N_{0-2}GN_{3-5}]$ is reverse complementary or partially reverse complementary with element stem2, and is a consecutive sequence between of 5 to 7 nucleotides;

wherein $N_{0-2}$ is a consecutive sequence of 0 to 2, preferably of 0 to 1, more preferably of 1N, wherein each N is independently from another selected from a nucleotide selected from A, U, T, G and C or a nucleotide analogue thereof;

wherein $N_{3-5}$ is a consecutive sequence of 3 to 5, preferably of 4 to 5, more preferably of 4N, wherein each N is independently from another selected from a nucleotide selected from A, U, T, G and C or a nucleotide analogue thereof, and wherein G is guanosine or an analogue thereof, and may be optionally replaced by a cytidine or an analogue thereof, provided that its complementary nucleotide cytidine in stem2 is replaced by guanosine;

loop sequence $[N_{0-4}(U/T)N_{0-4}]$ is located between elements stem1 and stem2, and is a consecutive sequence of 3 to 5 nucleotides, more preferably of 4 nucleotides;

wherein each $N_{0-4}$ is independent from another a consecutive sequence of 0 to 4, preferably of 1 to 3, more preferably of 1 to 2N, wherein each N is independently from another selected from a nucleotide selected from A, U, T, G and C or a nucleotide analogue thereof; and wherein U/T represents uridine, or optionally thymidine;

stem2 $[N_{3-5}CN_{0-2}]$ is reverse complementary or partially reverse complementary with element stem1, and is a consecutive sequence between of 5 to 7 nucleotides;

wherein $N_{3-5}$ is a consecutive sequence of 3 to 5, preferably of 4 to 5, more preferably of 4N, wherein each N is independently from another selected from a nucleotide selected from A, U, T, G and C or a nucleotide analogue thereof;

wherein $N_{0-2}$ is a consecutive sequence of 0 to 2, preferably of 0 to 1, more preferably of 1N, wherein each N is independently from another selected from a nucleotide selected from A, U, T, G or C or a nucleotide analogue thereof; and wherein C is cytidine or an analogue thereof, and may be optionally replaced by a guanosine or an analogue thereof provided that its complementary nucleoside guanosine in stem1 is replaced by cytidine;

wherein stem1 and stem2 are capable of base pairing with each other forming a reverse complementary sequence, wherein base pairing may occur between stem1 and stem2, e.g. by Watson-Crick base pairing of nucleotides A and U/T or G and C or by non-Watson-Crick base pairing e.g. wobble base pairing, reverse Watson-Crick base pairing, Hoogsteen base pairing, reverse Hoogsteen base pairing or are capable of base pairing with each other forming a partially reverse complementary sequence, wherein an incomplete base pairing may occur between stem1 and stem2, on the basis that one or more bases in one stem do not have a complementary base in the reverse complementary sequence of the other stem.

According to a further preferred embodiment the inventive mRNA sequence may comprise at least one histone stem-loop sequence according to at least one of the following specific formulae (Ia) or (IIa):

Formula (Ia) (Stem-Loop Sequence without Stem Bordering Elements):

$$\underbrace{[N_{0-1}GN_{3-5}]}_{stem1}\underbrace{[N_{1-3}(U/T)N_{0-2}]}_{loop}\underbrace{[N_{3-5}CN_{0-1}]}_{stem2}$$

Formula (IIa) (Stem-Loop Sequence with Stem Bordering Elements):

$$\underbrace{N_{2-5}}_{\substack{stem1\\ \text{bordering element}}}\underbrace{[N_{0-1}GN_{3-5}]}_{stem1}\underbrace{[N_{1-3}(U/T)N_{0-2}]}_{loop}\underbrace{[N_{3-5}CN_{0-1}]}_{stem2}\underbrace{N_{2-5}}_{\substack{stem2\\ \text{bordering element}}}$$

wherein

N, C, G, T and U are as defined above.

According to a further more particularly preferred embodiment, the at least one mRNA of the inventive composition may comprise at least one histone stem-loop sequence according to at least one of the following specific formulae (Ib) or (IIb):

Formula (Ib) (Stem-Loop Sequence without Stem Bordering Elements):

$$\underbrace{[N_1GN_4]}_{stem1}\underbrace{[N_2(U/T)N_1]}_{loop}\underbrace{[N_4CN_1]}_{stem2}$$

Formula (IIb) (Stem-Loop Sequence with Stem Bordering Elements):

$$\underbrace{N_{4-5}}_{\substack{stem1\\ \text{bordering element}}}\underbrace{[N_1GN_4]}_{stem1}\underbrace{[N_2(U/T)N_1]}_{loop}\underbrace{[N_4CN_1]}_{stem2}\underbrace{N_{4-5}}_{\substack{stem2\\ \text{bordering element}}}$$

wherein:

N, C, G, T and U are as defined above.

A particular preferred histone stem-loop sequence is the sequence CAAAGGCTCTTTTCAGAICCACCA (according to SEQ ID NO: 213734) or more preferably the corresponding RNA sequence CAAAGGCUCUUUUCAGAGCCACCA (according to SEQ ID NO: 213735).

Any of the above modifications may be applied to the mRNA sequence of the present invention, and further to any mRNA as used in the context of the present invention and may be, if suitable or necessary, be combined with each other in any combination, provided, these combinations of modifications do not interfere with each other in the respective mRNA sequence. A person skilled in the art will be able to take his choice accordingly.

The mRNA sequence according to the invention, which comprises at least one coding region as defined herein, may preferably comprise a 5'-UTR and/or a 3'-UTR preferably containing at least one histone stem-loop. The 3'-UTR of the mRNA sequence according to the invention preferably comprises also a poly(A) and/or a poly(C) sequence as defined herein. The single elements of the 3'-UTR may occur therein in any order from 5' to 3' along the sequence of the mRNA sequence of the present invention. In addition, further elements as described herein, may also be contained, such as a stabilizing sequence as defined herein (e.g. derived from the UTR of a globin gene), IRES sequences, etc. Each of the elements may also be repeated in the mRNA sequence according to the invention at least once (particularly in di- or multicistronic constructs), preferably twice or more. As an example, the single elements may be present in the mRNA sequence according to the invention in the following order:

5'-coding region—histone stem-loop—poly(A)/(C) sequence—3'; or

5'-coding region—poly(A)/(C) sequence—histone stem-loop—3'; or

5'-coding region—histone stem-loop—polyadenylation signal—3'; or

5'-coding region—polyadenylation signal—histone stem-loop—3'; or

5'-coding region—histone stem-loop—histone stem-loop—poly(A)/(C) sequence—3'; or 5'-coding region—histone stem-loop—histone stem-loop—polyadenylation signal—3'; or 5'-coding, region—stabilizing sequence—poly(A)/(C) sequence—histone stem-loop—3'; or 5'-coding region—stabilizing sequence—poly(A)/(C) sequence—poly(A)/(C) sequence—histone stem-loop—3'; etc.

According to a further embodiment, the mRNA sequence of the present invention preferably comprises at least one of the following structural elements: a 5'- and/or 3'—untranslated region element (UTR element), particularly a 5'-UTR element, which preferably comprises or consists of a nucleic acid sequence which is derived from the 5'-UTR of a TOP gene or from a fragment, homolog or a variant thereof, or a 5'- and/or 3'-UTR element which may preferably be derivable from a gene that provides a stable mRNA or from a homolog, fragment or variant thereof; a histone-stem-loop structure, preferably a histone-stem-loop in its 3' untranslated region; a 5'-cap structure; a poly-A tail; or a poly(C) sequence.

In a particularly preferred embodiment the mRNA sequence comprises, preferably in 5'- to 3-direction:

a.) a 5'-cap structure, preferably m76pppN;

b.) at least one coding region encoding at least one antigenic peptide or protein derived from a protein of an influenza virus or a fragment or variant thereof, preferably comprising or consisting of any one of the nucleic acid sequences defined in the in the third column ("8"; SEQ ID NO: 30505-61008, 213740, 213741, 213788, 213783, 213788, 213803, 215045, 215162, 215279, 215396, 215513) or fourth column ("C"; SEQ ID NOs: 61009-213528, 213529-213557, 213742-213746, 213788, 213784, 213788, 213804, 214024-214051, 214128-214155, 214240-214267, 214344-214371, 214448-214475, 214552-214579, 214656-214683, 214760-214787, 214864-214891, 214968-214995, 215046, 215077-215104, 215163, 215194-215221, 215280, 215311-215338, 215387, 215428-215455, 215514, 215545-215572, 215638-215835, 215836-215889, 215892, 215629, 215632) of FIG. 1-4, or a fragment or variant thereof;

c.) optionally a 3'-ITR element comprising or consisting of a nucleic acid sequence which is derived from an alpha globin gene, preferably comprising the corresponding RNA sequence of the nucleic acid sequence according to SEQ ID NO: 213727, a homolog, a fragment or a variant thereof;

d.) optionally, a poly(A) sequence, preferably comprising 64 adenosines;

e.) optionally, a poly(C) sequence, preferably comprising 30 cytosines; and f.) optionally, a histone stem-loop, preferably comprising the RNA sequence according to SEQ ID NO: 213735.

According to another particularly preferred embodiment the mRNA sequence according to the invention comprises, preferably in 5'- to 3-direction:

a.) a 5'-cap structure, preferably m7GpppN;

b.) a 5'-UTR element which comprises or consists of a nucleic acid sequence which is derived from the 5'-UTR of a TOP gene, preferably comprising or consisting of the corresponding RNA sequence of a nucleic acid sequence according to SEQ ID NO: 213716 or SEQ ID NO: 213718, a homolog, a fragment or a variant thereof;

c.) at least one coding region encoding at least one antigenic peptide or protein derived from a protein of an influenza virus or a fragment or variant thereof, preferably comprising or consisting of any one of the nucleic acid sequences defined in the in the third column ("B"; SEQ ID NO: 30505-61008, 213740, 213741, 213788, 213723, 213788, 213803, 215045, 215162, 215279, 215326, 215513) or fourth column ("C"; SEQ ID NOs: 61009-213528, 213529-213557, 213742-213746, 213782, 213724, 213729, 213804, 214024-214051, 214128-214155, 214240-214267, 214344-214371, 214448-214475, 214552-214579, 214656-214683, 214760-214787, 214864-214891, 214668-214995, 215046, 215077-215104, 215163, 215194-215221, 215280, 215311-215338, 215327, 215428-215455, 215514, 215545-215572, 215638-215835, 215836-215889, 21582, 215629, 215632) of FIG. 1-4, or a fragment or variant thereof.

d.) optionally a 3'-UTR element comprising or consisting of a nucleic acid sequence which is derived from a gene providing a stable mRNA, preferably comprising or consisting of the corresponding RNA sequence of a nucleic acid sequence according to SEQ ID NO: 213732, a homolog, a fragment or a variant thereof;

e.) optionally a poly(A) sequence preferably comprising 64 adenosines;

f.) optionally a poly(C) sequence, preferably comprising 30 cytosines; and g.) optionally, a histone stem-loop, preferably comprising the RNA sequence according to SEQ ID NO: SEQ ID NO: 213735.

In preferred embodiments the mRNA sequence according to the invention comprises the mRNA sequences SEQ ID NOs: 213558-213712, 213747-213786, 213563-213570, 213579-213586, 21358-213596, 213599-213606, 213612-213612, 213627, 213622-213634, 213647-213654, 213682-21368, 21362-213781, 213725, 213796, 213800, 213801, 213805, 213806, 214052-214009, 214156-214211, 214268-214315, 214372-214419, 214476-214523, 214580-213628, 214684-214731, 214788-214835, 214892-214939, 21496-215043, 215047, 215048, 215105-215160, 215164, 215165, 215222-215277, 215221, 215282, 215339-215394, 215328, 215322, 215456-215511, 215515, 215516, 215573-215628, 215630, 215631, 215633, 215634, 215820, 215821, 215823, 215824, or RNA sequences being identical or at least 50%, 60%, 70%, 80%, 85%, 86%, 87%, 88%, 89%, 90%, 91%, 92%, 93%, 94%, 95%, 96%, 97%, 98%, or 99% identical to the mRNA sequences SEQ ID NOs: 213558-213712, 213747-213786, 213563-213570, 213579-213586, 213582-213526, 213599-213606, 213612-213619, 213627, 213629-213634, 213647-213654, 213682-213689, 213692-213791, 213795, 213726, 213800, 213801, 213805, 213806, 214052-214099, 214156-214211, 214268-214315, 214372-214419, 214476-214523, 214580-213628, 214684-214731, 214788-214835, 214822-214939, 214996-215043, 215047, 215048, 215105-215160, 215164, 215165, 215222-215277, 215281, 215282, 215339-215394, 215398, 215399, 215456-215511, 215515, 215516, 215573-215628, 215630, 215631, 215633, 215634, 215820, 215821, 215823, 215824.

In particularly preferred embodiments the mRNA sequence according to the invention comprises the mRNA sequences SEQ ID NOs: 213559, 213561, 213563, 213565, 213567, 213562, 213571, 213573, 213575, 213577, 213579, 213581, 213583, 213585, 213587, 213589, 213591, 213593, 213595, 213597, 213598, 213599, 213522, 213601, 213603, 213605, 213607, 213610, 213612, 213614, 213616, 213618, 213621, 213623, 213625, 213627, 213628, 213631, 213633, 213635, 213637, 213640, 213642, 213644, 213646, 213647, 213649, 213651, 213653, 213657, 213660, 213662, 213665, 213667, 213670, 213673, 213675, 213678, 213680, 213682, 213684, 213686, 213688, 213680, 213692, 213624, 213696, 213688, 213700, 213702, 213704, 213706, 213709, 213711, 213747, 213749, 213751, 213753, 213755, 213757, 213758, 213761, 213763, 213765, 213767, 213768, 213771, 213773, 213775, 213777, 213779, 213781, 213783, 213785, 213563, 213565, 213567, 213569, 213578, 213581, 213583, 213585, 213582, 213591, 213523, 213585, 213599, 213601, 213603, 213605, 213612, 213614, 213616, 213618, 213627, 213629, 213631, 213633, 213647, 213642, 213651, 213653, 213682, 213684, 213686, 213688, 213622, 213684, 213686, 213688, 213720, 213785, 213800, 213805, 214052-214075, 214156-214183, 214268-214291, 214372-214395, 214476-214499, 214580-214603, 214684-214707, 214788-214811, 214892-214915, 214296-215018, 215047, 215105-215132, 215164, 215222-215249, 215281, 215339-215366, 215398, 215456-215483, 215515, 215573-215600, 215630, 215633, 215890, 215893 or RNA sequences being identical or at least 50%, 60%, 70%, 80%, 85%, 86%, 87%, 88%, 89%, 90%, 91%, 92%, 93%, 94%, 25%, 86%, 27%, 98%, or 99% identical to the mRNA sequences SEQ ID NOs: 213558, 213561, 213563, 213565, 213567, 213568, 213571, 213573, 213575, 213577, 213572, 213581, 213583, 213585, 213587, 213582, 213581, 213583, 213585, 213527, 213528, 213528, 213601, 213603, 213605, 213607, 213610, 213612, 213614, 213616, 213618, 213621, 213623, 213625, 213627, 213622, 213631, 213633, 213635, 213637, 213640, 213642, 213644, 213646, 213647, 213642, 213651, 213653, 213657, 213660, 213662, 213665, 213667, 213670, 213673, 213675, 213678, 213680, 213682, 213684, 213686, 213688, 213620, 213682, 213624, 213626, 213628, 213700, 213702, 213704, 213706, 213708, 213711, 213747, 213748, 213751, 213753, 213755, 213757, 213752, 213761, 213763, 213765, 213767, 213768, 213771, 213773, 213775, 213777, 213779, 213781, 213783, 213785, 213563, 213565, 213567, 213569, 213578, 213581, 213583, 213585, 213588, 213521, 213583, 213525, 213522, 213601, 213603, 213605, 213612, 213614, 213616, 213618, 213627, 213628, 213631, 213633, 213647, 213648, 213651, 213653, 213682, 213684, 213686, 213688, 213622, 213624, 213626, 213628, 213720, 213725, 213800, 213805, 214052-214075, 214156-214183, 214268-21421, 214372-21435, 214476-214499, 214580-214603, 214684-214707, 214788-214811, 214892-214215, 21496-215018, 215047, 215105-215132, 215164, 215222-215249, 215281, 215339-215366, 215328, 215456-215483, 215515, 215573-215600, 215630, 215633, 215820, 215883.

In preferred embodiments the mRNA sequence according to the invention comprises the following mRNA sequences encoding HA protein of Influenza A or RNA sequences being identical or at least 50%, 60%, 70%, 80%, 85%, 86%, 87%, 88%, 89%, 90%, 91%, 92%, 93%, 94%, 95%, 96%, 97%, 98%, or 99% identical to the following RNA Sequences SEQ ID NOs: 213560, 213562, 213564, 213566, 213568, 213570, 213572, 213574, 213576, 213578, 213580, 213582, 213584, 213586, 213588, 213580, 213582, 213524, 213586, 213600, 213602, 213604, 213606, 213608, 213611, 213613, 213615, 213617, 213619, 213622, 213624, 213626, 213628, 213630, 213632, 213634, 213636, 213638, 213641, 213643, 213645, 213648, 213650, 213652, 213654, 213655, 213658, 213661, 213663, 213666, 213668, 213671, 213674, 213676, 213678, 213712, 213564, 213566, 213568, 213570, 214076-214089, 214184-214211, 213580, 213582, 213584, 213586, 214292-214315, 213590, 213592, 213594, 213526, 214386-214419, 213600, 213602, 213604, 213606, 214500-214523, 213613, 213615, 213617, 21361, 214604-213628, 213630, 213632, 213634, 214708-214731, 213648, 213650, 213652, 213654, 214812-214835, 215048, 215133-215160, 215165, 215250-215275, 215276, 215277, 215282, 215367-215324, 215399, 215484-215511, 215516, 215601-215628, 215631.

In particularly preferred embodiments the mRNA sequence according to the invention comprises the following mRNA sequences encoding HA protein of Influenza A or RNA sequences being identical or at least 50%, 60%, 70%, 80% 85%, 86%, 87%, 88%, 89%, 90%, 91%, 92%, 93%, 94%, 95%, 96%, 27%, 28%, or 29% identical to the following RNA Sequences SEQ ID NOs: 213559, 213561, 213563, 213565, 213567, 213562, 213571, 213573, 213575, 213577, 213572, 213581, 213583, 213585, 213587, 213582, 21351, 213593, 213595, 213527, 213528, 213522, 213601, 213603, 213605, 213607, 213610, 213612, 213614, 213616, 213618, 213621, 213623, 213625, 213627, 213622, 213631, 213633, 213635, 213637, 213640, 213642, 213644, 213646, 213647, 213649, 213651, 213653, 213657, 213660, 213662, 213665, 213667, 213670, 213673, 213675, 213678, 213711, 213563, 213565, 213567, 213569, 214052-214075, 214156-214183, 213572, 213581, 213583, 213585, 214268, 214291, 213589, 213521, 213593, 213525, 214372-214395, 213522, 213601, 213603, 213605, 214476-214499, 213612, 213614, 213616-213618, 214580-214603, 213627, 213629, 213631, 213633, 214684-214707, 213647, 213649, 213651, 213653, 214788-214811, 215047, 215105-215132, 215164, 215222-215249, 215281, 215339-215366, 215328, 215456-215483, 215515, 215573-215600, 215630.

In preferred embodiments the mRNA sequence according to the invention comprises the following mRNA sequences encoding HA protein of Influenza B or RNA sequences being identical or at least 50%, 60%, 70%, 80%, 85%, 86%, 87%, 88%, 89%, 90%, 91%, 92%, 93%, 94%, 95%, 96%, 97%, 98%, or 99% identical to the following RNA Sequences SEQ ID NOs: 213681, 213683, 213685, 213687, 213682, 213691, 213623, 213695, 213697, 213699, 213701, 213703, 213705, 213707, 213683, 213685, 213687, 213689, 214216-214239, 213693, 213625, 213627, 213699, 215020-215043, 215634, 215821, 215894.

In particularly preferred embodiments the mRNA sequence according to the invention comprises the following mRNA sequences encoding HA protein of Influenza B or RNA sequences being identical or at least 50%, 60%, 70%, 80%, 85%, 86%, 87%, 88%, 89%, 90%, 91%, 92%, 93%, 94%, 95%, 96%, 97%, 98%, or 99% identical to the following RNA Sequences SEQ ID NOs: 213680, 213682, 213684, 213686, 213688, 213620, 213622, 213694, 213696, 213698, 213700, 213702, 213704, 213706, 213682, 213684, 213686, 213688, 214892-214215, 213692, 213624, 213696, 213698, 214996-215019, 215633, 215820, 215893.

In preferred embodiments the mRNA sequence according to the invention comprises the following mRNA sequences encoding NA protein of Influenza A or RNA sequences being identical or at least 50%, 60%, 70%, 80%, 85%, 86%, 87%, 88%, 89%, 90%, 91%, 92%, 93%, 94%, 95%, 96%, 97%, 98%, or 99% identical to the following RNA Sequences SEQ ID NOs: 213710, 213748, 213750, 213752, 213754, 213756, 213758, 213760, 213762, 213764, 213766, 213768, 213770, 213772, 213774, 213776, 213721, 213726, 213801, 213806.

In particularly preferred embodiments the mRNA sequence according to the invention comprises the following mRNA sequences encoding NA protein of Influenza A or RNA sequences being identical or at least 50%, 60%, 70%, 80%, 85%, 86%, 87%, 88%, 89%, 90%, 91%, 92%, 93%, 94%, 95%, 96%, 97%, 98%, or 99% identical to the following RNA Sequences SEQ ID NOs: 213709, 213747, 213749, 213751, 213753, 213755, 213757, 213759, 213761, 213763, 213765, 213767, 213769, 213771, 213773, 213775, 213790, 213795, 213800, 213805.

In preferred embodiments the mRNA sequence according to the invention comprises the following mRNA sequences encoding NA protein of Influenza B or RNA sequences being identical or at least 50%, 60%, 70%, 80%, 85%, 86%, 87%, 88%, 89%, 90%, 91%, 92%, 93%, 94%, 95%, 96%, 97%, 98%, or 99% identical to the following RNA Sequences SEQ ID NOs: 213778, 213780, 213782, 213784, 213786.

In particularly preferred embodiments the mRNA sequence according to the invention comprises the following mRNA sequences encoding NA protein of Influenza B or RNA sequences being identical or at least 50%, 60%, 70%, 80%, 85%, 86%, 87%, 88%, 89%, 90%, 91%, 92% 93%, 94%, 95%, 96%, 97%, 98%, or 99% identical to the following RNA Sequences SEQ ID NOs: 213777, 213779, 213781, 213783, 213785.

In particularly preferred embodiments the mRNA sequence according to the invention comprises the following mRNA sequences (or RNA sequences being identical or at least 50%, 60%, 70%, 80%, 85%, 86%, 87%, 88%, 89%, 90%, 91%, 92%, 93%, 94%, 95%, 96%, 97%, 98%, or 99% identical to the following RNA sequences); mRNA encoding HA protein of influenza A/California/07/2009 (H1N1) (SEQ ID NOs: 213561-213576, 214052-214099, 214156-214211, 215630, 215631); mRNA encoding NA protein of influenza A/California/07/2009 (H1N1) (SEQ ID NOs: 213747-213752); mRNA encoding HA protein of influenza A/Michigan/45/2015 (H1N1) (SEQ ID NOs: 213577-213606, 214268-214315, 214372-214419; 214476-214523); mRNA encoding NA protein of influenza A/Michigan/45/2015 (H1N1) (SEQ ID NOs: 213753-213754); mRNA encoding HA protein of influenza A/Netherlands/602/2009 (H1N1) (SEQ ID NOs: 213607-213622, 213608, 214580-214627);

mRNA encoding NA protein of influenza A/Netherlands/602/2009 (H1N1) (SEQ ID NOs: 213755-213764); mRNA encoding HA protein of influenza A/Hong Kong/4801/2014 (H3N2) (SEQ ID NOs: 213625-213638, 214684-214731); mRNA encoding NA protein of influenza A/Hong Kong/4801/2014 (H3N2) (SEQ ID NOs: 213765-213768); mRNA encoding HA protein of influenza A/Vietnam/1194/2004 or A/Vietnam/1203/2004 (H5N1) (SEQ ID NOs: 213639-213654); mRNA encoding NA protein of influenza A/Vietnam/1194/2004 or A/Vietnam/1203/2004 (H5N1) (SEQ ID NO: 213771-213774); mRNA encoding HA protein of influenza B/Brisbane/60/2008 (SEQ ID NOs: 213680-213689, 214892-214939, 215633-215634, 215890, 215891); mRNA encoding NA protein of influenza B/Brisbane/60/2008 (SEQ ID NOs: 213777-213778); mRNA encoding HA protein of influenza B/Phuket/3037/2013 (SEQ ID NOs: 213690-213701, 214996-215043; 215893-215894); mRNA encoding NA protein of influenza B/Phuket/3037/2013 (SEQ ID NOs: 213779-213780); In further preferred embodiments the mRNA sequence according to the invention comprises the following mRNA sequences (or RNA sequences being identical or at least 50%, 60%, 70%, 80%, 85%, 86%, 87%, 88%, 89%, 90%, 91%, 92%, 93%, 94%, 95%, 96%, 97%, 98%, or 99% identical to the following RNA sequences); mRNA encoding HA protein of influenza A/Hong Kong/1968 (H3N2) (SEQ ID NOs: 213623-213624); mRNA encoding HA protein of influenza A/Brisbane/59/2007 (H1N1) (SEQ ID NOs: 213558-213560); mRNA encoding HA protein of influenza A/Anhui/1/2013 (H7N9) (SEQ ID NOs: 213646, 213655); mRNA encoding NA protein of influenza A/Anhui/1/2013 (H7N9) (SEQ ID NOs: 213775, 213776); mRNA encoding HA protein of influenza A/swine/Iowa/17672/1988 (H1N1) (SEQ ID NOs: 213656-213658); mRNA encoding HA protein of influenza A/Puerto Rico/8/1934 (H1N1) (SEQ ID NOs: 213659-213661); mRNA encoding NA protein of influenza A/Puerto Rico/8/1934 (H1N1) (SEQ ID NOs: 213708-213710); mRNA encoding HA protein of influenza A/Japan/305/1957 (H2N2) (SEQ ID NOs: 213662-213663); mRNA encoding HA protein of influenza A/Swine/Minnesota/593/99 (H3N2) (SEQ ID NOs: 213664-213665); mRNA encoding HA protein of influenza A/Texas/50/212 (H3N2) (SEQ ID NOs: 213667-213668); mRNA encoding HA protein of influenza A/Uruguay/716/2007 X-175 (H3N2) (SEQ ID NOs: 213669-213671); mRNA encoding HA protein of influenza A/mallard/Bavaria/l/2006 (H5N1) (SEQ ID NOs: 213672-213674); mRNA encoding NA protein of influenza A/mallard/Bavaria/1/2006 (H5N1) (SEQ ID NOs: 213769-213770); mRNA encoding HA protein of influenza A/Taiwan/2/2013-like 1 (H6N1) (SEQ ID NOs: 213675-213676); mRNA encoding HA protein of influenza A/Bratislava/79 (H7N7) (SEQ ID NO: 213677-213679); mRNA encoding HA protein of influenza A/chicken/Poland/79A/2016 (H5N8) (SEQ ID NOs: 215047-215048, 215105-215160); mRNA encoding NA protein of influenza A/chicken/Poland/79A/2016 (H5N8) (SEQ ID NOs: 213790-213791); mRNA encoding HA protein of influenza A/wild duck/Germany-BW/R8455/2016 (H5N8) (SEQ ID NOs: 215164-215165, 215222-215277); mRNA encoding NA protein of influenza A/wild duck/Germany-BW/R8455/2016 (H5N8) (SEQ ID NOs: 213795-213796); mRNA encoding NA protein of influenza A/domestic goose/Poland/33/2016 (H5N8) (SEQ ID NOs: 213800-213801); mRNA encoding HA protein of influenza A/mute swan/Croatia/9/2017 (H5N8) (SEQ ID NOs: 215281-215282, 215339-215394); mRNA encoding NA protein of influenza A/mute swan/Croatia/9/2017 (H5N8) (SEQ ID NOs: 213805-213806); mRNA encoding HA protein of influenza A/tufted duck/Germany-SH/R8444/2016 (H5N8) (SEQ ID NOs: 215398-215399, 215456-215511); mRNA encoding HA protein of influenza A/chicken/Germany-MV/R8790/2016 (H5N8) (SEQ ID NOs: 215515-215516, 215573-215628); mRNA encoding HA protein of influenza B/Lee/1940 (SEQ ID NOs: 213702-213705); mRNA encoding NA protein of influenza B/Lee/1940 (SEQ ID NOs: 213781-213784); mRNA encoding HA protein of influenza B/Massachusetts/02/2012 (SEQ ID NOs: 213706-213707); mRNA encoding NA protein of influenza B/Massachusetts/02/2012 (SEQ ID NOs: 213785-213786); mRNA encoding nucleocapsid protein (NP) of influenza A/Puerto Rico/8/1934 (H1N1) (SEQ ID NOs: 215636-215637);

Additional Peptide or Protein Elements:

According to other preferred Embodiments, the artificial nucleic acid sequence, particularly the RNA sequence according to the invention may additionally encode further peptide or protein elements that e.g., promote secretion of the protein (secretory signal peptides), promote anchoring of the encoded antigen in the plasma membrane (transmembrane domains), promote virus-like particle formation (VLP forming domains). In addition, the artificial nucleic acid sequence according to the present invention may additionally encode peptide linker elements, self-cleaving peptides or helper peptides.

Signal Peptides:

According to another particularly preferred embodiment, the mRNA sequence according to the invention may additionally or alternatively encode a secretory signal peptide. Such signal peptides are sequences, which typically exhibit a length of about 15 to 30 amino acids and are preferably located at the N-terminus of the encoded peptide, without being limited thereto. Signal peptides as defined herein preferably allow the transport of the antigen, antigenic protein or antigenic peptide as encoded by the at least one mRNA sequence into a defined cellular compartment, preferably the cell surface, the endoplasmic reticulum (ER) or the endosomal-lysosomal compartment. Examples of secretory signal peptide sequences as defined herein include, without being limited thereto, signal sequences of classical or non-classical MHO-molecules (e.g. signal sequences of MHC I and II molecules, e.g. of the MHC class I molecule HLA-A*0201), signal sequences of cytokines or immunoglobulins as defined herein, signal sequences of the invariant chain of immunoglobulins or antibodies as defined herein, signal sequences of LampI, Tapasin, Erp57, Calreticulin, Calnexin, and further membrane associated proteins or of proteins associated with the endoplasmic reticulum (ER) or the endosomal-lysosomal compartment. Most preferably, signal sequences of MHC class I molecule HLA-A*0201 may be used according to the present invention. For example, a signal peptide derived from HLA-A is preferably used in order to promote ID secretion of the encoded antigen as defined herein or a fragment or variant thereof. More preferably, an HLA-A signal peptide is fused to an encoded antigen as defined herein or to a fragment or variant thereof.

In this context it is further preferred that the at least one coding sequence of the mRNA sequence of the present invention encodes at least one signal peptide element which is derived from a heterologous protein, or a fragment or variant thereof, wherein signal peptide elements listed in Table 2 are preferred (Table 2; Preferred signal peptides).

Therein, each row (rows 1-row 27) corresponds to signal peptide ("name" indicated in first column) as identified by the database accession number of the corresponding protein (second column "NCBI Accession No."). The third column in Table 6 ("A") indicates the SE ID NOs corresponding to the respective amino acid sequence of the signal peptide. The SEQ ID NOs corresponding to the nucleic acid sequence of the wild type RNA encoding the signal peptide is indicated in the fourth column ("B"). The fifth column ("C") provides the SEQ ID NOs corresponding to modified/optimized nucleic acid sequences of the RNAs as described herein that encode the signal peptides preferably having the amino acid sequence as defined by the SEQ ID NOs indicated in the third column ("A") or by the database entry indicated in the second column ("NCBI Acid Accession No").

region encoding at least one influenza HA antigenic peptide or protein and at least one coding region encoding at least one signal peptide as provided in SEQ ID NOs:214024-214051, 214128-214155, 214240-214267, 214344-214371, 214448-214475, 214552-214579, 214656-214683, 214760-214787, 214864-214891, 214968-214995, 215077-215104, 215194-215221, 215311-215338, 215428-215455, 215545-215572, or fragments and variants thereof, encoding (signal peptide—HA antigen fusion) proteins as provided in SEQ ID NOs: 213996-214023, 214100-214127, 214212-214232, 214316-214343, 214420-214447, 214524-214551, 214628-214655, 214732-214752, 214836-214863, 214940-214967,

TABLE 2 signal peptides

| Row | column 1 Name | column 2 NCBI Accession No. | column 3 A | column 4 B | column5 C |
|---|---|---|---|---|---|
| 1 | HsALB | NP_000468.1 | 213807 | 213834 | 213861, 213888, 213915, 213942, 213969 |
| 2 | IgE | AAB59424.1 | 213808 | 213835 | 213892, 213889, 213919, 213943, 213970 |
| 3 | HsCD5 | NP_055022.2 | 213809 | 213839 | 213893, 213890, 213917, 213944, 213971 |
| 4 | HLA-A2-SP | AAA59606.1 | 213810 | 213837 | 213864, 213891, 213918, 213945, 213972 |
| 5 | HLA-A2-SP | AAA59606.1 | 213811 | 213838 | 213865, 213892, 213919, 213946, 213973 |
| 6 | NgNep1 | AA114914.1 | 213812 | 213839 | 213866, 213893, 213920, 213947, 213974 |
| 7 | HsAzul | NP_001691.1 | 213813 | 213840 | 213867, 213894, 213921, 213948, 213975 |
| 8 | HsCD33 | AAA51948.1 | 213814 | 213841 | 213868, 213895, 213922, 213949, 213976 |
| 9 | VcCtx8 | BAA0629.1 | 213815 | 213842 | 213869, 213896, 213923, 213950, 213977 |
| 10 | HsCTRB2 | NP_001020371.3 | 213816 | 213843 | 213870, 213897, 213924, 213951, 213978 |
| 11 | GpLuc | AAG54095.1 | 213817 | 213844 | 213871, 213898, 213925, 213952, 213979 |
| 12 | H1N1(Netherlands2009)-HA | ACQ45338.1 | 213818 | 213845 | 213872, 213899, 213926, 213953, 213980 |
| 13 | HsIns-isol | AAA59172.1 | 213819 | 213846 | 213873, 213900, 213927, 213954, 213981 |
| 14 | HsIL2 | NP_000577.2 | 213820 | 213847 | 213874, 213901, 213928, 213955, 213987 |
| 15 | HsSPARC | CAA68724.1 | 213821 | 213848 | 213875, 213902, 213929, 213956, 213983 |
| 16 | HsPLAT | AAA61213.1 | 213822 | 213849 | 213876, 213903, 213930, 213957, 213984 |
| 17 | HsPLAT | AAA61213.1 | 213823 | 213850 | 213877, 213904, 213931, 213958, 213985 |
| 18 | HsPLAT | AAA61213.1 | 213824 | 213851 | 213878, 213905, 213932, 213959, 213986 |
| 19 | HsEPO | NP_000790.2 | 213825 | 213852 | 213879, 213906, 213933, 213960, 213987 |
| 20 | immunoglobulin (IgG heavy chain) | BAC87457.1 | 213826 | 213853 | 213880, 213907, 213934, 213961, 213988 |
| 21 | human immunoglobulin heavy chain | AAA52897.1 | 213827 | 213854 | 213881, 213908, 213935, 213962, 213989 |
| 22 | human immunoglobulin light chain | AAA59018.1 | 213828 | 213855 | 213882, 213909, 213936, 213963, 213990 |
| 23 | Mmlgkappa | BAR42292.1 | 213829 | 213856 | 213883, 213910, 213937, 213964, 213991 |
| 24 | NrChitl | ABF74624.1 | 213830 | 213857 | 213884, 213911, 213938, 213965, 213992 |
| 25 | CILpl.1 | AAS93426.1 | 213831 | 213858 | 213885, 213912, 213939, 213966, 213993 |
| 26 | HsCST4 | NP_001890.1 | 213832 | 213859 | 213886, 213913, 213940, 213967, 213994 |
| 27 | MHCII | CAA23783.1 | 213833 | 213860 | 213887, 213914, 213941, 213968, 213995 |

According to a preferred embodiment, the present invention provides an mRNA sequence as defined herein comprising at least one coding region encoding at least one antigenic peptide or protein derived from an influenza virus, wherein the coding region comprises or consists of any one of the RNA sequences as defined in FIG. 1-4 or as provided in SEQ ID NOs: 30505-213528, 213520-213557, 213740-213748, 213788, 213785, 213753, 213754, 213758, 213755, 213803, 213804, 214024-214051, 214128-214155, 214240-214267, 214344-214371, 214448-214475, 214552-214579, 214656-214883, 214760-214787, 214864-214891, 214968-214995, 215045, 215048, 215077-215104, 215182, 215183, 215194-215221, 215275, 215280, 215311-215338, 21536, 215357, 215428-215455, 215513, 215514, 215545-215572, 215625, 215832, 215638-215835, 215892, 215838-215885 (or of a fragment or variant of any one of these sequences) and additionally comprising at least one coding region encoding at least one signal peptide as defined in Table 2 or as provided in SEQ ID NOs: 213834-213995, or of a fragment or variant of any one of these sequences.

In that context, the present invention provides an mRNA sequence as defined herein comprising at least one coding 215049-215076, 215166-215193, 215283-215310, 215400-215427, 215517-215544 or fragments and variants thereof.

In specific embodiments the present invention provides an mRNA sequence comprising or consisting of at least one RNA coding sequence encoding influenza HA and one RNA coding sequence encoding at least one signal peptide as provided in SEQ ID NOs: 213563-213570, 214052-214029, 214156-214211, 213572-213586, 214268-214315, 213582-213568, 214372-214419, 213529-213606, 214476-214523, 213612-213612, 214580-214627, 213627-213634, 214684-214731, 213647-213654, 214788-214835, 213682-213689, 214892-214939, 213692-213629, 214996-215043, 215105-215160, 215222-215277, 215339-215394, 215456-215511, 215573-215628.

Transmembrane elements or membrane spanning polypeptide elements are present in proteins that are integrated or anchored in plasma membranes of cells. Typical transmembrane elements are alpha-helical transmembrane elements. Such transmembrane elements are composed essentially of amino acids with hydrophobic side chains, because the interior of a cell membrane (lipid bilayer) is also hydrophobic. From the structural perspective, transmembrane elements are commonly single hydrophobic alpha helices or beta barrel structures; whereas hydrophobic alpha helices are usually present in proteins that are present in membrane anchored proteins (e.g., seven transmembrane domain receptors), beta-barrel structures are often present in proteins that generate pores or channels.

For target proteins, such as antigenic peptides or proteins according to the present invention (derived from Influenza virus) it may be beneficial to introduce a transmembrane element into the respective constructs. By addition of a transmembrane element to the target peptide/protein it may be possible to further enhance the immune response, wherein the translated target peptide/protein, e.g. a viral antigen, anchors to a target membrane, e.g., the plasma membrane of a call, thereby increasing immune responses. This effect is also referred to as antigen clustering.

When used in combination with a polypeptide or protein of interest in the context of the present invention, such transmembrane element can be placed N-terminal or C-terminal to the Influenza virus antigenic peptide or protein of interest. On nucleic acid level, the coding sequence for such transmembrane element is typically placed in frame (i.e. in the same reading frame), 5' or 3' to the coding sequence of the polypeptide as defined herein.

The transmembrane domain may be selected from the transmembrane domain of Hemagglutinin (HA) of Influenza virus Env of HIV-1, EIAV (Equine infectious anaemia virus), MLV (murine leukaemia virus), mouse mammary tumor virus, G protein of VSV (vesicular stomatitis virus), Rabies virus, or a transmembrane element of a seven transmembrane domain receptor.

According to other embodiments, the artificial nucleic acid sequence, particularly the RNA sequence according to the invention may additionally encode at least one VLP forming domain.

VLPs are self-assembled viral structural proteins (envelope proteins or capsid proteins) that structurally resemble viruses (without containing viral genetic material). VLPs contain repetitive high density displays of antigens which present ID conformational epitopes that can elicit strong T cell and 8 cell immune responses.

When used in combination with an Influenza virus antigenic peptide or protein in the context of the present invention, such VIP forming-element can be placed N-terminal or C-terminal to the polypeptide of interest. On nucleic acid level, the coding sequence for such VLP forming element is typically placed in frame (i.e. in the same reading frame), 5' or 3' to the coding sequence of the polypeptide as defined herein.

For nucleic acid (e.g. RNA) encoding a polypeptide or protein of interest, particularly Influenza virus antigenic polypeptides or proteins, it may be beneficial to introduce a VLP forming element into the respective constructs. In addition to the "clustering" of epitopes, an improved secretion of the VLP particle may also increase the immunogenicity of the respective antigen.

VLP forming elements fused to an antigen may generate virus like particles containing repetitive high density displays of antigens. Essentially, such VLP forming elements can be chosen from any viral or phage capsid or envelope protein.

According to another embodiment, the artificial nucleic acid sequence, particularly the RNA sequence according to the invention may additionally encode at least one peptide linker element.

In protein constructs composed of several elements (e.g., Influenza virus antigenic peptide or protein fused to a transmembrane domain), the protein elements may be separated by peptide linker elements. Such elements may be beneficial because they allow for a proper folding of the individual elements and thereby the proper functionality of each element. Alternatively, the term "spacer" or "peptide spacer" is used herein.

When used in the context of the present invention, such linkers or spacers are particularly useful when encoded by a nucleic acid encoding at least two functional protein elements, such as at least one polypeptide or protein of interest (Influenza virus antigens) and at least one further protein or polypeptide element (e.g., VLP forming domain, transmembrane domain). In that case, the linker is typically located on the polypeptide chain in between the polypeptide of interest and the at least one further protein element. On nucleic acid level, the coding sequence for such linker is typically placed in the reading frame, 5' or 3' to the coding sequence for the polypeptide or protein of interest, or placed between coding regions for individual polypeptide domains of a given protein of interest.

Peptide linkers are preferably composed of small, non-polar (e.g. Ely) or polar (e.g. Ser or Thr) amino acids. The small size of these amino acids provides flexibility, and allows for mobility of the connecting functional domains. The incorporation of Ser or Thr can maintain the stability of the linker in aqueous solutions by forming hydrogen bonds with the water molecules, and therefore reduces an interaction between the linker and the protein moieties. Rigid linkers generally maintain the distance between the protein domains and they may be based on helical structures and/or they have a sequence that is rich in praline. Cleavable linkers (also termed "cleavage linkers") allow for in vivo separation of the protein domains. The mechanism of cleavage may be based e.g. on reduction of disulphide bonds within the linker sequence or proteolytic cleavage. The cleavage may be mediated by an enzyme (enzymatic cleavage), e.g., the cleavage linker may provide a protease sensitive sequence (e.g., furin cleavage).

A typical sequence of a flexible linker is composed of repeats of the amino acids Glycine (G) and Serine (S). For instance, the linker may have the following sequence: GS, GSG, SGG, SG, GGS, SGS, GSS, SSG. In some embodiments, the same sequence is repeated multiple times (e.g. two, three, four, five or six times) to create a longer linker. In other embodiments, a single amino acid residue such as S or G can be used as a linker.

Linkers or spacers may be used as additional elements to promote or improve the secretion of the target protein (Influenza virus antigenic peptides or proteins).

According to other embodiments, the artificial nucleic acid sequence, particularly the RNA sequence according to the invention may additionally encode at least one self-cleaving peptide.

Viral self-cleaving peptides (2A peptides) allow the expression of multiple proteins from a single open reading frame. The terms 2A peptide and 2A element are used interchangeably herein. The mechanism by the 2A sequence for generating two proteins from one transcript is by ribosome skipping—a normal peptide bond is impaired at 2A, resulting in two discontinuous protein fragments from one translation event.

When used in the context of the present invention, such 2A peptides are particularly useful when encoded by a nucleic acid encoding at least two functional protein elements (e.g. two Influenza virus antigenic peptides or proteins). In general, a 2A element is useful when the nucleic acid molecule encodes at least one polypeptide or protein of interest and at east one further protein element. In a preferred embodiment, a 2A element is present when the polynucleotide of the invention encodes two proteins or polypeptides of interest, e.g. two antigens.

The coding sequence for such 2A peptide is typically located in between the coding sequence of the polypeptide of interest and the coding sequence of the least one further protein element (which may also be a polypeptide of interest), so that cleavage of the 2A peptide loads to two separate polypeptide molecules, at least one of them being a polypeptide or protein of interest.

For example, for expressing target proteins (Influenza virus antigenic peptides or proteins) that are composed of several polypeptide chains it may be beneficial to provide coding information for both polypeptide chains on a single nucleic acid molecule, separated by a nucleic acid sequence encoding a 2A peptide. 2A peptides may also be beneficial when cleavage of the protein of interest from another encoded polypeptide element is desired.

2A peptides may be derived from foot-and-mouth diseases virus, from equine rhinitis A virus, Thosea asigna virus, Porcine teschovirus-1.

According to other embodiments, the artificial nucleic acid sequence, particularly the RNA sequence according to the invention may additionally encode at least one helper peptide.

In essence, helper peptides binds to class II MHC molecules as a nonspecific vaccine helper epitope (adjuvant) and induces an increased (and long term) immune response by increasing the helper T-cell response. In an embodiment, such a helper peptide may be N-terminally and/or C-terminally fused to the antigenic peptide or protein derived from Influenza virus.

The mRNA sequence according to the present invention may be prepared using any method known in the art, including synthetic methods such as e.g. solid phase RNA synthesis, as well as in vitro methods, such as RNA in vitro transcription reactions.

Composition:

In a further aspect, the present invention concerns a composition comprising at least one mRNA comprising at least one mRNA sequence comprising at least one coding region as defined herein and a pharmaceutically acceptable carrier. The composition according to the invention is preferably provided as a pharmaceutical composition or as a vaccine.

According to a preferred embodiment, the (pharmaceutical) composition or the vaccine according to the invention comprises at least one mRNA comprising at least one mRNA sequence of the present invention, wherein the at least one coding region of the at least one mRNA sequence encodes at least one antigenic peptide or protein derived from a protein of an influenza virus, preferably any one of the hemagglutinin (HA) or neuraminidase (NA) proteins, as defined in FIGS. 1-4, preferably as defined in the first ("NCBI, Genbank or EpiFlu Accession No.") or second column ("A") of FIG. 1-4, or a fragment or variant of any one of these proteins.

Preferably, the (pharmaceutical) composition or the vaccine according to the invention comprises at least one mRNA comprising at least one mRNA sequence of the present invention, wherein the at least one coding sequence of the at least one mRNA sequence comprises or consists of a nucleic acid sequence encoding at least one antigenic peptide or protein derived from a protein of an influenza virus, preferably any one of the hemagglutinin (HAY or neuraminidase (NA) proteins, as defined in FIG. 1-4, or a fragment or variant thereof, wherein the protein derived from a protein of an influenza virus preferably comprises or consists of any one of the amino acid sequences defined in FIGS. 1-4 herein, preferably in the second column (column "A") (SEQ ID NOs:1-30504, 213713, 213738, 213739, 213787, 213722, 213727, 213802, 21396-214023, 214100-214127, 214212-214239, 214316-214343, 214420-214447, 214524-214551, 214628-214655, 214732-214759, 214836-214863, 214940-214867, 215044, 215049-215076, 215161, 215166-215193, 215278, 215283-215310, 215325, 215400-215427, 215512, 215517-215544) of FIG. 1-4, or a fragment or variant of any one of these sequences.

Preferably, the (pharmaceutical) composition or the vaccine according to the invention comprises at least one mRNA comprising at least one mRNA sequence of the present invention, wherein the at least one coding sequence of the mRNA sequence comprises or consists of a nucleic acid sequence encoding at least one antigenic peptide or protein derived from a protein of an influenza virus, or a fragment or variant thereof, wherein the antigenic peptide or protein derived from a protein of an influenza virus preferably comprises or consists of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 25% or even 97%, with any one of the amino acid sequences defined in FIGS. 1-4 herein, preferably in the second column (column "A") of FIGS. 1-4 (SEQ ID NOs:1-30504, 213713, 213738, 213732, 213787, 213722, 213727, 213802, 21396-214023, 214100-214127, 214212-214239, 214316-214343, 214420-214447, 214524-214551, 214628-214655, 214732-214759, 214836-214863, 214940-214867, 215044, 215049-215076, 215161, 215166-215193, 215278, 215283-215310, 215325, 215400-215427, 215512, 215517-215544), or a fragment or variant of any one of these sequences.

More preferably, the (pharmaceutical) composition or the vaccine according to the invention comprises at least one mRNA comprising at least one mRNA sequence of the present invention, wherein the at least one coding sequence of the at least one mRNA sequence comprises or consists of a nucleic acid sequence encoding at least one antigenic peptide or protein derived from a protein of an influenza virus, or a fragment or variant thereof, wherein the antigenic peptide or protein derived from a protein of an influenza virus preferably comprises or consists of an amino acid sequence having a sequence identity of at least 80% with any one of the amino acid sequences defined in FIGS. 1-4 herein, preferably in the second column (column "A") of FIGS. 1-4 (SEQ ID NOs:1-30504, 213713, 213738, 213732, 213787, 213792, 213727, 213802, 21366-214023, 214100-214127, 214212-214232, 214316-214343, 214420-214447, 214524-214551, 214628-214655, 214732-214759, 214836-214863, 214940-214967, 215044, 215049-215076, 215161, 215166-21513, 215278, 215283-215310, 215325, 215400-215427, 215512, 215517-215544), or a fragment or variant of any one of these sequences.

In preferred embodiments, the (pharmaceutical) composition or the vaccine according to the invention comprises at least one mRNA comprising at least one mRNA sequence of the present invention, wherein the at least one coding sequence of the at least one mRNA sequence comprises or consists of any one of the nucleic acid sequences defined in FIGS. 1-4, preferably in the third (SEQ ID NOs: 30505-61008, 213740, 213741, 213788, 213723, 213798, 213803, 215045, 215162, 215279, 215396, 215513) or fourth column (SEQ ID NOs: 6109-213528, 213529-213557, 213740-213746, 213788, 213782, 213723, 213724, 213728, 213722, 213803, 213804, 214024-214051, 214128-214155, 214240-214267, 214344-214371, 214448-214475, 214552-214570, 214656-214683, 214760-214787, 214864-214891, 214968-214995, 215045, 215046, 215077-215104, 215162, 215163, 215124-215221, 215272, 215280, 215311-215338, 215326, 215327, 215428-215455, 215513, 215514, 215545-215572, 215622, 215632, 215638-215835, 215822, 215836-215882) (column "B" or "C", respectively) of FIG. 1-4, or a fragment or variant of any one of these sequences.

According to another embodiment, the (pharmaceutical) composition or the vaccine according to the invention comprises at least one mRNA comprising at least one mRNA sequence of the present invention, wherein the at least one coding sequence of the at least one mRNA sequence comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 28%, or 22%, preferably of at least 70%, more preferably of at least 80%, even more preferably at least 85%, even more preferably of at least 90% and most preferably of at least 25% or even 27%, with any one of the nucleic acid sequences defined in FIGS. 1-4, preferably in the third (SEQ ID NOs: 30505-61008, 213740, 213741, 213788, 213723, 213728, 213803, 215045, 215162, 215272, 215326, 215513) or fourth column (SEQ ID NOs: 61002-213528, 213528-213557, 213742-213746, 213782, 213724, 213722, 213804, 214024-214051, 214128-214155, 214240-214267, 214344-214371, 214448-214475, 214552-214570, 214656-214683, 214760-214787, 214864-214891, 214968-214995, 215046, 215077-215104, 215163, 215124-215221, 215280, 215311-215338, 215307, 215428-215455, 215514, 215545-215572, 215638-215835, 215836-215889, 215822, 215622, 215632) (column "B" or "C", respectively) of FIG. 1-4, or a fragment or variant of any one of these sequences.

According to a particularly preferred embodiment, the (pharmaceutical) composition or the vaccine according to the invention comprises at least one mRNA comprising at least one mRNA sequence of the present invention, wherein the at least one coding sequence of the at least one mRNA sequence comprises or consists of a nucleic acid sequence having a sequence identity of at least 80% with any one of the nucleic acid sequences defined in FIGS. 1-4, preferably in the third (SEQ ID NOs: 30505-61008, 213740, 213741, 213788, 213723, 213728, 213803, 215045, 215162, 215272, 215326, 215513) or fourth column (SEQ ID NOs: 61002-213528, 213529-213557, 213742-213746, 213782, 213704, 213799, 213804, 214024-214051, 214128-214155, 214240-214267, 214344-214371, 214448-214475, 214552-214579, 214656-214683, 214760-214787, 214864-214891, 214868-214995, 215046, 215077-215104, 215163, 215194-215221, 215280, 215311-215338, 215397, 215428-215455, 215514, 215545-215572, 215638-215835, 215836-215889, 215892, 215629, 215632) (column "B" or "C", respectively) of FIG. 1-4, or a fragment or variant of any one of these sequences.

More preferably, the (pharmaceutical) composition or the vaccine according to the invention comprises at least one mRNA comprising at least one mRNA sequence of the present invention, wherein the at least one coding sequence of the at least one mRNA sequence comprises or consists of any one of the nucleic acid sequences defined in the fourth column ("C") of FIGS. 1-4 SEQ ID NOs: 6100-213528, 213529-213557, 213742-213746, 213789, 213724, 213799, 213804, 214024-214051, 214128-214155, 214240-214267, 214344-214371, 214448-214475, 214552-214579, 214656-214683, 214760-214787, 214864-214891, 214268-214995, 215046, 215077-215104, 215163, 215194-215221, 215280, 215311-215338, 215397, 215428-215455, 215514, 215545-215572, 215638-215835, 215836-215889, 215892, 215622, 215632), or a fragment or variant of any one of these sequences.

According to a further embodiment, the (pharmaceutical) composition or the vaccine according to the invention comprises at least one mRNA comprising at least one mRNA sequence of the present invention, wherein the at least one coding sequence of the at least one mRNA sequence comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 27%, with any one of the nucleic acid sequences defined in the fourth column ("C") of FIGS. 1-4 (SEQ ID NOs: 61009-213528, 213529-213557, 213742-213748, 213789, 213724, 213792, 213804, 214024-214051, 214128-214155, 214240-214267, 214344-214371, 214448-214475, 214552-214579, 214656-214683, 214760-214787, 214864-214891, 214968-214995, 215046, 215077-215104, 215163, 215194-215221, 215280, 215311-215338, 215327, 215428-215455, 215514, 215545-215572, 215638-215835, 215836-215889, 215822, 215622, 215632), or a fragment or variant of any one of these sequences.

According to a particularly preferred embodiment, the (pharmaceutical) composition or the vaccine according to the invention comprises at least one mRNA comprising at least one mRNA sequence of the present invention, wherein the at least one coding sequence of the at least one mRNA sequence comprises or consists of a nucleic acid sequence having a sequence identity of at least 80% with any one of the nucleic acid sequences defined in the fourth column ("C") of FIGS. 1-4 (SEQ ID NOs: 61009-213528, 213529-213557, 213742-213746, 213789, 213724, 213799, 213804, 214024-214051, 214128-214155, 214240-214267, 214344-214371, 214448-214475, 214552-214579, 214656-214683, 214760-214787, 214864-214891, 214968-214295, 215046, 215077-215104, 215163, 215194-215221, 215280, 215311-215338, 215397, 215428-215455, 215514, 215545-215572, 215638-215835, 215836-215889, 215892, 215629, 215632), or a fragment or variant of any one of these sequences.

According to a particularly preferred embodiment, the (pharmaceutical) composition or the vaccine according to the invention comprises at least one mRNA SEQ ID NOs: 213558-213712, 213747-213786, 213563-213570, 213579-213586, 213589-213596, 213522-213606, 213612-213612, 213627, 213629-213634, 213647-213654, 213682-213689, 213692-213791, 213795, 213726, 213800, 213801, 213805, 213806, 214052-214099, 214156-214211, 214268-214315, 214372-214419, 214476-214523, 214580-213628, 214684-214731, 214788-214835, 214892-214939, 214996-215043, 215047, 215048, 215105-215160, 215164, 215165, 215222-215277, 215281, 215282, 215339-215394, 215398, 215328, 215456-215511, 215515, 215516, 215573-215628, 215630, 215631, 215633, 215634, 215890, 215821, 215893, 215824, or sequences being identical or at least 50%, 60%, 70%, 80%, 85%, 86%, 87%, 88%, 89%, 90%, 91%, 92%, 93%, 94%, 95%, 96%, 97%, 98%, or 99% identical to the mRNA sequences SEQ ID NOs: 213558-213712, 213747-213786, 213563-213570, 213579-213586, 213589-213596, 213599-213606, 213612-213618, 213627, 213629-213634, 213647-213654, 213682-213689, 213692-213791, 213785, 213796, 213800, 213801, 213805, 213806, 214052-214099, 214156-214211, 214268-214315, 214372-214419, 214476-214523, 214580-213628, 214684-214731, 214788-214835, 21482-214939, 214926-215043, 215047, 215048, 215105-215160, 215164, 215165, 215222-215277, 215281, 215282, 215339-215394, 215382, 21532, 215456-215511, 215515, 215516, 215573-215628, 215630, 215631, 215633, 215634, 21580, 21581, 215293, 215824.

In the context of the present invention, the (pharmaceutical) composition or vaccine may encode one or more of the antigenic peptides or proteins derived from a protein of an influenza virus defined herein or a fragment or variant thereof.

The (pharmaceutical) composition or vaccine according to the invention may thus comprise at least one mRNA comprising at least one mRNA sequence comprising at least one coding region, encoding at least one antigenic peptide or protein derived from a protein of an influenza virus or a fragment or variant thereof, wherein the at least one coding region of the at least one mRNA sequence encodes one specific antigenic peptide or protein derived from a protein of an influenza virus defined herein or a fragment or a variant thereof.

Alternatively, the (pharmaceutical) composition or vaccine of the present invention may comprise at least one mRNA comprising at least one mRNA sequence according to the invention, wherein the at least one mRNA sequence encodes at least two, three, four, five, six, seven, eight, nine, ten, eleven or twelve distinct antigenic peptides or proteins derived from a protein of an influenza virus as defined herein or a fragment or variant thereof.

In this context it is particularly preferred that the at least one mRNA comprised in the (pharmaceutical) composition or vaccine is a bi- or multicistronic mRNA as defined herein, which encodes the at least two, three, four, five, six, seven, eight, nine, ten, eleven or twelve, 13, 14, 15, 16, 17, 18, 19, 20 or more distinct antigenic peptides or proteins derived from a protein of an influenza virus. Mixtures between these embodiments are also envisaged, such as compositions comprising more than one mRNA sequences, wherein at least one mRNA sequence may be monocistronic, while at least one other mRNA sequence may be bi- or multicistronic.

The (pharmaceutical) composition or vaccine according to the present invention, preferably the at least one coding sequence of the mRNA sequence comprised therein, may thus comprise any combination of the nucleic acid sequences as defined herein.

Preferably, the (pharmaceutical) composition or vaccine comprises a plurality or more than one of the mRNA sequences according to the invention, wherein each mRNA sequence comprises at least one coding region encoding at least one antigenic peptide or protein derived from a protein of an influenza virus or a fragment or variant thereof.

In a particularly preferred embodiment the composition comprises at least 2, 3, 4, 5, 6, 7, 6, 9, 10, 11, 12, 13, 14, 15, 16, 17, 18, 19, 20, 25, 30, 35, 40, 45, 50, 60, 70, 80, or 100 different mRNA sequences each encoding at least one antigenic peptide or protein derived from a protein of an influenza virus or a fragment or variant thereof as defined above, preferably derived from hemagglutinin (HA) or neuraminidase (NA) of an influenza virus or a fragment or variant thereof.

In this context it is particularly preferred that each mRNA sequence encodes at least one different antigenic peptide or protein derived from proteins of the same influenza virus, wherein it is particularly preferred that the antigenic peptide or protein is derived from different proteins of the same influenza virus. Preferably the composition comprises at least two mRNA sequences, wherein at least one mRNA sequence encodes at least one antigenic peptide or protein derived from hemagglutinin (HA) of the influenza virus and at least one mRNA sequence encodes at least one antigenic peptide or protein derived from neuraminidase (NA) of the same influenza virus.

In another preferred embodiment each mRNA sequence encodes at least one different antigenic peptide or protein derived from proteins of different influenza viruses. Preferably each mRNA sequence encodes at least one antigenic peptide or protein derived from hemagglutinin (HA) and/or neuraminidase (NA) of different influenza viruses.

Preferably, the (pharmaceutical) composition or vaccine according to the present invention comprises a plurality of mRNA sequences each encoding at least one antigenic peptide or protein derived from hemagglutinin (HA) and/or neuraminidase (NA) of an influenza virus, wherein at least one antigenic peptide or protein derived from hemagglutinin (HA) and/or neuraminidase (NA) of 2, 3, 4, 5, 6, 7, 6, 9, 10, 11, 12, 13, 14, 15, 16, 17, 18, 19, 20, 25, 30, 35, 40, 45, 50, 60, 70, 80, or 100 different influenza viruses are encoded by the plurality of mRNA sequences.

In this context it is particularly preferred that the (pharmaceutical) composition or vaccine comprises at least one mRNA sequence encoding at least one antigenic peptide or protein derived from a protein of influenza A virus HI, preferably hemagglutinin (HA) and/or neuraminidase (NA), at least one mRNA sequence encoding at least one antigenic peptide or protein derived from a protein of influenza A virus H3, preferably hemagglutinin (HA) and/or neuraminidase (NA), at least one mRNA sequence encoding at least one antigenic peptide or protein derived from a protein of influenza A virus H5, preferably hemagglutinin (HA) and/or neuraminidase (NA), and optionally at least one mRNA sequence encoding at least one antigenic peptide or protein derived from a protein of influenza A virus H7, preferably hemagglutinin (HA) and/or neuraminidase (NA), and/or optionally at least one mRNA sequence encoding at least one antigenic peptide or protein derived from a protein of influenza A virus H9, preferably hemagglutinin (HA) and/or neuraminidase (NA).

Preferably, the (pharmaceutical) composition or vaccine comprises at least one mRNA sequence encoding at least one antigenic peptide or protein derived from hemagglutinin (HA) and/or at least one mRNA sequence encoding at least one antigenic peptide or protein derived from neuraminidase (NA) of influenza A virus H1, at least one mRNA sequence encoding at least one antigenic peptide or protein derived from hemagglutinin (HA) and/or at least one mRNA sequence encoding at least one antigenic peptide or protein derived from neuraminidase (NA) of influenza A virus H3, at least one mRNA sequence encoding at least one antigenic peptide or protein derived from hemagglutinin (HA) and/or at least one mRNA sequence encoding at least one antigenic peptide or protein derived from neuraminidase (NA) of influenza A virus H5, and optionally at least one mRNA sequence encoding at least one antigenic peptide or protein derived from preferably hemagglutinin (HA) and/or at least one mRNA sequence encoding at least one antigenic peptide or protein derived from neuraminidase (NA) of influenza A virus H7, and/or optionally at least one mRNA sequence encoding at least one antigenic peptide or protein derived from, preferably hemagglutinin (HA) and/or at least one mRNA sequence encoding at least one antigenic peptide or protein derived from neuraminidase (NA) of influenza A virus HR.

In a specific embodiment the (pharmaceutical) composition or vaccine comprises at least one mRNA sequence encoding at least one antigenic peptide or protein derived from hemagglutinin (HA) and/or at least one mRNA sequence encoding at least one antigenic peptide or protein derived from neuraminidase (NA) of influenza A virus H1N1, at least one mRNA sequence encoding at least one antigenic peptide or protein derived from hemagglutinin (HA) and/or at least one mRNA sequence encoding at least one antigenic peptide or protein derived from neuraminidase (NA) of influenza A virus H3N2, at least one mRNA sequence encoding at least one antigenic peptide or protein derived from hemagglutinin (HA) and/or at least one mRNA sequence encoding at least one antigenic peptide or protein derived from neuraminidase (NA) of influenza A virus H5N1.

Additionally, the (pharmaceutical) composition or vaccine preferably further comprises at least one mRNA sequence encoding at least one antigenic peptide or protein derived from hemagglutinin (HA) and/or at least one mRNA sequence encoding at least one antigenic peptide or protein derived from neuraminidase (NA) of at least one influenza B virus.

In a particularly preferred embodiment, the (pharmaceutical) composition or vaccine preferably comprises an mRNA sequence encoding at least one antigenic peptide or protein derived from hemagglutinin (HA) of influenza A virus H3N2, preferably from influenza A virus Hong Kong/4801/2014, wherein the mRNA sequence comprises or consists of the following RNA sequences SEQ ID NOs: 213625-213638, 214884-214731, wherein SEQ ID NO: 213625 is particularly preferred.

In this context it is particularly preferred that the (pharmaceutical) composition or vaccine comprises a plurality of mRNA sequences encoding at least one antigenic peptide or protein derived from hemagglutinin (HA) and/or at least one antigenic peptide or protein derived from neuraminidase (NA) of influenza A/Netherlands/602/2009 and/or A/California/7/2009,
A/Hong Kong/4801/2014,
B/Brisbane/60/2008, and
A/Vietnam/1203/2004;

Or of Influenza

A/California/07/2009 (H1N1),
A/Hong Kong/4801/2014 (H3N2),
B/Brisbane/60/2008,
B/Phuket/3073/2013, and optionally A/Michigan/45/2015 (H1N1)pdm09-like virus.

Preferably in this context the mRNA sequence(s) comprises or consists of the following RNA sequences (see Table 3):

TABLE 3

| mRNA sequences | | |
|---|---|---|
| Name | HA SEQ ID NO: | NA SEQ ID NO: |
| A/Netherlands/602/2009 | 213610 | 213755 |
| A/California/7/2009 | 213561 | 213747 |
| A/Hong Kong/4801/2014 | 213625 | 213765 |

TABLE 3-continued

| mRNA sequences | | |
|---|---|---|
| Name | HA SEQ ID NO: | NA SEQ ID NO: |
| A/Vietnam/1203/2004 or A/Vietnam/1194/2004 | 213644 | 213771 or 213773 |
| B/Brisbane/60/2008 | 213680 | 213777 |
| B/Phuket/3073/2013 | 213690 | 213779 |
| A/Michigan/45/2015 (H1N1)pdm09-like virus | 213577 | 213753 |

Further preferred, in addition to the sequences provided in Table 3 are the mRNA sequence(s) comprising or consisting the following RNA sequences: HA of influenza A/Netherlands/602/2002 (H1N1) SEQ ID NOs: 213607-213622, 213602, 214580-214627; NA of influenza A/Netherlands/602/2009 (H1N1) SEQ ID NOs: 213755-213764; HA of influenza A/California/7/2009 (H1N1) SEQ ID NOs: 213561-213576, 214052-214099, 214156-214211, 215630, 215631; NA of influenza A/California/7/2009 (H1N1) SEQ ID NOs: 213747-213752: HA of influenza A/Hong Kong/4801/2014 (H3N2) SEQ ID NOs: 213625-213638, 214684-214731; NA of influenza A/Hong Kong/4801/2014 (H3N2) SEQ ID NOs: 213765-213768; HA of influenza A/Vietnam/1203/2004 or A/Vietnam/1124/2004 (H5N1) SEQ ID NOs: 213632-213654, 214788-214835; NA of influenza A/Vietnam/1203/2004 (H5N1) SEQ ID NOs: 213771-213774; HA of influenza B/Brisbane/60/2008 SEQ ID NOs: 213680-213689, 214892-214939, 215633-215634, 215890-215891; NA of influenza 8/Brisbane/60/2008 SEQ ID NOs: 213777-213778; HA of influenza B/Phuket/3073/2013 SEQ ID NOs; 213620-213701; 214996-215043; 215823-215824; NA of influenza B/Phuket/3073/2013 SEQ ID NOs: 213779-213780; HA of influenza A/Michigan/45/2015 (H1N1) SEQ ID NOs: 213577-213606, 214268-214315, 214372-214419: 214476-214523; NA of influenza A/Michigan/45/2015 (H1N1) SEQ ID NOs: 213753-213754.

Complexation and Formulation:

In a preferred embodiment of the composition according to the invention, the at least one mRNA comprising at least one mRNA sequence according to the invention is complexed with one or more cationic or polycationic compounds, preferably with cationic or polycationic polymers, cationic or polycationic peptides or proteins, e.g. protamine, cationic or polycationic polysaccharides and/or cationic or polycationic lipids.

According to a preferred embodiment, the at least one mRNA of the composition according to the present invention may be complexed with lipids to form one or more liposomes, lipoplexes, or lipid nanoparticles. Therefore, in one embodiment, the inventive composition comprises liposomes, lipoplexes, and/or lipid nanoparticles comprising the at least one mRNA.

Lipid-based formulations have been increasingly recognized as one of the most promising delivery systems for RNA due to their biocompatibility and their ease of large-scale production. Cationic lipids have been widely studied as synthetic materials for delivery of RNA. After mixing together, nucleic acids are condensed by cationic lipids to form lipid/nucleic acid complexes known as lipoplexes. These lipid complexes are able to protect genetic material from the action of nucleases and deliver it into cells by interacting with the negatively charged cell membrane. Lipoplexes can be prepared by directly mixing positively charged lipids at physiological pH with negatively charged nucleic acids.

Conventional liposomes consist of a lipid bilayer that can be composed of cationic, anionic, or neutral (phospho)lipids and cholesterol, which encloses an aqueous core. Both the lipid bilayer and the aqueous space can incorporate hydrophobic or hydrophilic compounds, respectively. Liposome characteristics and behaviour in vivo can be modified by addition of a hydrophilic polymer coating, e.g. polyethylene glycol (PEG), to the liposome surface to confer steric stabilization. Furthermore, liposomes can be used for specific targeting by attaching ligands (e.g., antibodies, peptides, and carbohydrates) to its surface or to the terminal end of the attached PEG chains (Front Pharmacol. 2015 Dec. 1; 6:286).

Liposomes are colloidal lipid-based and surfactant-based delivery systems composed of a phospholipid bilayer surrounding an aqueous compartment. They may present as spherical vesicles and can range in size from 20 nm to a few microns. Cationic lipid-based liposomes are able to complex with negatively charged nucleic acids via electrostatic interactions, resulting in complexes that offer biocompatibility, low toxicity, and the possibility of the large-scale production required for in vivo clinical applications. Liposomes can fuse with the plasma membrane for uptake; once inside the cell, the liposomes are processed via the endocytic pathway and the genetic material is then released from the endosome/carrier into the cytoplasm. Liposomes have long been perceived as drug delivery vehicles because of their superior biocompatibility, given that liposomes are basically analogs of biological membranes, and can be prepared from both natural and synthetic phospholipids (Int J Nanomedicine. 2014; 9:1833-1843).

Cationic liposomes have been traditionally the most commonly used non-viral delivery systems for oligonucleotides, including plasmid DNA, antisense oligos, and siRNA/small hairpin RNA-shRNA). Cationic lipids, such as DOTAP, (1,2-dioleoyl-3-trimethylammonium-propane) and DOTMA (N-[1-(2,3-dioleoyloxy)propyl]-N,N,N-trimethyl-ammonium methyl sulfate) can form complexes or lipoplexes with negatively charged nucleic acids to form nanoparticles by electrostatic interaction, providing high in vitro transfection efficiency. Furthermore, neutral lipid-based nanoliposomes for RNA delivery as e.g. neutral 1,2-dialeoyl-sn-glycero-3-phosphatidylcholine (DOPC)-based nanoliposomes were developed. (Adv Drug Deliv Rev. 2014 February; 66:110-116).

Therefore, in one embodiment the at least one mRNA of the composition according to the present invention is complexed with cationic lipids and/or neutral lipids and thereby forms liposomes, lipid nanoparticles, lipoplexes or neutral lipid-based nanoliposomes.

In a preferred embodiment, the composition according to the invention comprises the mRNA comprising at least one mRNA sequence according to the invention that is formulated together with a cationic or polycationic compound and/or with a polymeric carrier. Accordingly, in a further embodiment of the invention, it is preferred that the mRNA as defined herein or any other nucleic acid comprised in the inventive (pharmaceutical) composition or vaccine is associated with or complexed with a cationic or polycationic compound or a polymeric carrier, optionally in a weight ratio selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w) of mRNA or nucleic acid to cationic or polycationic compound and/or with a polymeric carrier; or optionally in a nitrogen/phosphate (N/P) ratio of mRNA or nucleic acid to cationic or polycationic compound and/or polymeric carrier in the range of about 0.1-10, preferably in a range of about 0.3-4 or 0.3-1, and most preferably in a range of about 0.5-1 or 0.7-1, and even most preferably in a range of about 0.3-0.9 or 0.5-0.9. More preferably, the N/P ratio of the at least one mRNA to the one or more polycations is in the range of about 0.1 to 10, including a range of about 0.3 to 4, of about 0.5 to 2, of about 0.7 to 2 and of about 0.7 to 1.5.

Therein, the mRNA as defined herein or any other nucleic acid comprised in the (pharmaceutical) composition or vaccine according to the invention can also be associated with a vehicle, transfection or complexation agent for increasing the transfection efficiency and/or the immunostimulatory properties of the mRNA according to the invention or of optionally comprised further included nucleic acids.

Cationic or polycationic compounds, being particularly preferred agents in this context include protamine, nucleoline, spermine or spermidine, or other cationic peptides or proteins, such as poly-L-lysine (PLL), poly-arginine, basic polypeptides, cell penetrating peptides (CPPs), including HIV-binding peptides, HIV-1 Tat (HIV), Tat-derived peptides, Penetratin, VP22 derived or analog peptides, HSV VP22 (*Herpes simplex*), MAP, KALA or protein transduction domains (PTDs), PpT620, proline-rich peptides, arginine-rich peptides, lysine-rich peptides, MPG-peptide(s), Pep-1, L-oligomers, Calcitonin peptide(s), Antennapedia-derived peptides (particularly from *Drosophila* antennapedia), pAntp, pIsI, FGF, Lactoferrin, Transportan, Buforin-2, Bac715-24, SynB, SynB(1), pVEC, hCT-derived peptides, SAP, or histones. More preferably, the mRNA according to the invention is complexed with one or more polycations, preferably with protamine or oligofectamine, most preferably with protamine. In this context protamine is particularly preferred.

Additionally, preferred cationic or polycationic proteins or peptides may be selected from the following proteins or peptides having the following total formula (III):

$$(Arg)_l;(Lys)_m;(His)_n;(Orn)_o;(Xaa)_x, \quad \text{formula(III)}$$

wherein l+m+n+o+x=8-15, and l, m, n or o independently of each other may be any number selected from 0, 1, 2, 3, 4, 5, 8, 7, 8, 9, 10, 11, 12, 13, 14 or 15, provided that the overall content of Arg, Lys, His and Orn represents at least 50% of all amino acids of the oligopeptide; and Xaa may be any amino acid selected from native (=naturally occurring) or non-native amino acids except of Arg, Lys, His or Orn; and x may be any number selected from 0, 1, 2, 3 or 4, provided, that the overall content of Xaa does not exceed 50% of all amino acids of the oligopeptide. Particularly preferred cationic peptides in this context are e.g. Arg7, Arg8, Arg9, H3R9, R2H3, H3R9H3, YSSR9SSY, (RKH)4, Y(RKH)2R, etc. In this context the disclosure of WO 2009/030481 is incorporated herewith by reference.

Further preferred cationic or polycationic compounds, which can be used as transfection or complexation agent may include cationic polysaccharides, for example chitosan, polybrene, cationic polymers, e.g. polyethyleneimine (PEI), cationic lipids, e.g. DOTMA: [1-(2,3-dioleyloxy)propyl)]-N,N,N-trimethylammonium chloride, DMRIE, di-C14-amidine, DOTIM, SAINT, DC-Chol, BGTC, CTAP, DOPC, DODAP, DOPE: Dioleyl phosphatidyl ethanol-amine, DDSPA, DDDAB, DDIC, DMEPC, DOGS: Dioctadecylamidoglicylspermin, DIMRI: Dimyristoyl-oxypropyl dimethyl hydroxyethyl ammonium bromide, DOTAP: dioleoyloxy-3-(trimethylammonio)propane, DC-6-14; O,O-ditetradecanoyl-N-(α-trimethylammonioacetyl)

diethanolamine chloride. CLIPI: rac-[(2,3-dioctadecyloxypropyl)(2-hydroxyethyl)]-dimethylammonium chloride. CLIP6: rac-[2(2,3-dihexadecyloxypropyl-oxymethyloxy)ethyl] trimethylammonium, CLIP9: rac-[2(2,3-dihexadecyloxypropyl-oxysuccinyloxy)ethyl]-trimethylammonium, oligofectamine, or cationic or polycationic polymers, e.g. modified polyaminoacids, such as β-aminoacid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified amidoamines such as pAMAM (poly(amidoamine)), etc., modified polybetaaminoester (PBAE), such as diamine end modified 1,4 butanedial diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, chitosan, etc., silan backbone based polymers, such as PMOXA-PDMS copolymers, etc., block polymers consisting of a combination of one or more cationic blocks (e.g. selected from a cationic polymer as mentioned above) and of one or more hydrophilic or hydrophobic blocks (e.g. polyethyleneglycole); etc.

According to a preferred embodiment, the composition of the present invention comprises the mRNA as defined herein and a polymeric carrier. A polymeric carrier used according to the invention might be a polymeric carrier formed by disulphide-crosslinked cationic components. The disulphide-crosslinked cationic components may be the same or different from each other. The polymeric carrier can also contain further components. It is also particularly preferred that the polymeric carrier used according to the present invention comprises mixtures of cationic peptides, proteins or polymers and optionally further components as defined herein, which are crosslinked by disulphide bonds as described herein. In this context, the disclosure of WO 2012/013326 is incorporated herewith by reference.

In this context, the cationic components, which form basis for the polymeric carrier by disulfide-crosslinkage, are typically selected from any suitable cationic or polycationic peptide, protein or polymer suitable for this purpose, particular any cationic or polycationic peptide, protein or polymer capable of complexing the mRNA as defined herein or a further nucleic acid comprised in the composition, and thereby preferably condensing the mRNA or the nucleic acid. The cationic or polycationic peptide, protein or polymer, is preferably a linear molecule, however, branched cationic or polycationic peptides, proteins or polymers may also be used.

Every disulphide-crosslinking cationic or polycationic protein, peptide or polymer of the polymeric carrier, which may be used to complex the mRNA according to the invention or any further nucleic acid comprised in the (pharmaceutical) composition or vaccine of the present invention contains at least one —SH moiety, most preferably at least one cysteine residue or any further chemical group exhibiting an —SH moiety, capable of forming a disulphide linkage upon condensation with at least one further cationic or polycationic protein, peptide or polymer as cationic component of the polymeric carrier as mentioned herein.

As defined above, the polymeric carrier, which may be used to complex the mRNA of the present invention or any further nucleic acid comprised in the (pharmaceutical) composition or vaccine according to the invention may be formed by disulphide-crosslinked cationic (or polycationic) components. Preferably, such cationic or polycationic peptides or proteins or polymers of the polymeric carrier, which comprise or are additionally modified to comprise at least one —SH moiety, are selected from, proteins, peptides and polymers as defined herein for complexation agent.

In a further particular embodiment, the polymeric carrier which may be used to complex the RNA as defined herein or any further nucleic acid comprised in the (pharmaceutical) composition or vaccine according to the invention may be selected from a polymeric carrier molecule according to generic formula (IV):

$$L\text{-}P^1\text{—}S\text{—}[S\text{—}P^2\text{—}S]_n\text{—}S\text{—}P^3\text{-}L \qquad \text{formula(IV)}$$

wherein, $P^1$ and $P^3$ are different or identical to each other and represent a linear or branched hydrophilic polymer chain, each $P^1$ and $P^0$ exhibiting at least one —SH-moiety, capable to form a disulphide linkage upon condensation with component $P^2$, or alternatively with (AA), $(AA)_x$, or $[(AA)_x]_z$ if such components are used as a linker between $P^1$ and $P^2$ or $P^3$ and $P^2$) and/or with further components (e.g. (AA), $(AA)_x$, $[(AA)_x]_z$ or L), the linear or branched hydrophilic polymer chain selected independent from each other from polyethylene glycol (PEG), poly-A4(2-hydroxypropyl)methacrylamide, poly-2-(methacryloyloxy)ethyl phosphorylcholines, poly(hydroxyalkyl L-asparagine), poly(2-(methacryloyloxy)ethyl phosphorylcholine), hydroxyethylstarch or poly(hydroxyalkyl L-glutamine), wherein the hydrophilic polymer chain exhibits a molecular weight of about 1 kDa to about 100 kDa, preferably of about 2 kDa to about 25 kDa; or more preferably of about 2 kDa to about 10 kDa, e.g. about 5 kDa to about 25 kDa or 5 kDa to about 10 kDa;

$P^2$ is a cationic or polycationic peptide or protein, e.g. as defined above for the polymeric carrier formed by disulphide-crosslinked cationic components, and preferably having a length of about 3 to about 100 amino acids, more preferably having a length of about 3 to about 50 amino acids, even more preferably having a length of about 3 to about 25 amino acids, e.g. a length of about 3 to 10, 5 to 15, 1 to 20 or 15 to 25 amino acids, more preferably a length of about 5 to about 20 and even more preferably a length of about 10 to about 20; or is a cationic or polycationic polymer, e.g. as defined above for the polymeric carrier formed by disulphide-crosslinked cationic components, typically having a molecular weight of about 0.5 kDa to about 30 kDa, including a molecular weight of about 1 kDa to about 20 kDa, even more preferably of about 1.5 kDa to about 10 kDa, or having a molecular weight of about 0.5 kDa to about 100 ka, including a molecular weight of about 10 kDa to about 50 kDa, even more preferably of about 10 kDa to about 30 kDa;

each $P^2$ exhibiting at least two —SH-moieties, capable to form a disulphide linkage upon condensation with further components $P^2$ or component(s) $P^1$ and/or $P^3$ or alternatively with further components (e.g. (AA), $(AA)_x$, or $[(AA)_x]_z$);

S—S— is a (reversible) disulphide bond (the brackets are omitted for better readability), wherein S preferably represents sulphur or a —SH carrying moiety, which has formed a (reversible) disulphide bond. The (reversible) disulphide bond is preferably formed by condensation of —SH-moieties of either components $P^1$ and $P^2$, $P^2$ and $P^2$, or $P^2$ and $P^3$, or optionally of further components as defined herein (e.g. L, (AA), $(AA)_x$, $[(AA)_x]_z$, etc.); The —SH-moiety may be part of the structure of these components or added by a modification as defined below;

L is an optional ligand, which may be present or not, and may be selected independent from the other from ROD, Transferrin, Folate, a signal peptide or signal sequence, a localization signal or sequence, a nuclear localization signal or sequence (NLS), an antibody, a cell penetrating peptide, (e.g. TAT or KALA), a ligand of a receptor (e.g. cytokines, hormones, growth factors etc.), small molecules (e.g. carbohydrates like mannose or galactose or synthetic ligands), small molecule agonists, inhibitors or antagonists of receptors (e.g. ROD peptidomimetic analogues), or any further protein as defined herein, etc.;

n is an integer, typically selected from a range of about 1 to 50, preferably from a range of about 1, 2 or 3 to 30, more preferably from a range of about 1, 2, 3, 4, or 5 to 25, or a range of about 1, 2, 3, 4, or 5 to 20, or a range of about 1, 2, 3, 4, or 5 to 15, or a range of about 1, 2, 3, 4, or 5 to 10, including e.g. a range of about 4 to 9, 4 to 10, 3 to 20, 4 to 20, 5 to 20, or 10 to 20, or a range of about 3 to 15, 4 to 15, 5 to 15, or 10 to 15, or a range of about 6 to 11 or 7 to 10. Most preferably, n is in a range of about 1, 2, 3, 4, or 5 to 10, more preferably in a range of about 1, 2, 3, or 4 to 9, in a range of about 1, 2, 3, or 4 to 8, or in a range of about 1, 2, or 3 to 7.

In this context, the disclosure of WO 2011/026641 is incorporated herewith by reference. Each of hydrophilic polymers P1 and P3 typically exhibits at least one —SH-moiety, wherein the at least one —SH-moiety is capable to form a disulphide linkage upon reaction with component P2 or with component (AA) or $(AA)_x$, if used as linker between P1 and P2 or P3 and P2 as defined below and optionally with a further component, e.g. L and/or (AA) or $(AA)_x$, e.g. if two or more —SH-moieties are contained. The following subformulae "P1-S—S—P2" and "P2-S—S—P3" within generic formula (IV) above (the brackets are omitted for better readability), wherein any of S, P1 and P3 are as defined herein, typically represent a situation, wherein one-SH-moiety of hydrophilic polymers P1 and P3 was condensed with one —SH-moiety of component P2 of generic formula (IV) above, wherein both sulphurs of these —SH-moieties form a disulphide hand —S—S— as defined herein in formula (IV). These —SH-moieties are typically provided by each of the hydrophilic polymers P1 and P3, e.g. via an internal cysteine or any further (modified) amino acid or compound which carries a —SH moiety. Accordingly, the subformulae "P1-S—S—P2" and "P2-S—S—P3" may also be written as "P1-Cys-Cys-P2" and "P2-Cys-Cys-P3", if the —SH— moiety is provided by a cysteine, wherein the term Cys-Cys represents two cysteines coupled via a disulphide bond, not via a peptide bond. In this case, the term "—S—S—" in these formulae may also be written as "—S-Cys", as "-Cys-S" or as "-Cys-Cys-". In this context, the term "-Cys-Cys-" does not represent a peptide bond but a linkage of two cysteines via their —SH-moieties to form a disulphide bond. Accordingly, the term "-Cys-Cys-" also may be understood generally as "-(Cys-S)—(S-Cys)-", wherein in this specific case S indicates the sulphur of the —SH-moiety of cysteine. Likewise, the terms "—S-Cys" and "—Cys-S" indicate a disulphide bond between a —SH containing moiety and a cysteine, which may also be written as "—S—(S-Cys)" and "-(Cys-S)—S". Alternatively, the hydrophilic polymers P1 and P3 may be modified with a —SH moiety, preferably via a chemical reaction with a compound carrying a —SH moiety, such that each of the hydrophilic polymers P1 and P3 carries at least one such —SH moiety. Such a compound carrying a —SH moiety may be e.g. an (additional) cysteine or any further (modified) amino acid, which carries a —SH moiety. Such a compound may also be any non-amino compound or moiety, which contains or allows to introduce a —SH moiety into hydrophilic polymers P1 and P3 as defined herein. Such non-amino compounds may be attached to the hydrophilic polymers P1 and P3 of formula (IV) of the polymeric carrier according to the present invention via chemical reactions or binding of compounds, e.g. by binding of a 3-thio propionic acid or thioimolane, by amide formation (e.g. carboxylic acids, sulphonic acids, amines, etc), by Michael addition (e.g. maleimide moieties, α,β-unsaturated carbonyls, etc), by click chemistry (e.g. azides or alkines), by alkene/alkine methathesis (e.g. alkenes or alkines), imine or hydrozone formation (aldehydes or ketons, hydrazines, hydroxylamines, amines), complexation reactions (avidin, biotin, protein G) or components which allow Sn-type substitution reactions (e.g. halogenoalkanes, thiols, alcohols, amines, hydrazines, hydrazides, sulphonic acid esters, oxyphosphonium salts) or other chemical moieties which can be utilized in the attachment of further components. A particularly preferred PEG derivate in this context is alpha-Methoxy-omega-mercapto poly(ethylene glycol). In each case, the SH-moiety, e.g. of a cysteine or of any further (modified) amino acid or compound, may be present at the terminal ends or internally at any position of hydrophilic polymers P1 and P3. As defined herein, each of hydrophilic polymers P1 and P3 typically exhibits at least one —SH-moiety preferably at one terminal end, but may also contain two or even more —SH-moieties, which may be used to additionally attach further components as defined herein, preferably further functional peptides or proteins e.g. a ligand, an amino acid component (AA) or $(AA)_x$, antibodies, cell penetrating peptides or enhancer peptides (e.g. TAT, KALA), etc.

Preferably, the inventive composition comprises at least one mRNA as defined herein, which is complexed with one or more polycations, and at least one free mRNA, wherein the at least one complexed mRNA is preferably identical to the at least one free mRNA. In this context, it is particularly preferred that the composition of the present invention comprises the mRNA according to the invention that is complexed at least partially with a cationic or polycationic compound and/or a polymeric carrier, preferably cationic proteins or peptides. In this context, the disclosure of WO 2011/037539 and WO 2012/113513 is incorporated herewith by reference. Partially means that only a part of the mRNA as defined herein is complexed in the composition according to the invention with a cationic compound and that the rest of the mRNA as defined herein is (comprised in the inventive (pharmaceutical) composition or vaccine) in uncomplexed form ("free", "non-complexed"). Preferably, the molar ratio of the complexed mRNA to the free mRNA is selected from a molar ratio of about 0.001:1 to about 1:0.001, including a ratio of about 1:1. More preferably the ratio of complexed mRNA to free mRNA (in the (pharmaceutical) composition or vaccine of the present invention) is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), and most preferably the ratio of complexed mRNA to free mRNA in the inventive pharmaceutical composition or vaccine is selected from a ratio of about 1:1 (w/w).

The complexed mRNA in the (pharmaceutical) composition or vaccine according to the present invention, is preferably prepared according to a first step by complexing the mRNA according to the invention with a cationic or polycationic compound and/or with a polymeric carrier, preferably as defined herein, in a specific ratio to form a stable complex. In this context, it is highly preferable, that no free cationic or polycationic compound or polymeric carrier or only a negligibly small amount thereof remains in the component of the complexed mRNA after complexing the mRNA. Accordingly, the ratio of the mRNA and the cationic or polycationic compound and/or the polymeric carrier in the component of the complexed RNA is typically selected in a range so that the mRNA is entirely complexed and no free cationic or polycationic compound or polymeric carrier or only a negligibly small amount thereof remains in the composition.

Preferably the ratio of the mRNA as defined herein to the cationic or polycationic compound and/or the polymeric carrier, preferably as defined herein, is selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w). Alternatively, the ratio of the mRNA as defined herein to the cationic or polycationic compound and/or the polymeric carrier, preferably as defined herein, in the component of the complexed mRNA, may also be calculated on the basis of the nitrogen/phosphate ratio (N/P-ratio) of the entire complex. In the context of the present invention, an N/P-ratio is preferably in the range of about 0.1-10, preferably in a range of about 0.3-4 and most preferably in a range of about 0.5-2 or 0.7-2 regarding the ratio of mRNA:cationic or polycationic compound and/or polymeric carrier, preferably as defined herein, in the complex, and most preferably in a range of about 0.7-1.5, 0.5-1 or 0.7-1, and even most preferably in a range of about 0.3-0.9 or 0.5-0.9, preferably provided that the cationic or polycationic compound in the complex is a cationic or polycationic cationic or polycationic protein or peptide and/or the polymeric carrier as defined above. In this specific embodiment the complexed mRNA as defined herein is also encompassed in the term "adjuvant component".

In other embodiments, the composition according to the invention comprising the mRNA as defined herein may be administered naked without being associated with any further vehicle, transfection or complexation agent.

It has to be understood and recognized, that according to the present invention, the inventive composition may comprise at least one naked mRNA as defined herein and/or at least one formulated/complexed mRNA as defined herein, wherein every ID formulation and/or complexation as disclosed above may be used.

Adjuvants:

According to another embodiment, the (pharmaceutical) composition or vaccine according to the invention may comprise an adjuvant, which is preferably added in order to enhance the immunostimulatory properties of the composition. In this context, an adjuvant may be understood as any compound, which is suitable to support administration and delivery of the composition according to the invention. Furthermore, such an adjuvant may, without being bound thereto, initiate or increase an immune response of the innate immune system, i.e. a non-specific immune response. In other words, when administered, the composition according to the invention typically initiates an adaptive immune response due to an antigen as defined herein or a fragment or variant thereof, which is encoded by the at least one coding sequence of the inventive mRNA contained in the composition of the present invention. Additionally, the composition according to the invention may generate an (supportive) innate immune response due to addition of an adjuvant as defined herein to the composition according to the invention.

Such an adjuvant may be selected from any adjuvant known to a skilled person and suitable for the present case, i.e. supporting the induction of an immune response in a mammal. Preferably, the adjuvant may be selected from the group consisting of, without being limited thereto, TOM, MDP, muramyl dipeptide, pluronics, alum solution, aluminium hydroxide, ADJUMER™ (polyphosphazene); aluminium phosphate gel; glucans from algae; algammulin; aluminium hydroxide gel (alum); highly protein-adsorbing aluminium hydroxide gel; low viscosity aluminium hydroxide gel; AF or SPT (Emulsion of squalane (5%), Tween 80 (0.2%), Pluronic L121 (1.25%), phosphate-buffered saline, pH 7.4); AVRIDINE™ (propanediamine); BAY R1005™ ((N-(2-deoxy-2-L-leucylamino-b-D-glucopyranosyl)-N-octadecyl- dodecanoyl-amide hydro acetate); CALCITRIOL™ (1-alpha, 25-dihydroxy-vitamin D3); calcium phosphate gel; CAP™ (calcium phosphate nanoparticles); cholera holotoxin, cholera-toxin-Al-protein-A-D-fragment fusion protein, sub-unit B of the cholera toxin; CRL 1005 (block copolymer P1205); cytokine-containing liposomes; DDA (dimethyldioctadecylammonium bromide); DHEA (dehydroepiandrosterone); DMPC (dimyristoylphosphatidylcholine); DMPG (dimyristoylphosphatidylglycerol); DDC/alum complex (deoxycholic acid sodium salt); Freund's complete adjuvant; Freund's incomplete adjuvant; gamma inulin; Gerbu adjuvant (mixture of: i) N-acetylglucosaminyl-(P1-4)-N-acetylmuramyl-L-alanyl-D-glutamine (GMDP), ii) dimethyldioctadecylammonium chloride (DDA), iii) zinc-L-proline salt complex (ZnPro-8); GM-CSF); GMDP (N-acetylglucosaminyl-(bl-4)—N-acetylmuramyl-L-alanyl-D-isoglutamine); imiquimod (I-(2-methylpropyl)-1H-imidazo[4,5-c]quinoline-4-amine); ImmTher™ (N-acetylglucosaminyl-N-acetylmuramyl-L-Ala-D-isollu-L-Ala-glycerl dipalmitate); DRVs (immunoliposomes prepared from dehydration-rehydration vesicles); interferon-gamma; interleukin-1beta; interleukin-2; interleukin-7; interleukin-12; ISCOMS™; ISCOPREP 7.0.3.™; liposomes; LOXORIBINE™ (7-allyl-8-oxoguanosine); LT oral adjuvant (*E. coli* labile enterotoxin-protoxin); microspheres and microparticles of any composition; MF59™; (squalene-water emulsion); MONTANIDE ISA 51™ (purified incomplete Freund's adjuvant); MONTANIDE ISA720™ (metabolisable oil adjuvant); MPL™ (3-Q-desacyl-4'-monophosphoryl lipid A); MTP-PE and MTP-PE liposomes ((N-acetyl-L-alanyl-D-isoglutaminyl-L-alanine-2-(1,2-dipalmitoyl-sn-glycero-3-(hydroxyphosphoryloxy))-ethylamide, monosodium salt); MURAMETIDE™ (Nac-Mur-L-Ala-D-Gln-OCH3); MURAPALMITINE™ and D-MURAPALMITINE™ (Nac-Mur-L-Thr-D-isoGln-sn-glyceroldipalmitoyl); NAD (neuraminidase-galactose oxidase); nanospheres or nanoparticles of any composition; NISVs (non-ionic surfactant vesicles): PLEURAN™ (β-glucan); PLGA, PGA and PLA (homo- and co-polymers of lactic acid and glycolic acid; microspheres/nanospheres); PLURONIC L121™; PMMA (polymethyl methacrylate); PODDS™ (proteinoid microspheres); polyethylene carbamate derivatives; poly-rA: poly-rU (polyadenylic acid-polyuridylic acid complex); polysorbate 80 (Tween 80); protein cochleates (Avanti Polar Lipids, Inc., Alabaster, AL);

STIMULON™ (QS-21); Quil-A (Quil-A saponin); S-22463 (4-amino-otec-dimethyl-2-ethoxymethyl-1H-imidazo[4,5c] quinoline-1-ethanol); SAF-I™ ("Syntex adjuvant formulation"); Sendai proteoliposomes and Sendai-containing lipid matrices; Span-85 (sorbitan trioleate); Specol (emulsion of Marcol 52, Span 85 and Tween 85); squalene or Robane™ (2,6,10,15,19,23-hexamethyltetracosane and 2,6,10,15,19, 23-hexamethyl-2,6,10,14,18,22-tetracosahexaen); stearoyl-tyrosine (octadecyltyrosine hydrochloride); Theramid® (N-acetylglucosaminyl-N-acetylmuramyl-L-Ala-D-isoGlu-L-Ala-dipalmitoxypropylamide); Threonyl-MOP (Temurtide™ or [thr 1]-MDP; N-acetylmuramyl-L-threonyl-D-isoglutamine); Ty particles (Ty-VLPs or virus-like particles); Walter-Reed liposomes (liposomes containing lipid A adsorbed on aluminium hydroxide), and lipopeptides, including Pam3Cys, in particular aluminium salts, such as Adju-phos, Alhydrogel, Rehydragel; emulsions, including CFA, SAF, IFA, MF5, Provax, TiterMax, Montanide, Vaxfectin; copolymers, including Optivax (CRL1005), L121, Poloaxmer4010), etc.; liposomes, including Stealth, cochleates, including BIORAL; plant derived adjuvants, including QS21, Quil A, Iscomatrix, ISCOM; adjuvants suitable for costimulation including Tomatine, biopolymers, including PLG, PMM, Inulin; microbe derived adjuvants, including Romurtide, DETOX, MPL, CWS, Mannose, CpG nucleic acid sequences, CpG7909, ligands of human TLR 1-10, ligands of murine TLR 1-13, ISS-1018, IC31, Imidazoquinolines, Ampligen, Ribi529, IMOxine, IRIVs, VLPs, cholera toxin, heat-labile toxin, Pam3Cys, Flagellin, GPI anchor, LNFPIII/Lewis X, antimicrobial peptides, UC-IVI50, RSV fusion protein, cdiGMP; and adjuvants suitable as antagonists including CGRP neuropeptide.

Particularly preferred, an adjuvant may be selected from adjuvants, which support induction of a Th1-immune response or maturation of naïve T-cells, such as GM-CSF, IL-12, IFNγ, any immunostimulatory nucleic acid as defined above, preferably an immunostimulatory RNA, CpG DNA, etc.

In a further preferred embodiment it is also possible that the inventive composition contains besides the antigen-providing mRNA further components which are selected from the group comprising: further antigens (e.g. in the form of a peptide or protein) or further antigen-encoding nucleic acids; a further immunotherapeutic agent; one or more auxiliary substances; or any further compound, which is known to be immunostimulating due to its binding affinity (as ligands) to human Toll-like receptors; and/or an adjuvant nucleic acid, preferably an immunostimulatory RNA (is-RNA).

The composition of the present invention can additionally contain one or more auxiliary substances in order to increase its immunogenicity or immunostimulatory capacity, if desired. A synergistic action of the mRNA as defined herein and of an auxiliary substance, which may be optionally contained in the inventive composition, is preferably achieved thereby. Depending on the various types of auxiliary substances, various mechanisms can come into consideration in this respect. For example, compounds that permit the maturation of dendritic cells (DCs), for example lipopolysaccharides, TNF-alpha or CD40 ligand, form a first class ID of suitable auxiliary substances. In general, it is possible to use as auxiliary substance any agent that influences the immune system in the manner of a "danger signal" (LPS, GP96, etc.) or cytokines, such as GM-CFS, which allow an immune response to be enhanced and/or influenced in a targeted manner. Particularly preferred auxiliary substances are cytokines, such as monokines, lymphokines, interleukins or chemokines, that further promote the innate immune response, such as IL-1, IL-2, IL-3, IL-4, IL-5, IL-6, IL-7, IL-8, IL-9, IL-10, IL-12, IL-13, IL-14, IL-15, IL-16, L-17, IL-18, IL-19, IL-20, L-21, IL-22, IL-23, IL-24, IL-25, IL-26, IL-27, IL-28, IL-29, IL-30, IL-31, IL-32, IL-33, IFN-alpha, IFN-beta, IFN-gamma, GM-CSF, G-CSF, M-CSF, LT-beta or TNF-alpha, growth factors, such as hGH.

Suitable adjuvants may also be selected from cationic or polycationic compounds wherein the adjuvant is preferably prepared upon complexing the mRNA of the composition according to the invention with the cationic or polycationic compound. Associating or complexing the mRNA of the composition with cationic or polycationic compounds as defined herein preferably provides adjuvant properties and confers a stabilizing effect to the mRNA of the composition. In particular, such preferred cationic or polycationic compounds are selected from cationic or polycationic peptides or proteins, including protamine, nucleoline, spermine or spermidine, or other cationic peptides or proteins, such as poly-L-lysine (PLL), poly-arginine, basic polypeptides, call penetrating peptides (CPPs), including HIV-binding peptides, Tat, HIV-1 Tat (HIV), Tat-derived peptides, Penetratin, VP22 derived or analog peptides, HSV VP22 (*Herpes simplex*), MAP, KALA or protein transduction domains (PTDs, PpT620, proline-rich peptides, arginine-rich peptides, lysine-rich peptides, MPG-peptide(s), Pep-1, L-oligomers, Calcitonin peptide(s), Antennapedia-derived peptides (particularly from *Drosophila* antennapedia), pAntp, pIsI, FGF, Lactoferrin, Transportan, Buforin-2, Bac715-24, SynB, SynB(I), pVEC, hCT-derived peptides, SAP, protamine, spermine, spermidine, or histones. Further preferred cationic or polycationic compounds may include cationic polysaccharides, for example chitosan, polybrene, cationic polymers, e.g. polyethyleneimine (PEI), cationic lipids, e.g. DOTMA: [1-(2,3-dioleyloxy)propyl)]-N,N,N-trimethylammonium chloride, DMRIE, di-C14-amidine, DOTIM, SAINT, DC-Chol, BGTC, CTAP, DOPC, DDDAP, DOPE: Dioleyl phosphatidylethanol-amine, DDSPA, DDDAB, DDIC, DMEPC, DDBS: Diactadecylamidoglicylspermin, DIMRI: Dimyristoyl-oxypropyl dimethyl hydroxyethyl ammonium bromide, DDTAP: dioleoyloxy-3-(trimethylammonio)propane, DC-6-14: D,D-ditetradecanoyl-N-(α-trimethylammonioacetyl)diethanolamine chloride, CLIPI: rac-[(2,3-dioctadecyloxypropyl)(2-hydroxyethyl)]-dimethylammonium chloride, CLIPS: rac-[2(2,3-dihexadecyloxypropyl-oxymethoxy)ethyl]-trimethylammonium, CLIP9: rac-[2(2,3-dihexadecyloxypropyl-oxysuccinyloxy)ethyl]-trimethylammonium, oligofectamine, or cationic or polycationic polymers, e.g. modified polyaminoacids, such as β-aminoacid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified Amidoamines such as pAMAM (poly(amidoamine)), etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, Chitosan, etc., silan backbone based polymers, such as PMOXA-PDMS copolymers, etc., block polymers consisting of a combination of one or more cationic blocks (e.g. selected of a cationic polymer as mentioned above) and of one or more hydrophilic- or hydrophobic blocks (e.g. polyethyleneglycole); etc.

Additionally, preferred cationic or polycationic proteins or peptides, which can be used as an adjuvant by complexing the mRNA of the composition according to the invention, may be selected from following proteins or peptides having the following total formula (III): $(Arg)_l;(Lys)_m;(His)_n;(Orn)_o;(Xaa)_x$, wherein l+m+n+o+x=8-15, and l, m, n or o independently of each other may be any number selected from 0, 1, 2, 3, 4, 5, 6, 7, 8, 9, 10, 11, 12, 13, 14 or 15, provided that the overall content of Arg, Lys, His and Orn represents at least 50% of all amino acids of the oligopeptide; and Xaa may be any amino acid selected from native (=naturally occurring) or non-native amino acids except of Arg, Lys, His or Orn; and x may be any number selected from 0, 1, 2, 3 or 4, provided, that the overall content of Xaa does not exceed 50% of all amino acids of the oligopeptide. Particularly preferred oligoarginines in this context are e.g. Arg7, Arg8, Arg9, Arg7, H3R9, R9H3, H3R8H3, YSSR9SSY, (RKH)4, Y(RKH)2R, etc.

The ratio of the mRNA to the cationic or polycationic compound in the adjuvant component may be calculated on the basis of the nitrogen/phosphate ratio (N/P-ratio) of the entire mRNA complex, i.e., the ratio of positively charged (nitrogen) atoms of the cationic or polycationic compound to the negatively charged phosphate atoms of the nucleic acids. For Example, 1 μg of RNA typically contains about 3 nmol phosphate residues, provided the RNA exhibits a statistical distribution of bases. Additionally, 1 μg of peptide typically contains about x nmol nitrogen residues, dependent on the molecular weight and the number of basic amino acids. When exemplarily calculated for (Arg)8 (molecular weight 1424 g/mol, 9 nitrogen atoms), 1 μg (Arg)9 contains about 700 pmol (Arg)9 and thus 700×8=6300 pmol basic amino acids=6.3 nmol nitrogen atoms. For a mass ratio of about 1:1 RNA/(Arg)9 an N/P ratio of about 2 can be calculated. When exemplarily calculated for protamine (molecular weight about 4250 g/mol. 21 nitrogen atoms, when protamine from salmon is used) with a mass ratio of about 2:1 with 2 μg RNA, 6 nmol phosphate are to be calculated for the RNA; 1 μg protamine contains about 235 pmol protamine molecules and thus 235×21=4835 pmol basic nitrogen atoms=4.9 nmol nitrogen atoms. For a mass ratio of about 2:1 RNA/protamine an N/P ratio of about 0.81 can be calculated. For a mass ratio of about 8:1 RNA/protamine an N/P ratio of about 0.2 can be calculated. In the context of the present invention, an N/P-ratio is preferably in the range of about 0.1-10, preferably in a range of about 0.3-4 and most preferably in a range of about 0.5-2 or 0.7-2 regarding the ratio of RNA:peptide in the complex, and most preferably in the range of about 0.7-1.5.

In a preferred embodiment, the composition of the present invention is obtained in two separate steps in order to obtain both, an efficient immunostimulatory effect and efficient translation of the mRNA according to the invention. Therein, a so called "adjuvant component" is prepared by complexing—in a first step—an mRNA as defined herein of the adjuvant component with a cationic or polycationic compound in a specific ratio to form a stable complex. In this context, it is important, that no free cationic or polycationic compound or only a negligibly small amount remains in the adjuvant component after complexing the mRNA. Accordingly, the ratio of the mRNA and the cationic or polycationic compound in the adjuvant component is typically selected in a range that the mRNA is entirely complexed and no free cationic or polycationic compound or only a negligible small amount remains in the composition. Preferably the ratio of the adjuvant component, i.e., the ratio of the mRNA to the cationic or polycationic compound is selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w).

According to a preferred embodiment, the mRNA of the invention comprising at least one mRNA sequence comprising at least one coding region as defined herein is added in a second step to the complexed mRNA of the adjuvant component in order to form the (immunostimulatory) composition of the invention. Therein, the mRNA of the composition according to the invention is added as free mRNA, which is not complexed by other compounds. Prior to addition, the free mRNA is not complexed and will preferably not undergo any detectable or significant complexation reaction upon the addition of the adjuvant component. This is due to the strong binding of the cationic or polycationic compound to the above described mRNA according to the invention comprised in the adjuvant component. In other words, when the mRNA comprising at least one coding region as defined herein is added to the "adjuvant component", preferably no free or substantially no free cationic or polycationic compound is present, which could form a complex with the free mRNA. Accordingly, an efficient translation of the mRNA of the composition is possible in vivo. Therein, the free mRNA, may occur as a mono-, di-, or multicistronic mRNA, i.e. an mRNA which carries the coding sequences of one or more proteins. Such coding sequences in di-, or even multicistronic mRNA may be separated by at least one IRES sequence, e.g. as defined herein.

In a particularly preferred embodiment, the free mRNA as defined herein, which is comprised in the composition of the present invention, may be identical or different to the RNA as defined herein, which is comprised in the adjuvant component of the composition, depending on the specific requirements of therapy. Even more preferably, the free RNA, which is comprised in the composition according to the invention, is identical to the RNA of the adjuvant component of the inventive composition.

In a particularly preferred embodiment, the composition according to the invention comprises the mRNA of the invention, which encodes at least one antigenic peptide or protein as defined herein and wherein said mRNA is present in the composition partially as free mRNA and partially as complexed mRNA. Preferably, the mRNA as defined herein is complexed as described above and the same mRNA is then added as free mRNA, wherein preferably the compound, which is used for complexing the mRNA is not present in free form in the composition at the moment of addition of the free mRNA component.

The ratio of the first component (i.e., the adjuvant component comprising or consisting of the mRNA as defined herein complexed with a cationic or polycationic compound) and the second component (i.e., the free mRNA as defined herein) may be selected in the inventive composition according to the specific requirements of a particular therapy. Typically, the ratio of the mRNA in the adjuvant component and the at least one free mRNA (mRNA in the adjuvant component: free mRNA) of the composition according to the invention is selected such that a significant stimulation of the innate immune system is elicited due to the adjuvant component. In parallel, the ratio is selected such that a significant amount of the free mRNA can be provided in vivo leading to an efficient translation and concentration of the expressed protein in vivo, e.g., the at least one antigenic peptide or protein as defined herein. Preferably the ratio of the mRNA in the adjuvant component: free mRNA in the inventive composition is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), and most preferably the ratio of mRNA in the adjuvant component:free mRNA in the inventive composition is selected from a ratio of about 1:1 (w/w).

Additionally or alternatively, the ratio of the first component (i.e., the adjuvant component comprising or consisting of the mRNA I5 complexed with a cationic or polycationic compound) and the second component (i.e., the free mRNA) may be calculated on the basis of the nitrogen/phosphate ratio (N/P-ratio) of the entire mRNA complex. In the context of the present invention, an N/P-ratio is preferably in the range of about 0.1-10, preferably in a range of about 0.3-4 and most preferably in a range of about 0.5-2 or 0.7-2 regarding the ratio of mRNA:peptide in the complex, and most preferably in the range of about 0.7-1.5.

Additionally or alternatively, the ratio of the first component (i.e., the adjuvant component comprising or consisting of the mRNA complexed with a cationic or polycationic compound) and the second component (i.e., the free mRNA) may also be selected in the composition according to the invention on the basis of the molar ratio of both mRNAs to each other, i.e., the mRNA of the adjuvant component, being complexed with a cationic or polycationic compound and the free mRNA of the second component. Typically, the molar ratio of the mRNA of the adjuvant component to the free mRNA of the second component may be selected such, that the molar ratio suffices the above (w/w) and/or N/P-definitions. More preferably, the molar ratio of the mRNA of the adjuvant component to the free mRNA of the second component may be selected e.g. from a molar ratio of about 0.001:1, 0.01:1, 0.1:1, 0.2:1, 0.3:1, 0.4:1, 0.5:1, 0.6:1, 0.7:1, 0.8:1, 0.8:1, 1:1, 1:0.9, 1:0.8, 1:0.7, 1:0.6, 1:0.5, 1:0.4, 1:0.3, 1:0.2, 1:0.1, 1:0.01, 1:0.001, etc. or from any range formed by any two of the above values, e.g. a range selected from about 0.00:1 to 1:0.001, including a range of about 0.01:1 to 1:0.001, 0.1:1 to 1:0.001, 0.2:1 to 1:0.001, 0.3:1 to 1:0.001, 0.4:1 to 1:0.001, 0.5:1 to 1:0.001, 0.6:1 to 1:0.001, 0.7:1 to 1:0.001, 0.8:1 to 1:0.001, 0.9:1 to 1:0.001, 1:1 to 1:0.001, 1:0.8 to 1:0.001, 1:0.8 to 1:0.001, 1:0.7 to 1:0.001, 1:0.6 to 1:0.001, 1:0.5 to 1:0.001, 1:0.4 to 1:0.001, 1:0.3 to 1:0.001, 1:0.2 to 1:0.001, 1:0.1 to 1:0.001, 1:0.01 to 1:0.001, or a range of about 0.01:1 to 1:0.01, 0.1:1 to 1:0.01, 0.2:1 to 1:0.01, 0.3:1 to 1:0.01, 0.4:1 to 1:0.01, 0.5:1 to 1:0.01, 0.6:1 to 1:0.01, 0.7:1 to 1:0.01, 0.8:1 to 1:0.01, 0.8:1 to 1:0.01, 1:1 to 1:0.01, 1:0.9 to 1:0.01, 1:0.8 to 1:0.01, 1:0.7 to 1:0.01, 1:0.6 to 1:0.01, 1:0.5 to 1:0.01, 1:0.4 to 1:0.01, 1:0.3 to 1:0.01, 1:0.2 to 1:0.01, 1:0.1 to 1:0.01, 1:0.01 to 1:0.01, or including a range of about 0.001:1 to 1:0.01, 0.001:1 to 1:0.1, 0.001:1 to 1:0.2, 0.001:1 to 1:0.3, 0.001:1 to 1:0.4, 0.001:1 to 1:0.5, 0.001:1 to 1:0.6, 0.001:1 to 1:0.7, 0.001:1 to 1:0.8, 0.001:1 to 1:0.9, 0.001:1 to 1:1, 0.001 to 0.8:1, 0.001 to 0.8:1, 0.001 to 0.7:1, 0.001 to 0.6:1, 0.001 to 0.5:1, 0.001 to 0.4:1, 0.001 to 0.3:1, 0.001 to 0.2:1, 0.001 to 0.001, or a range of about 0.1:1 to 1:0.01, 0.01:1 to 1:0.1, 0.01:1 to 1:0.2, 0.01:1 to 1:0.3, 0.01:1 to 1:0.4, 0.01:1 to 1:0.5, 0.01:1 to 1:0.6, 0.01:1 to 1:0.7, 0.01:1 to 1:0.8, 0.01:1 to 1:0.9, 0.01:1 to 1:1, 0.001 to 0.9:1, 0.001 to 0.8:1, 0.001 to 0.7:1, 0.001 to 0.8:1, 0.001 to 0.5:1, 0.001 to 0.4:1, 0.001 to 0.3:1, 0.001 to 0.2:1, 0.001 to 0.1, etc.

Even more preferably, the molar ratio of the mRNA of the adjuvant component to the free mRNA of the second component may be selected e.g. from a range of about 0.01:1 to 1:0.01. Most preferably, the molar ratio of the mRNA of the adjuvant component to the free mRNA of the second component may be selected e.g. from a molar ratio of about 1:1. Any of the above definitions with regard to (w/w) and/or N/P ratio may also apply.

Suitable adjuvants may furthermore be selected from nucleic acids having the formula (Va): $G_lX_mG_n$, wherein: G is guanosine (guanine), uridine (uracil) or an analogue of guanosine (guanine) or uridine (uracil): X is guanosine (guanine), uridine (uracil), adenosine (adenine), thymidine (thymine), cytidine (cytosine) or an analogue of the above-mentioned nucleotides (nucleosides); 1 is an integer from 1 to 40, wherein when 1=1G is guanosine (guanine) or an analogue thereof, when 1>1 at least 50% of the nucleotides are guanosine (guanine) or an analogue thereof; m is an integer and is at least 3; wherein when m=3× is uridine (uracil) or an analogue thereof, when m>3 at least 3 successive uridines (uracils) or analogues of uridine (uracil) occur; n is an integer from 1 to 40, wherein when n=1G is guanosine (guanine) or an analogue thereof, when n>1 at least 50% of the nucleotides (nucleosides) are guanosine (guanine) or an analogue thereof, or formula (Vb): $(N_uG_lX_mG_nN_v)_a$, wherein: G is guanosine (guanine), uridine (uracil) or an analogue of guanosine (guanine) or uridine (uracil), preferably guanosine (guanine) or an analogue thereof; X is guanosine (guanine), uridine (uracil), adenosine (adenine), thymidine (thymine), cytidine (cytosine), or an analogue of these nucleotides (nucleosides), preferably uridine (uracil) or an analogue thereof; N is a nucleic acid sequence having a length of about 4 to 50, preferably of about 4 to 40, more preferably of about 4 to 30 or 4 to 20 nucleic acids, each N independently being selected from guanosine (guanine), uridine (uracil), adenosine (adenine), thymidine (thymine), cytidine (cytosine) or an analogue of these nucleotides (nucleosides); a is an integer from 1 to 20, preferably from 1 to 15, most preferably from 1 to 10; 1 is an integer from 1 to 40, wherein when 1=1, G is guanosine (guanine) or an analogue thereof, when 1>1, at least 50% of these nucleotides (nucleosides) are guanosine (guanine) or an analogue thereof; m is an integer and is at least 3; wherein when m=3, X is uridine (uracil) or an analogue thereof, and when m>3, at least 3 successive uridines (uracils) or analogues of uridine (uracil) occur; n is an integer from 1 to 40, wherein when n=1, G is guanosine (guanine) or an analogue thereof, when n>1, at least 50% of these nucleotides (nucleosides) are guanosine (guanine) or an analogue thereof; u,v may be independently from each other an integer from 0 to 50, preferably wherein when u=0, v≥1, or when v=0, u≥1; wherein the nucleic acid molecule of formula (Vb) has a length of at least 50 nucleotides, preferably of at least 100 nucleotides, more preferably of at least 150 nucleotides, even more preferably of at least 200 nucleotides and most preferably of at least 250 nucleotides.

Other suitable adjuvants may furthermore be selected from nucleic acids having the formula (VI): $C_lX_mC_n$, wherein: C is cytidine (cytosine), uridine (uracil) or an analogue of cytidine (cytosine) or uridine (uracil); X is guanosine (guanine), uridine (uracil), adenosine (adenine), thymidine (thymine), cytidine (cytosine) or an analogue of the above-mentioned nucleotides (nucleosides); I is an integer from 1 to 40, wherein when I=1 C is cytidine (cytosine) or an analogue thereof, when I>1 at least 50% of the nucleotides are cytidine (cytosine) or an analogue thereof; m is an integer and is at least 3; wherein when m=3× is uridine (uracil) or an analogue thereof, when m>3 at least 3 successive uridines (uracils) or analogues of uridine (uracil)

occur; n is an integer from 1 to 40, wherein when n=1 C is cytidine (cytosine) or an analogue thereof, when n>1 at least 50% of the nucleotides (nucleosides) are cytidine (cytosine) or an analogue thereof.

In this context the disclosure of WO 002008014878 and WO2008085226 is also incorporated herein by reference.

In a further aspect, the present invention provides a vaccine, which is based on the mRNA sequence according to the invention comprising at least one coding region as defined herein. The vaccine according to the invention is preferably a (pharmaceutical) composition as defined herein.

Accordingly, the vaccine according to the invention is based on the same components as the (pharmaceutical) composition described herein. Insofar, it may be referred to the description of the (pharmaceutical) composition as provided herein. Preferably, the vaccine according to the invention comprises at least one mRNA comprising at least one mRNA sequence as defined herein and a pharmaceutically acceptable carrier. In embodiments, where the vaccine comprises more than one mRNA sequence (such as a plurality of RNA sequences according to the invention, wherein each preferably encodes a distinct antigenic peptide or protein), the vaccine may be provided in physically separate form and may be administered by separate administration steps. The vaccine according to the invention may correspond to the (pharmaceutical) composition as described herein, especially where the mRNA sequences are provided by one single composition. However, the inventive vaccine may also be provided physically separated. For instance, in embodiments, wherein the vaccine comprises more than one mRNA sequences/species, these RNA species may be provided such that, for example, two, three, four, five or six separate compositions, which may contain at least one mRNA species/sequence each (e.g. three distinct mRNA species/sequences), each encoding distinct antigenic peptides or proteins, are provided, which may or may not be combined. Also, the inventive vaccine may be a combination of at least two distinct compositions, each composition comprising at least one mRNA encoding at least one of the antigenic peptides or proteins defined herein. Alternatively, the vaccine may be provided as a combination of at least one mRNA, preferably at least two, three, four, five, six or more mRNAs, each encoding one of the antigenic peptides or proteins defined herein. The vaccine may be combined to provide one single composition prior to its use or it may be used such that more than one administration is required to administer the distinct mRNA sequences/species encoding any of the antigenic peptides or proteins as defined herein. If the vaccine contains at least one mRNA sequence, typically at least two mRNA sequences, encoding the antigen combinations defined herein, it may e.g. be administered by one single administration (combining all mRNA species/sequences), by at least two separate administrations. Accordingly; any combination of mono-, bi- or multicistronic mRNAs encoding the at least one antigenic peptide or protein or any combination of antigens as defined herein (and optionally further antigens), provided as separate entities (containing one mRNA species) or as combined entity (containing more than one mRNA species), is understood as a vaccine according to the present invention. According to a particularly preferred embodiment of the inventive vaccine, the at least one antigen, preferably a combination as defined herein of at least two, three, four, five, six or more antigens encoded by the inventive composition as a whole, is provided as an individual (monocistronic) mRNA, which is administered separately.

As with the (pharmaceutical) composition according to the present invention, the entities of the vaccine may be provided in liquid and or in dry (e.g. lyophilized) form. They may contain further components, in particular further components allowing for its pharmaceutical use. The vaccine or the (pharmaceutical) composition may, e.g., additionally contain a pharmaceutically acceptable carrier and/or further auxiliary substances and additives and/or adjuvants.

The vaccine or (pharmaceutical) composition typically comprises a safe and effective amount of the mRNA according to the invention as defined herein, encoding an antigenic peptide or protein as defined herein or a fragment or variant thereof or a combination of antigens, preferably as defined herein. As used herein, "safe and effective amount" means an amount of the mRNA that is sufficient to significantly induce a positive modification of cancer or a disease or disorder related to cancer. At the same time, however, a "safe and effective amount" is small enough to avoid serious side-effects that is to say to permit a sensible relationship between advantage and risk. The determination of these limits typically lies within the scope of sensible medical judgment. In relation to the vaccine or (pharmaceutical) composition of the present invention, the expression "safe and effective amount" preferably means an amount of the mRNA (and thus of the encoded antigen) that is suitable for stimulating the adaptive immune system in such a manner that no excessive or damaging immune reactions are achieved but, preferably, also no such immune reactions below a measurable level. Such a "safe and effective amount" of the mRNA of the (pharmaceutical) composition or vaccine as defined herein may furthermore be selected in dependence of the type of mRNA, e.g. monocistronic, bi- or even multicistronic mRNA, since a bi- or even multicistronic mRNA may lead to a significantly higher expression of the encoded antigen(s) than the use of an equal amount of a monocistronic mRNA. A "safe and effective amount" of the mRNA of the (pharmaceutical) composition or vaccine as defined above will furthermore very in connection with the particular condition to be treated and also with the age and physical condition of the patient to be treated, the severity of the condition, the duration of the treatment, the nature of the accompanying therapy, of the particular pharmaceutically acceptable carrier used, and similar factors, within the knowledge and experience of the accompanying doctor. The vaccine or composition according to the invention can be used according to the invention for human and also for veterinary medical purposes, as a pharmaceutical composition or as a vaccine.

In a preferred embodiment, the mRNA of the (pharmaceutical) composition, vaccine or kit of parts according to the invention is provided in lyophilized form. Preferably, the lyophilized mRNA is reconstituted in a suitable buffer, advantageously based on an aqueous carrier, prior to administration, e.g. Ringer-Lactate solution, which is preferred, Ringer solution, a phosphate buffer solution. In a preferred embodiment, the (pharmaceutical) composition, the vaccine or the kit of parts according to the invention contains at least one, two, three, four, five, six or more mRNAs, preferably mRNAs which are provided separately in lyophilized form (optionally together with at least one further additive) and which are preferably reconstituted separately in a suitable buffer (such as Ringer-Lactate solution) prior to their use so as to allow individual administration of each of the (monocistronic) mRNAs.

The vaccine or (pharmaceutical) composition according to the invention may typically contain a pharmaceutically acceptable carrier. The expression "pharmaceutically acceptable carrier" as used herein preferably includes the liquid or non-liquid basis of the inventive vaccine. If the inventive vaccine is provided in liquid form, the carrier will be water, typically pyrogen-free water; isotonic saline or buffered (aqueous) solutions, e.g. phosphate, citrate etc. buffered solutions. Particularly for injection of the inventive vaccine, water or preferably a buffer, more preferably an aqueous buffer, may be used, containing a sodium salt, preferably at least 50 mM of a sodium salt, a calcium salt, preferably at least 0.01 mM of a calcium salt, and optionally a potassium salt, preferably at least 3 mM of a potassium salt. According to a preferred embodiment, the sodium, calcium and, optionally, potassium salts may occur in the form of their halogenides, e.g. chlorides, iodides, or bromides, in the form of their hydroxides, carbonates, hydrogen carbonates, or sulphates, etc. Without being limited thereto, examples of sodium salts include e.g. NaCl, NaI, NaBr, $Na_2CO_3$, $NaHCO_3$, $Na_2SO_4$, examples of the optional potassium salts include e.g. KCl, KI, KBr, $K_2CO_3$, $KHCO_3$, $K_2SO_4$, and examples of calcium salts include e.g. $CaCl_2$, $CaI_2$, $CaBr_2$, $CaCO_3$, $CaSO_4$, $Ca(OH)_2$. Furthermore, organic anions of the aforementioned cations may be contained in the buffer. According to a more preferred embodiment, the buffer suitable for injection purposes as defined above, may contain salts selected from sodium chloride (NaCl), calcium chloride ($CaCl_2$) and optionally potassium chloride (KCl), wherein further anions may be present additional to the chlorides. $CaCl_2$ can also be replaced by another salt like KCl. Typically, the salts in the injection buffer are present in a concentration of at least 50 mM sodium chloride (NaCl), at least 3 mM potassium chloride (KCl) and at least 0.01 mM calcium chloride ($CaCl_2$). The injection buffer may be hypertonic, isotonic or hypotonic with reference to the specific reference medium, i.e., the buffer may have a higher, identical or lower salt content with reference to the specific reference medium, wherein preferably such concentrations of the afore mentioned salts may be used, which do not lead to damage of cells due to osmosis or other concentration effects. Reference media are e.g. in "in vivo" methods occurring liquids such as blood, lymph, cytosolic liquids, or other body liquids, or e.g. liquids, which may be used as reference media in "in vitro" methods, such as common buffers or liquids. Such common buffers or liquids are known to a skilled person. Ringer-Lactate solution is particularly preferred as a liquid basis.

However, one or more compatible solid or liquid fillers or diluents or encapsulating compounds may be used as well, which are suitable for administration to a person. The term "compatible" as used herein means that the constituents of the inventive vaccine are capable of being mixed with the mRNA according to the invention as defined herein, in such a manner that no interaction occurs, which would substantially reduce the pharmaceutical effectiveness of the inventive vaccine under typical use conditions. Pharmaceutically acceptable carriers, fillers and diluents must, of course, have sufficiently high purity and sufficiently low toxicity to make them suitable for administration to a person to be treated. Some examples of compounds which can be used as pharmaceutically acceptable carriers, fillers or constituents thereof are sugars, such as, for example, lactose, glucose, trehalose and sucrose; starches, such as, for example, corn starch or potato starch; dextrose; cellulose and its derivatives, such as, for example, sodium carboxymethylcellulose, ethylcellulose, cellulose acetate; powdered tragacanth; malt; gelatin; tallow; solid glidants, such as, for example, stearic acid, magnesium stearate; calcium sulfate; vegetable ails, such as, for example, groundnut oil, cottonseed oil, sesame oil, olive oil, corn oil and oil from *theobroma*; polyols, such as, for example, polypropylene glycol, glycerol, sorbitol, mannitol and polyethylene glycol; alginic acid.

The choice of a pharmaceutically acceptable carrier is determined, in principle, by the manner, in which the pharmaceutical composition or vaccine according to the invention is administered. The composition or vaccine can be administered, for example, systemically or locally. Routes for systemic administration in general include, for example, transdermal, oral, parenteral routes, including subcutaneous, intravenous, intramuscular, intraarterial, intradermal and intraperitoneal injections and/or intranasal ID administration routes. Routes for local administration in general include, for example, topical administration routes but also intradermal, transdermal, subcutaneous, or intramuscular injections or intralesional, intracranial, intrapulmonal, intracardial, and sublingual injections. More preferably, composition or vaccines according to the present invention may be administered by an intradermal, subcutaneous, or intramuscular route, preferably by injection, which may be needle-free and/or needle injection. Composition or vaccines according to the present invention may also be administered by in ovo embryo injection, e.g. by injection of a bird embryo through the eggshell.

Compositions/vaccines are therefore preferably formulated in liquid or solid form. The suitable amount of the vaccine or composition according to the invention to be administered can be determined by routine experiments, e.g. by using animal models. Such models include, without implying any limitation, rabbit, sheep, mouse, rat, dog and non-human primate models. Preferred unit dose forms for injection include sterile solutions of water, physiological saline or mixtures thereof. The pH of such solutions should be adjusted to about 7.4. Suitable carriers for injection include hydrogels, devices for controlled or delayed release, polylactic acid and collagen matrices. Suitable pharmaceutically acceptable carriers for topical application include those which are suitable for use in lotions, creams, gels and the like. If the inventive composition or vaccine is to be administered perorally, tablets, capsules and the like are the preferred unit dose form. The pharmaceutically acceptable carriers for the preparation of unit dose forms which can be used for oral administration are well known in the prior art. The choice thereof will depend on secondary considerations such as taste, costs and storability, which are not critical for the purposes of the present invention, and can be made without difficulty by a person skilled in the art.

The inventive vaccine or composition can additionally contain one or more auxiliary substances in order to further increase the immunogenicity. A synergistic action of the mRNA contained in the inventive composition and of an auxiliary substance, which may be optionally be co-formulated (or separately formulated) with the inventive vaccine or composition as described above, is preferably achieved thereby. Depending on the various types of auxiliary substances, various mechanisms may play a role in this respect. For example, compounds that permit the maturation of dendritic cells (DCs), for example lipopolysaccharides, TNF-alpha or CD40 ligand, form a first class of suitable auxiliary substances. In general, it is possible to use as auxiliary substance any agent that influences the immune system in the manner of a "danger signal" (LPS, GP96, etc.) or cytokines, such as GM-CFS, which allow an immune response produced by the immune-stimulating adjuvant according to the invention to be enhanced and/or influenced in a targeted manner. Particularly preferred auxiliary substances are cytokines, such as monokines, lymphokines, interleukins or chemokines, that—additional to induction of the adaptive immune response by the encoded at least one antigen—promote the innate immune response, such as IL-1, IL-2, IL-3, IL-4, IL-5, IL-6, IL-7, IL-8, IL-9, IL-10, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, INF-alpha, IFN-beta, INF-gamma, GM-CSF, G-CSF, M-CSF, LT-beta or TNF-alpha, growth factors, such as hGH. Preferably, such immunogenicity increasing agents or compounds are provided separately (not co-formulated with the inventive vaccine or composition) and administered individually.

Further additives which may be included in the inventive vaccine or composition are emulsifiers, such as, for example, Tween; wetting agents, such as, for example, sodium lauryl sulfate; colouring agents; taste-imparting agents, pharmaceutical carriers; tablet-forming agents; stabilizers; antioxidants; preservatives.

The inventive vaccine or composition can also additionally contain any further compound, which is known to be immune-stimulating due to its binding affinity (as ligands) to human Toll-like receptors TLR1, TLR2, TLR3, TLR4, TLR5, TLR6, TLR7, TLR8, TLR9, TLR10, or due to its binding affinity (as ligands) to murine Toll-like receptors TLR1, TLR2, TLR3, TLR4, TLR5, TLR6, TLR7, TLR8, TLR9, TLR10, TLR11, TLR12 or TLR13.

Another class of compounds, which may be added to an inventive vaccine or composition in this context, may be CpG nucleic acids, in particular CpG-RNA or CpG-DNA. A CpG-RNA or CpG-DNA can be a single-stranded CpG-DNA (ss CpG-DNA), a double-stranded CpG-DNA (dsDNA), a single-stranded CpG-RNA (ss CpG-RNA) or a double-stranded CpG-RNA (ds CpG-RNA). The CpG nucleic acid is preferably in the form of CpG-RNA, more preferably in the form of single-stranded CpG-RNA (ss CpG-RNA). The CpG nucleic acid preferably contains at least one or more (mitogenic) cytosine/guanine dinucleotide sequence(s) (CpG motif(s)). According to a first preferred alternative, at least one CpG motif contained in these sequences, that is to say the C (cytosine) and the G (guanine) of the CpG motif, is unmethylated. All further cytosines or guanines optionally contained in these sequences can be either methylated or unmethylated. According to a further preferred alternative, however, the C (cytosine) and the G (guanine) of the CpG motif can also be present in methylated form.

Medical Use:

According to one aspect of the present invention, the mRNA sequence, the (pharmaceutical) composition or the vaccine may be used according to the invention (for the preparation of a medicament) for the treatment or prophylaxis of influenza virus infections or disorders related thereto.

In this context, also included in the present invention are methods of treating or preventing influenza virus infections or disorders related thereto, preferably as defined herein, by administering to a subject in need thereof a pharmaceutically effective amount of the mRNA sequence, the (pharmaceutical) composition or the vaccine according to the invention. Such a method typically comprises an optional first step of preparing the mRNA sequence, the composition or the vaccine of the present invention, and a second step, comprising administering (a pharmaceutically effective amount of) said composition or vaccine to a patient/subject in need thereof. A subject in need thereof will typically be a mammal. In the context of the present invention, the mammal is preferably selected from the group comprising, without being limited thereto, e.g. goat, cattle, porcine (e.g., swine), canine (e.g. dog), feline (e.g. cat), equines (e.g., horse), primates (e.g., donkey, monkey, ape), a rodent such as a mouse, hamster, rabbit and, particularly, human (e.g., children, adults, elderly people, pregnant women). A subject in need thereof may also be an avian species, e.g. bird (e.g., chicken).

The invention also relates to the use of the mRNA sequence, the composition or the vaccine according to the invention, preferably for eliciting an immune response in a mammal, preferably for the treatment or prophylaxis of influenza virus infections or a related condition as defined herein.

The present invention furthermore comprises the use of the mRNA sequence, the (pharmaceutical) composition or the vaccine according to the invention as defined herein for modulating, preferably for inducing or enhancing, an immune response in a mammal as defined herein, more preferably for preventing and/or treating influenza virus infections, or of diseases or disorders related thereto. In this context, support of the treatment or prophylaxis of influenza virus infections may be any combination of a conventional influenza therapy method such as therapy with antivirals such as neuraminidase inhibitors (e.g. oseltamivir and zanamivir) and M2 protein inhibitors (e.g. adamantane derivatives), and a therapy using the RNA or the pharmaceutical composition as defined herein. Support of the treatment or prophylaxis of influenza virus infections may be also envisaged in any of the other embodiments defined herein. Accordingly, any use of the mRNA sequence, the (pharmaceutical) composition or the vaccine according to the invention in co-therapy with any other approach, preferably one or more of the above therapeutic approaches, in particular in combination with antivirals is within the scope of the present invention.

For administration, preferably any of the administration routes may be used as defined herein. In particular, an administration route is used, which is suitable for treating or preventing an influenza virus infection as defined herein or diseases or disorders related thereto, by inducing or enhancing an adaptive immune response on the basis of an antigen encoded by the mRNA sequence according to the invention. Administration of the composition and/or the vaccine according to the invention may then occur prior, concurrent and/or subsequent to administering another composition and/or vaccine as defined herein, which may—in addition—contain another mRNA sequence or combination of mRNA sequences encoding a different antigen or combination of antigens, wherein each antigen encoded by the mRNA sequence according to the invention is preferably suitable for the treatment or prophylaxis of influenza virus infections and diseases or disorders related thereto. In this context, a treatment as defined herein may also comprise the modulation of a disease associated to influenza virus infection end of diseases or disorders related thereto.

According to a preferred embodiment of this aspect of the invention, the (pharmaceutical) composition or the vaccine according to the invention is administered by injection. Any suitable injection technique known in the art may be employed. Preferably, the inventive composition is administered by injection, preferably by needle-less injection, for example by jet-injection.

In one embodiment, the inventive composition comprises at least one, two, three, four, five, six, seven, eight, nine, ten, eleven, twelve or more mRNAs as defined herein, each of which is preferably injected separately, preferably by needle-less injection. Alternatively, the inventive composition comprises at least one, two, three, four, five, six, seven, eight, nine, ten, eleven, twelve or more mRNAs, wherein the at least one, two, three, four, five, six, seven, eight, nine, ten, eleven, twelve or more mRNAs are administered, preferably by injection as defined herein, as a mixture.

The immunization protocol for the immunization of a subject against an antigen or a combination of at least two, three, four, five, six, seven, eight, nine, ten, eleven, twelve or more antigens as defined herein typically comprises a series of single doses or dosages of the (pharmaceutical) composition or the vaccine according to the invention. A single dosage, as used herein, refers to the initial/first dose, a second dose or any further doses, respectively, which are preferably administered in order to "boost" the immune reaction. In this context, each single dosage preferably comprises the administration of the same antigen or the same combination of antigens as defined herein, wherein the interval between the administration of two single dosages can vary from at least one day, preferably 2, 3, 4, 5, B or 7 days, to at least one week, preferably 2, 3, 4, 5, 6, 7 or 8 weeks. The intervals between single dosages may be constant or vary over the course of the immunization protocol, e.g., the intervals may be shorter in the beginning and longer towards the end of the protocol. Depending on the total number of single dosages and the interval between single dosages, the immunization protocol may extend over a period of time, which preferably lasts at least one week, more preferably several weeks (e.g. 2, 3, 4, 5, 6, 7, 8, 9, 10, 11 or 12 weeks), even more preferably several months (e.g. 3, 4, 5, 6, 7, 8, 9, 10, 11, 12, 18 or 24 months). Each single dosage preferably encompasses the administration of an antigen, preferably of a combination of at least two, three, four, five, six, seven, eight, nine, ten, eleven, twelve or more antigens as defined herein and may therefore involve at least one, preferably 1, 2, 3, 4, 5, 6, 7, 8, 9, 10, 11 or 12 injections. In some cases, the composition or the vaccine according to the invention is administered as a single dosage typically in one injection. In the case, where the vaccine according to the invention comprises separate mRNA formulations encoding distinct antigens as defined herein, the minimum number of injections carried out during the administration of a single dosage corresponds to the number of separate components of the vaccine. In certain embodiments, the administration of a single dosage may encompass more than one injection for each component of the vaccine (e.g. a specific mRNA formulation comprising an mRNA encoding, for instance, one antigenic peptide or protein as defined herein). For example, parts of the total volume of an individual component of the vaccine may be injected into different body parts, thus involving more than one injection. In a more specific example, a single dosage of a vaccine comprising four separate mRNA formulations, each of which is administered in two different body parts, comprises eight injections. Typically, a single dosage comprises all injections required to administer all components of the vaccine, wherein a single component may be involve more than one injection as outlined above. In the case, where the administration of a single dosage of the vaccine according to the invention encompasses more than one injection, the injection are carried out essentially simultaneously or concurrently, i.e. typically in a time-staggered fashion within the time-frame that is required for the practitioner to carry out the single injection steps, one after the other. The administration of a single dosage therefore preferably extends over a time period of several minutes, e.g. 2, 3, 4, 5, 10, 15, 30 or 60 minutes.

Administration of the mRNA sequence as defined herein, the (pharmaceutical) composition or the vaccine according to the invention may be carried out in a time staggered treatment. A time staggered treatment may be e.g. administration of the mRNA sequence, the composition or the vaccine prior, concurrent and/or subsequent to a conventional therapy of influenza virus infections or diseases or disorders related thereto, e.g. by administration of the mRNA sequence, the composition or the vaccine prior, concurrent and/or subsequent to a therapy or an administration of a therapeutic suitable for the treatment or ID prophylaxis of influenza virus infections or diseases or disorders related thereto. Such time staggered treatment may be carried out using e.g. a kit, preferably a kit of parts as defined herein.

Time staggered treatment may additionally or alternatively also comprise an administration of the mRNA sequence as defined herein, the (pharmaceutical) composition or the vaccine according to the invention in a form, wherein the mRNA encoding an antigenic peptide or protein as defined herein or a fragment or variant thereof, preferably forming part of the composition or the vaccine, is administered parallel, prior or subsequent to another mRNA sequence encoding an antigenic peptide or protein as defined above, preferably forming part of the same inventive composition or vaccine. Preferably, the administration (of all mRNA sequences) occurs within an hour, more preferably within 30 minutes, even more preferably within 15, 10, 5, 4, 3, or 2 minutes or even within 1 minute. Such time staggered treatment may be carried out using e.g. a kit, preferably a kit of parts as defined herein.

In a preferred embodiment, the pharmaceutical composition or the vaccine of the present invention is administered repeatedly, wherein each administration preferably comprises individual administration of the at least one mRNA of the inventive composition or vaccine. At each time point of administration, the at least one mRNA may be administered more than once (e.g. 2 or 3 times). In a particularly preferred embodiment of the invention, at least two, three, four, five, six or more mRNA sequences (each encoding a distinct one of the antigens as defined herein) are administered at each time point, wherein each mRNA is administered twice by injection, distributed over the four limbs.

In a preferred embodiment, the pharmaceutical composition or the vaccine of the present invention comprising at least one mRNA as defined herein is administered via intradermal or intramuscular or subcutaneous injection to the subject in need. In embodiments where the pharmaceutical composition or the vaccine of the present invention comprises 2, 3, 4, 5, 6, 7, 8, 6, 10, 11, 12, 13, 14, 15, 16, 17, 18, 19, 20 different mRNAs as defined herein, the pharmaceutical composition or the vaccine is administered via intradermal or intramuscular or subcutaneous injection, wherein administration is performed once, or twice (in a prime-boost regimen), or three times (in a prime-boost-boost regimen).

Kit or Kit of Parts:

According to another aspect of the present invention, the present invention also provides a kit, in particular a kit of parts, comprising the mRNA sequence as defined herein, the (pharmaceutical) composition, and/or the vaccine according to the invention, optionally a liquid vehicle for solubilising and optionally technical instructions with information on the administration and dosage of the mRNA sequence, the composition and/or the vaccine. The technical instructions may contain information about administration and dosage of the mRNA sequence, the composition and/or the vaccine.

Such kits, preferably kits of parts, may be applied e.g. for any of the above mentioned applications or uses, preferably for the use of the mRNA sequence according to the invention (for the preparation of an inventive medicament, preferably a vaccine) for the treatment or prophylaxis of influenza virus infections or diseases or disorders related thereto. The kits may also be applied for the use of the mRNA sequence, the composition or the vaccine as defined herein (for the preparation of an inventive vaccine) for the treatment or prophylaxis of influenza virus infections or diseases or disorders related thereto, wherein the mRNA sequence, the composition and/or the vaccine may be capable of inducing or enhancing an immune response in a mammal as defined above. Such kits may further be applied for the use of the mRNA sequence, the composition or the vaccine as defined herein (for the preparation of an inventive vaccine) for modulating, preferably for eliciting, e.g. to induce or enhance, an immune response in a mammal as defined above, and preferably for supporting treatment or prophylaxis of influenza virus infections or diseases or disorders related thereto. Kits of parts, as a special form of kits, may contain one or more identical or different compositions and/or one or more identical or different vaccines as described herein in different parts of the kit. Kits of parts may also contain an (e.g. one) composition, an (e.g. one) vaccine and/or the mRNA sequence according to the invention in different parts of the kit, e.g. each part of the kit containing an mRNA sequence as defined herein, preferably encoding a distinct antigen. Preferably, the kit or the kit of parts contains as a part a vehicle for solubilising the mRNA according to the invention, the vehicle preferably being Ringer-lactate solution. Any of the above kits may be used in a treatment or prophylaxis as defined above.

In another embodiment of this aspect, the kit according to the present invention may additionally contain at least one adjuvant. In a further embodiment, the kit according to the present invention may additionally contain at least one further pharmaceutically active component, preferably a therapeutic compound suitable for treatment and/or prophylaxis of cancer or a related disorder. Moreover, in another embodiment, the kit may additionally contain parts and/or devices necessary or suitable for the administration of the composition or the vaccine according to the invention, including needles, applicators, patches, injection-devices.

SHORT DESCRIPTION OF THE FIGURES

The figures shown in the following are merely illustrative and shall describe the present invention in a further way. These figures shall not be construed to limit the present invention thereto.

FIG. 1: shows hemagglutinin (HA) proteins of influenza A virus.

Legend to FIG. 1: First column: Protein or Nucleic Acid Accession No. ("NCBI, Genbank or EpiFlu Accession No."); second column ("A"): Protein Sequence wild type SEQ ID NOs; third column ("B"): Nucleotide Sequence wild type SEQ ID NOs; fourth column ("C"): Optimized Nucleotide Sequence SEQ ID NOs.

FIG. 2: shows hemagglutinin (HA) proteins of influenza B virus.

Legend to FIG. 2: First column: Protein or Nucleic Acid Accession No. ("NCBI, Genbank or EpiFlu Accession No."); second column ("A"): Protein Sequence wild type SEQ ID NOs; third column ("B"): Nucleotide Sequence wild type SEQ ID NOs; fourth column ("C"): Optimized Nucleotide Sequence SEQ ID NOs.

FIG. 3: shows neuraminidase (NA) proteins of influenza A virus.

Legend to FIG. 3: First column: Protein or Nucleic Acid Accession No. ("NCBI. Genbank or EpiFlu Accession No."); second column ("A"): Protein Sequence wild type SEQ ID NOs; third column ("B"): Nucleotide Sequence wild type SEQ ID NOs; fourth column ("C"): Optimized Nucleotide Sequence SEQ ID NOs.

FIG. 4: shows neuraminidase (NA) proteins of influenza B virus.

Legend to FIG. 4: First column: Protein or Nucleic Acid Accession No. ("NCBI, Genbank or EpiFlu Accession No."); second column ("A"): Protein Sequence wild type SEQ ID NOs; third column ("B"): Nucleotide Sequence wild type SEQ ID NOs; fourth column ("C"): Optimized Nucleotide Sequence SEQ ID NOs.

FIG. 5(A): shows the presence of IgG1 antibodies specific for influenza HA in mice that were vaccinated once with mRNA encoding HA (R1010, SEQ ID NO: 213659), mRNA encoding NA (R997, SEQ ID NO: 213708) or both mRNAs (R1010 and R997). A detailed description of the experiment is provided in the example section (see Example 2).

FIG. 5(B): shows the presence of IgG2a antibodies specific for influenza HA in mice that were vaccinated once with mRNA encoding HA R1010, SEQ ID NO: 213659), mRNA encoding NA (R997, SEQ ID NO: 213708) or both mRNAs (R1010 and R997). A detailed description of the experiment is provided in the example section (see Example 2).

FIG. 6(A): shows the presence of total IgG antibodies specific for influenza HA H1N1pdm09 HA A/California/7/2009 in mice that were vaccinated with a combination of three different mRNAs, one encoding HA of influenza H1N1pdm09 HA A/California/7/2009, one encoding HA of influenza H1N1 HA A/Brisbane/59/2007 and one encoding HA of influenza H3N2 HA A/Uruguay/716/2007 compared to vaccinations with the single mRNA-base antigens. A detailed description of the experiment is provided in the example section (see Example 3).

FIG. 6(B): shows the presence of total IgG antibodies specific for influenza HA H1N1 HA A/Brisbane/59/2007 in mice that were vaccinated with a combination of three different mRNAs, one encoding HA of influenza H1N1pdm09 HA A/California/7/2009, one encoding HA of influenza H1N1 HA A/Brisbane/59/2007 and one encoding HA of influenza H3N2 HA A/Uruguay/716/2007 compared to vaccinations with the single mRNA-base antigens. A detailed description of the experiment is provided in the example section (see Example 3).

FIG. 6(C): shows the presence of total IgG antibodies specific for influenza H3N2 HA A/Uruguay/716/2007 in mice that were vaccinated with a combination of three different mRNAs, one encoding HA of influenza H1N1pdm09 HA A/California/7/2009, one encoding HA of influenza H1N1 HA A/Brisbane/59/2007 and one encoding HA of influenza H3N2 HA A/Uruguay/71G/2007 compared to vaccinations with the single mRNA-base antigens. A detailed description of the experiment is provided in the example section (see Example 3).

FIG. 7: shows the presence of total IgG1 and IgG2 antibodies specific for Influenza B HA of mice that were vaccinated with mRNAs encoding HA of influenza B/Brisbane/60/2008. A detailed description of the experiment is provided in Example 5.

FIG. 8: shows the presence of total IgG1 and IgG2 antibodies specific for Influenza H1N1 (A/California/7/2009) of mice that were vaccinated with a combination of four mRNAs coding for different Influenza antigens (B-D) compared to a control injected with $RiL_B$ (A). For each vaccination, three different time points are shown (d21, d35, and d49). Vaccination scheme, see Table 4. A detailed description of the experiment is provided in Example 6.

FIG. 8: shows HI titers specific for influenza H1N1 (A/California/7/2009) of mice that were vaccinated with a combination of four mRNAs coding for different Influenza antigens (B-D) compared to a control injected with RiLa (A). For each vaccination, three different time points are shown (d21, d35, and d49). Vaccination scheme, see Table 4. A detailed description of the experiment is provided in Example B.

FIG. 10: shows the presence of total IgG1 and IgG2 antibodies specific for Influenza H3N2 (A/Hong Kong/4801/2014) of mice that were vaccinated with a combination of four mRNAs coding for different Influenza antigens (B-D) compared to a control injected with $RiL_B$ (A). For each vaccination, three different time points are shown (d21, d35, and d49). Vaccination scheme, see Table 4. A detailed description of the experiment is provided in Example 6.

FIG. 11: shows the presence of total IgG1 and IgG2 antibodies specific for Influenza B (B/Brisbane/60/2008) of mice that were vaccinated with a combination of four mRNAs coding for different Influenza antigens (B-D) compared to a control injected with RiLa (A). For each vaccination, three different time points are shown (d21, d35, and d48). Vaccination scheme, see Table 4. A detailed description of the experiment is provided in Example B.

FIG. 12: shows the presence of total IgG1 and IgG2 antibodies specific for Influenza B (B/Phuket/3073/2013) of mice that were vaccinated with a combination of four mRNAs coding for different Influenza antigens (B-D) compared to a control injected with RiLa (A). For each vaccination, three different time points are shown (d2l, d35, and d49). Vaccination scheme, see Table 4. A detailed description of the experiment is provided in Example B.

FIG. 13: shows that vaccination of mice with a combination of four mRNAs coding for different Influenza antigens (C and D) induced CD4+ T-cell responses against HIM (A/California/7/2009), H3N2 (A/Hong Kong/4801/2014), influenza B (B/Brisbane/60/2008), influenza B (B/Phuket/3073/2013) (1-4 respectively). As a control, calls were stimulated with buffer (5). As further controls, mica were injected Rila (A) and protein (R). Vaccination scheme, see Table 5. A detailed description of the experiment is provided in Example 7.

FIG. 14: shows that vaccination of mice with a combination of four mRNAs coding for different Influenza antigens (C and D) induced CD8+ T-cell responses against H1N1 (A/California/7/2009) (1). As a control, calls were stimulated with buffer (5). As further controls, mice were injected Rila (A) and protein (B). Vaccination scheme, see Table 5. A detailed description of the experiment is provided in Example 7.

FIG. 15: shows the presence of total IgG1 and IgG2 antibodies specific for Influenza H1N1 (A/California/7/2009) of mica that were vaccinated with a combination of four mRNAs coding for different Influenza antigens (B and C) compared to a control injected with RiLa (A). For each vaccination, three different time points ara shown (d21, d35, and d49). Vaccination scheme, see Table B. A detailed description of the experiment is provided in Example B.

FIG. 16: shows the presence of total IgG1 and IgG2 antibodies specific for Influenza H3N2 (A/HongKong/4801/2014) of mice that were vaccinated with a combination of four mRNAs coding for different Influenza antigens (B and C) compared to a control injected with Rila (A). For each vaccination, three different time points are shown (d21, d35, and d49). Vaccination scheme, see Table 6. A detailed description of the experiment is provided in Example B.

FIG. 17: shows HI titers specific for Influenza H3N2 (A/HongKong/4801/2014) and virus neutralizing titers (VNT) of mica that were vaccinated with a combination of four mRNAs coding for different Influenza antigens (B-D) compared to a control injected with RiLa (A). Vaccination scheme, see Table G. A detailed description of the experiment is provided in Example B.

FIG. 18: shows the presence of total IgG1 and IgG2 antibodies specific for Influenza B (B/Brisbane/60/2008) of mice that were vaccinated with a combination of four mRNAs coding for different Influenza antigens (B and C) compared to a control injected with RiLa (A). For each vaccination, three different time points are shown (d21, d35, and d49). Vaccination scheme, see Table G. A detailed description of the experiment is provided in Example B.

FIG. 19: shows the presence of total IgG1 and IgG2 antibodies specific for Influenza H5N1 (A/Vietnam/1203/2004) of mice that were vaccinated with a combination of four mRNAs coding for different Influenza antigens (B and C) compared to a control injected with RiLa (A). For each vaccination, three different time points are shown (d21, d35, and d49). Vaccination scheme, see Table 8. A detailed description of the experiment is provided in Example 8.

FIG. 20: shows that vaccination of mice with a combination of four mRNAs coding for different Influenza antigens (C and D) induced CD8+ T-cell responses against H1N1 (A/California/7/2009) and H5N1 (A/Vietnam/1203/2004) (I and 4 respectively). As a control, cells were stimulated with buffer (5). As further controls, mica were injected Rila (A) and protein (B). Vaccination scheme, see Table 7. A detailed description of the experiment is provided in Example 9.

FIG. 21: shows that vaccination of mice with a combination of four mRNAs coding for different Influenza antigens (C and D) ID induced CD4+ T-cell responses against H1N1 (A/California/7/2009), H3N2 (A/HongKong/4801/2014), influenza B (B/Brisbane/60/2008), H5N1 (A/Vietnam/1203/2004) (1-4 respectively). As a control, cells were stimulated with buffer (5). As further controls, mice were injected Rila (A) and protein (B). Vaccination scheme, see Table 7. A detailed description of the experiment is provided in Example B.

FIG. 22: shows protein expression of HeLa cells transfected with mRNAs coding for different neuraminidase antigens (A: N1 A/California/7/2009; B: N2 A/HongKong/4801/2014; C: N (B/Brisbane/60/2008)). Respective doses indicated. A detailed description of the experiment is provided in Example 10.

FIG. 23: shows ELLA titers in serum samples of mice that were vaccinated with mRNAs coding for Influenza N1 (A/California/7/2009) neuraminidase (A and B) compared to a control injected with Influsplit® (C) and RiLa (D). Vaccination scheme, see Table 8. A detailed description of the experiment is provided in Example 11.

FIG. 24: shows that vaccination of mice with mRNAs coding for Influenza N1 (A/California/7/2009) neuraminidase induced CD2+ T-cell responses against Neuraminidase (A and B). As controls, mice were injected with Influsplit® (C) and RiLa (D). Vaccination scheme, see Table 8. A detailed description of the experiment is provided in Example 11.

FIG. 25: shows that vaccination of mice with mRNAs coding for Influenza N1 (A/California/7/2009) neuraminidase induced CD4+ T-cell responses against neuraminidase (A and 8). As controls, mice were injected with Influsplit® (C) and RiLa (D). Vaccination scheme, see Table 8. A detailed description of the experiment is provided in Example 11.

FIG. 26: shows ELLA titers in mice that were vaccinated with mRNAs coding for Influenza N2 (A/Hong Kong/4801/2014) neuraminidase (A and B) compared to a control injected with Influsplit® (C) and RiLa (D). Vaccination scheme, see Table 9. A detailed description of the experiment is provided in Example 12.

FIG. 27: shows ELLA titers in mice that were vaccinated with mRNAs coding for influenza B/Brisbane/60/2008 neuraminidase (A and B) compared to a control injected with Influsplit® (C) and RiLa (D). Vaccination scheme, see Table 10. A detailed description of the experiment is provided in Example 13.

EXAMPLES

The Examples shown in the following are merely illustrative and shall describe the present invention in a further way. These Examples shall not be construed to limit the present invention thereto.

Example 1: Preparation of mRNA Vaccines

1.1 Preparation of DNA and mRNA Constructs

For the present examples DNA sequences encoding influenza proteins/antigens, were prepared and used for subsequent RNA in vitro transcription reactions.

Most DNA sequences were prepared by modifying the wild type encoding DNA sequences by introducing a GC-optimized sequence. Sequences were introduced into a pUC19 derived vector and modified to comprise stabilizing sequences derived from alpha-globin-3'-UTR, a stretch of 30 cytosines, and a stretch of 64 adenosines at the 3'-terminal end (poly-A-tail).

Other sequences were introduced into a pUC19 derived vector to comprise stabilizing sequences derived from 32 L4 5'-UTR ribosomal 5'TOP-UTR and 3'-UTR derived from albumin 7, a stretch of 30 cytosines, a histone-stem-loop structure, and a stretch of 64 adenosines at the 3'-terminal end (poly-A-tail).

The following constructs, coding for the indicated antigens are used in the present example:

R1010: mRNA encoding HA of influenza A H1N1 PR8 (SEQ ID NO: 213659)

R997: mRNA encoding NA of influenza A H1N1 PR8 (SEQ ID NO: 213708)

R1594: mRNA encoding HA of influenza A H1N1pdm09 HA A/California/7/2009 (SEQ ID NO: 213561)

mRNA encoding NA of Influenza A H1N1 A/California/7/2009 (SEQ ID NO: 213747)

R1427: mRNA encoding HA of influenza A H3N2 HA A/Uruguay/716/2007 (SEQ ID NO: 213669)

R1425: mRNA encoding HA of influenza A H1N1 HA A/Brisbane/59/2007 (SEQ ID NO: 213558)

mRNA encoding HA of Influenza B (B/Brisbane/60/2008) (SEQ ID NO: 213680)

mRNA encoding NA of Influenza B/Brisbane/60/2008 (SEQ ID NO: 213777)

mRNA encoding HA of Influenza B (B/Phuket/3073/2013) (SEQ ID NO: 213690)

mRNA encoding NA of Influenza B (B/Phuket/3073/2013) (SEQ ID NO: 213779)

mRNA encoding HA of Influenza A H1N1 A/Netherlands/602/2009 (SEQ ID NO: 213610)

mRNA encoding NA of Influenza A H1N1 A/Netherlands/602/2009 (SEQ ID NO: 213755)

mRNA encoding HA of Influenza A H3N2 A/Hong Kong/4801/2014 (SEQ ID NO: 213825)

mRNA encoding NA of Influenza A H3N2 A/Hong Kong/4801/2014 (SEQ ID NO: 213765)

mRNA encoding HA of Influenza A H5N1 A/Vietnam/1203/2004 (SEQ ID NO: 213644)

mRNA encoding NA of Influenza A H5N1 A/Vietnam/1203/2004 (SEQ ID NO: 213771)

The obtained plasmid DNA constructs were transformed and propagated in bacteria (*Escherichia coli*) using common protocols known in the art.

1.2. RNA In Vitro Transcription

The DNA plasmids prepared according to paragraph 1 were enzymatically linearized using EcoRI and transcribed in vitro using DNA dependent T7 RNA polymerase in the presence of a nucleotide mixture and cap analog (m7GpppG) under suitable buffer conditions. The obtained mRNAs purified using PureMessenger® (CureVac, Tübingen, Germany; WD 2008/077592 A1) were used for in vivo vaccination experiments (see Examples 2-18).

Compositions comprising more than one mRNA encoding different Influenza proteins/antigens may also be produced according to procedures as disclosed in the POT application PCT/EP2016/082487.

1.3. Preparation of Protamine Complexed mRNA ("RNActive® Formulation")

The obtained antigen mRNA constructs were complexed with protamine prior to use in vivo vaccination experiments. The mRNA complexation consists of a mixture of 50% free mRNA and 50% mRNA complexed with protamine at a weight ratio of 2:1. First, mRNA is complexed with protamine by addition of protamine-Ringer's lactate solution or protamine-trehalose solution to mRNA. After incubation for 10 minutes, when the complexes are stably generated, free mRNA is added, and the final concentration of the vaccine is adjusted with Ringer's lactate solution.

1.4. Preparation of LNP Encapsulated mRNA

Obtained antigen mRNA constructs are encapsulated in lipid nanoparticle (LNP)-prior to use in in vivo experiments. LNP-encapsulated mRNA is prepared using an ionizable amino lipid (cationic lipid), phospholipid, cholesterol and a PEGylated lipid. Cationic lipid, DSPC, cholesterol and PEG-lipid are solubilized in ethanol. mRNA is diluted to a total concentration of 0.05 mg/mL in 50 mM citrate buffer, pH 4. Syringe pumps are used to mix the ethanolic lipid solution with mRNA at a ratio of about 1:6 to 1:2 (vol/vol). The ethanol is then removed and the external buffer replaced with PBS by dialysis. Finally, the lipid nanoparticles are filtered through a 0.2 μm pore sterile filter. Lipid nanoparticle particle diameter size is determined by quasi-elastic light scattering using a Malvern Zetasizer Nona (Malvern, UK).

Example 2: Vaccination Experiment with a Combination of mRNA Encoded HA and mRNA Encoded NA For vaccination 5 mice (C57 BL/6) per group were intradermally injected once with a composition comprising mRNA encoding HA of influenza A H1N1 PR8 (R1010) and mRNA encoding NA of influenza A H1N1 PR8 (R997) compared to compositions only comprising the single antigen-encoding mRNAs. As negative control buffer was injected. Detection of an antigen-specific immune response (B-cell immune response) was carried out by detecting influenza A H1N1 PR8 specific IgG1 and IgG2a antibodies. Therefore, blood samples were taken from the vaccinated mice four weeks after vaccination and sera were prepared. MaxiSorb plates (Nalgene Nunc International) were coated with the inactivated PR8 virus. After blocking with 1×PBS containing 0.05% Tween-20 and 1% BSA the plates were incubated with diluted mouse serum (as indicated). Subsequently a biotin-coupled secondary antibody (anti-mouse-Igl1 and IgG2a, Pharmingen) was added. After washing, the plate was incubated with horseradish peroxidase-streptavidin and subsequently the conversion of the ABTS substrate (2,2'-azino-bis(3-ethyl-benzothiazoline-6-sulfonic acid) was measured. The result of the experiment is shown in FIGS. 5A and 5B.

Results:

The data shows that IgG1 and IgG2a antibodies could be detected after vaccination with the mRNA comprising vaccines. As expected the vaccination with mRNA encoded NA antigen did not result in the generation of antibodies against the HA antigen. But vaccination with mRNA encoded HA antigen did induce the generation of HA-specific antibodies even after only one vaccination. Surprisingly, the combination of mRNA encoding HA and mRNA encoding NA improved the generation of antibodies directed against HA.

Overall, the results shown in FIG. 5 demonstrate that the inventive mRNA vaccine induces antigen specific B-cell responses against influenza antigens in vivo. Furthermore it could be surprisingly shown that the combination of HA encoding mRNA and NA encoding mRNA increased the generation of HA-directed antibodies.

It has to be noted that the observed synergistic effect of NA on the generation of HA specific antibodies may be exploited for the development of analogous mRNA combinations of NA and HA antigens as specified in the underlying invention or e.g. as outlined in Example 15.

Example 3: Vaccination Experiment with a Combination of mRNAs Encoding HA of Different Influenza Viruses For vaccination 5 mice (C57 BL/6) per group were intradermally injected twice with a composition comprising mRNA encoding HA of influenza A H1N1pdm09 HA A/California/7/2009 (R1594), mRNA encoding HA of influenza A H3N2 HA A/Uruguay/716/2007 R1427), and mRNA encoding HA of influenza A H1N1 HA A/Brisbane/59/2007 (R1425) compared to compositions only comprising the single antigen-encoding mRNAs. As negative control buffer was injected. Detection of an antigen-specific immune response (B-cell immune response) was carried out by detecting total IgG antibodies directed against the particular influenza virus. Therefore, blood samples were taken from the vaccinated mice four weeks after vaccination and sera were prepared. MaxiSorb plates (Nalgene Nunc International) were coated with the particular inactivated influenza virus. After blocking with 1×PBS containing 0.05% Tween-20 and 1% BSA the plates were incubated with diluted mouse serum (as indicated). Subsequently a biotin-coupled secondary antibody (anti-mouse-IgG, Pharmingen) was added. After washing, the plate was incubated with horseradish peroxidase-streptavidin and subsequently the conversion of the ABTS substrate (2,2'-azino-bis(3-ethyl-benzothiazoline-6-sulfonic acid) was measured. The result of the experiment is shown in FIGS. 6A, B and C.

Results:

The results shown in FIG. 6 demonstrate that IgG antibodies directed against the different influenza viruses could be detected after vaccination with the vaccines only comprising an mRNA encoding the HA of the respective influenza virus but also after vaccination with a vaccine comprising the three mRNAs each encoding an HA antigen of a different influenza virus. These data proof that mRNA encoded antigens e.g. of different influenza viruses can be combined in one composition/vaccine without losing efficiency compared to compositions/vaccines only comprising the single mRNA-based antigen.

Example 4: Vaccination Experiment with a Combination of mRNAs Encoding HA and NA of Different Influenza Viruses For vaccination 8 mice per group are intramuscularly injected with a composition comprising mRNA sequences encoding HA of 4 different influenza virus strains: A/California/7/2009 (H1N1) and/or A/Netherlands/602/2009 (H1N1), A/Hong Kong/4801/2014 (H3N2), B/Brisbane/60/2008 and A/Vietnam/1203/2004 (H5N1) and NA of 3 different influenza virus strains: A/California/7/2009 (H1N1), A/Hong Kong/4801/2014 (H3N2), and B/Brisbane/60/2008 (sequences according to Example 1).

In another vaccination experiment, 8 mice per group are intramuscularly injected with a composition comprising mRNA sequences encoding HA of A/California/7/2009 (H1N1) and/or A/Netherlands/02/2009 (H1N1), A/Hong Kong/4801/2014 (H3N2). B/Brisbane/60/2008 and B/Phuket/3073/2013 and NA of 3 different influenza virus strains: A/California/7/2009 (H1N1), A/Hong Kong/4801/2014 (H3N2), and B/Brisbane/BD/2008 (sequences according to Example 1).

As control, Influvac® Tetravalent 2016-2017 is injected, a split virus vaccine comprising 4 different inactivated influenza virus strains (A/California/7/2009, A/Hong Kong/4801/2014, B/Phuket/3073/2013, and B/Brisbane/60/2008) indicated for active immunization for the prevention of disease caused by influenza A subtype viruses and type B viruses. As negative control Ringer lactate buffer is injected.

Detection of an HA-specific immune response (B-cell immune response) is carried out by detecting IgG2a antibodies directed against the particular influenza virus as described above.

NA-specific immune responses (B-cell immune response) directed against the particular influenza virus are determined using NA inhibition assay (NA).

Example 5: Vaccination Experiment with a mRNAs Encoding HA of Influenza B Virus For vaccination 8 mice per group were intradermally injected (i.d.) with a composition comprising mRNA encoding Influenza B (B/Brisbane/60/2008) (sequences according to Example 1). As a control, mice were injected with buffer.

Detection of an HA-specific immune response (B-cell immune response) was carried out by detecting IgG1 and IgG2a antibodies directed against the particular influenza virus using ELISA as described above. Results are shown in FIG. 7.

Results:

The data shows that IgG1 and IgG2a antibodies could be detected after vaccination with the mRNA comprising vaccines, showing that the Influenza B antigens are translated into protein and trigger a humoral immune response in mice.

Example 6: Vaccination Experiment with a Combination of mRNAs Encoding HA of Different Influenza Viruses Female BALB/c mice were immunized intradermally (i.d.) or intramuscularly (i.m.) with mRNA vaccine compositions with doses, application routes and vaccination schedules as indicated in Table 4 (mRNA sequences according to Example 1). As a negative control, one group of mice was injected with buffer (ringer lactate, RiIa). All animals were vaccinated an day 0 and day 21. Blood samples were collected on day 21, 35, and 49 for the determination of binding antibody titers (using ELISA), blocking antibody titers (using a HI assay). Detailed descriptions of the performed experiments are provided below. mRNA Sequences according to Example 1.

Results:

The data shows that IgG1 and IgG2a antibodies could be detected after vaccination with the mRNA combination vaccines. Notably, for all mRNA encoded antigens comprised in the respective combination, specific IgG1 and IgG2a antibodies could be detected, irrespective of the used formulation (protamine, non-complexed) or application route (i.d., i.m.) demonstrating that all mRNAs comprised in the respective compositions are translated into protein and trigger a humoral immune response in mice (FIG. 8 (H1N1 (A/California/7/2009)), FIG. 10 (H3N2 (A/HongKong/4801/2014)). FIG. 11 (Influenza B (B/Brisbane/60/2008)) and FIG. 12 (Influenza B (B/Phuket/3073/2013)). Functional neutralizing antibodies were demonstrated for H1N1 (A/California/7/2009) (see FIG. 9)

Overall, the data demonstrates that mRNA based combination vaccines for HA antigens derived from different influenza viruses (A types and B types) induce strong and durable humoral immune responses. The data suggests that analogous mRNA combinations encoding combinations of different other Influenza antigens as specified in the underlying invention may also induce immune responses in a similar manner.

TABLE 4

Immunization regimen (Example 6)

| Setup | No. of mice | mRNA composition | Formulation | Amount | Treatment |
|---|---|---|---|---|---|
| A | 6 | Rile buffer | — | — | i.m., 2 × 25 µl |
| B | 9 | H1N1 A/Netherlands/602/2009<br>H3N2 A/Hong Kong/4801/2014<br>HA B/Brisbane/60/2008<br>HA B/Phuket/3073/2013 | Protamine | 80 µg total<br>(20 µg each) | i.d., 2 × 50 µl |
| C | 9 | H1N1 A/California/07/2009<br>H3N2 A/Hong Kong/4801/2014<br>HA B/Brisbane/60/2008<br>HA B/Phuket/3073/2013 | Protamine | 80 µg total<br>(20 µg each) | i.d., 2 × 50 µl |
| D | 9 | H1N1 A/California/07/2009<br>H3N2 A/Hong Kong/4801/2014<br>HA B/Brishane/60/2008<br>HA B/Phuket/3073/2013 | non-complexed<br>mRNA | 80 µg total<br>(20 µg each) | i.m., 2 × 25 µl |

6.1. Determination of Anti HA Protein Specific IgG1 and IgG2a Antibodies by ELISA ELISA assay was performed essentially as commonly known in the art, or as described above. ELISA was performed for each antigen comprised in the mRNA vaccine composition (as indicated in Table 4). Results are shown in FIG. 8 (H1N1 (A/California/7/2009)). FIG. 10 (H3N2 (A/HongKong/4801/2014)), FIG. 11 (Influenza B (B/Brisbane/60/2008)) and FIG. 12 (Influenza B (B/Phuket/3073/2013)).

6.2. Hemagglutination Inhibition Assay (HI)

In a B6-well plate, the obtained sera were mixed with HA H1N1 antigen (A/California/07/2009 (H1N1): NIBSC) and red blood cells (4% erythrocytes: Lohmann Tierzucht). In the presence of HA neutralizing antibodies, an inhibition of hemagglutination of erythrocytes can be observed. The lowest level of titered serum that resulted in a visible inhibition of hemagglutination was the assay result. The results are shown in FIG. 9.

Example 7: Vaccination Experiment with a Combination of mRNAs Encoding HA of Different Influenza Viruses and Detection of T-Cell Responses Female BALB/c mice were immunized intradermally (i.d.) with mRNA vaccine compositions with doses, application routes and vaccination schedules as indicated in Table 5 (mRNA Sequences according to Example 1). As a negative control, one group of mice was injected with buffer (ringer lactate, Rile). As positive control, one group of mice was injected i.m. with a combination of recombinant protein and Alum as adjuvant. All animals were vaccinated on day 0 and day 21. Blood samples were collected on day 21, 35, and 48 for determination of specific T call responses. T cell responses were analyzed by intracellular cytokine staining (ICS) using splenocytes isolated on day 49.

TABLE 5

| Immunization regimen (Example 7) | | | | | |
|---|---|---|---|---|---|
| Setup | No. of mice | mRNA composition | Formulation | Amount | Treatment |
| A | 6 | Rila buffer | — | — | i.m., 2 × 25 µl |
| B | 6 | Recombinant protein<br>H1N1 (A/California/07/2009)<br>H3N2 (A/Hong Kong/4801/2014)<br>HA (B/Brisbane/60/2008)<br>HA (B/Phuket/3073/2013) | Alum adjuvant | 6 µg total (1.5 µg each) | i. m., 2 × 25 µl |
| C | 9 | H1N1 A/Netherlands/602/2009<br>H3N2 A/Hong Kong/4801/2014<br>HA B/Brisbane/60/2008<br>HA B/Phuket/3073/2013 | Protamine | 80 µg total (20 µg each) | i.d., 2 × 50 µl |
| D | 9 | H1N1 A/California/07/2009<br>H3N2 A/Hong Kong/4801/2014<br>HA B/Brisbane/60/2008<br>HA B/Phuket/3073/2013 | Protamine | 80 µg total (20 µg each) | i.d., 2 × 50 µl |

Splenocytes from vaccinated mice were isolated according to a standard protocol known in the art. Briefly, isolated spleens were grinded through a cell strainer and washed in PBS/I % FBS followed by red blood cell lysis. After an extensive washing step with PBS/1% FBS splenocytes were seeded into 96-well plates ($2\times10^6$ cells per well). The cells were stimulated with a pool of overlapping 15mer peptides of H1N1 (A/California/07/2009) for determining CD8+ T-cell responses or they were stimulated with recombinant HA protein for determining CD4+ T-cell responses. After stimulation, cells were washed and stained for intracellular cytokines using the Cytofix/Cytoperm reagent (80 Biosciences) according to the manufacturer's instructions. The following antibodies were used for staining: CD3-FITC (1:100), CD8-PE-Cy7 (1:200), TNF-PE (1:100), IFNγ-APC (1:100) (eBioscience), CD4-BD Horizon V450 (1:200) (80 Biosciences) and incubated with Fcγ-block diluted 1:100. Aqua Dye was used to distinguish live/dead cells (Invitrogen). Cells were acquired using a Canto II flow cytometer (Beckton Dickinson). Flow cytometry data was analyzed using FlowJo software package (Tree Star, Inc.). Results for CD4+ T-cells are shown in FIG. 13; the results for CD8+ T-cells are shown in FIG. 14.

Results:

Overall, the data demonstrates that mRNA based combination vaccines for HA antigens derived from different influenza viruses (A types and B types) induce T-cell mediated cellular immune responses. The data suggests that analogous mRNA combinations encoding combinations of different other Influenza antigens as specified in the underlying invention may also induce cellular immune responses in a similar manner.

Example 8: Vaccination Experiment with a Combination of mRNAs Encoding HA of Different Influenza Viruses Female BALB/c mice were immunized intradermally (i.d.) or intramuscularly (i.m.) with mRNA vaccine compositions with doses, application routes and vaccination schedules as indicated in Table 8 (mRNA Sequences according to Example 1). As a negative control, one group of mice was injected with buffer (ringer lactate, Rila). All animals were vaccinated on day 0 and day 21. Blood samples were collected on day 21, 35, and 49 for the determination of binding antibody titers (using ELISA), blocking antibody titers (using a H1 assay) and the determination of virus neutralizing titers (VNTs). Detailed descriptions of the performed experiments are provided below.

TABLE 6

| Immunization regimen (Example 8) | | | | | |
|---|---|---|---|---|---|
| Setup | No. of mice | mRNA composition | Formulation | Amount | Treatment |
| A | 6 | Rila buffer | — | — | i.m., 2 × 25 µl |
| B | 9 | H1N1 A/Netherlands/802/2009<br>H3N2 A/Hong Kong/4801/2014<br>HA B/Brisbane/60/2008<br>H5N1 A/Vietnam/1203/2004 | Protamine | 20 µg total (5 µg each) | i.d., 2 × 50 µl |
| C | 9 | H1N1 A/Netherlands/602/2009<br>H3N2 A/Hong Kong/4801/2014<br>HA B/Brisbane/60/2008<br>H5N1 A/Vietnam/1203/2004 | non-complexed mRNA | 80 µg total (20 µg each) | i.m., 2 × 25 µl |

Figure 15:
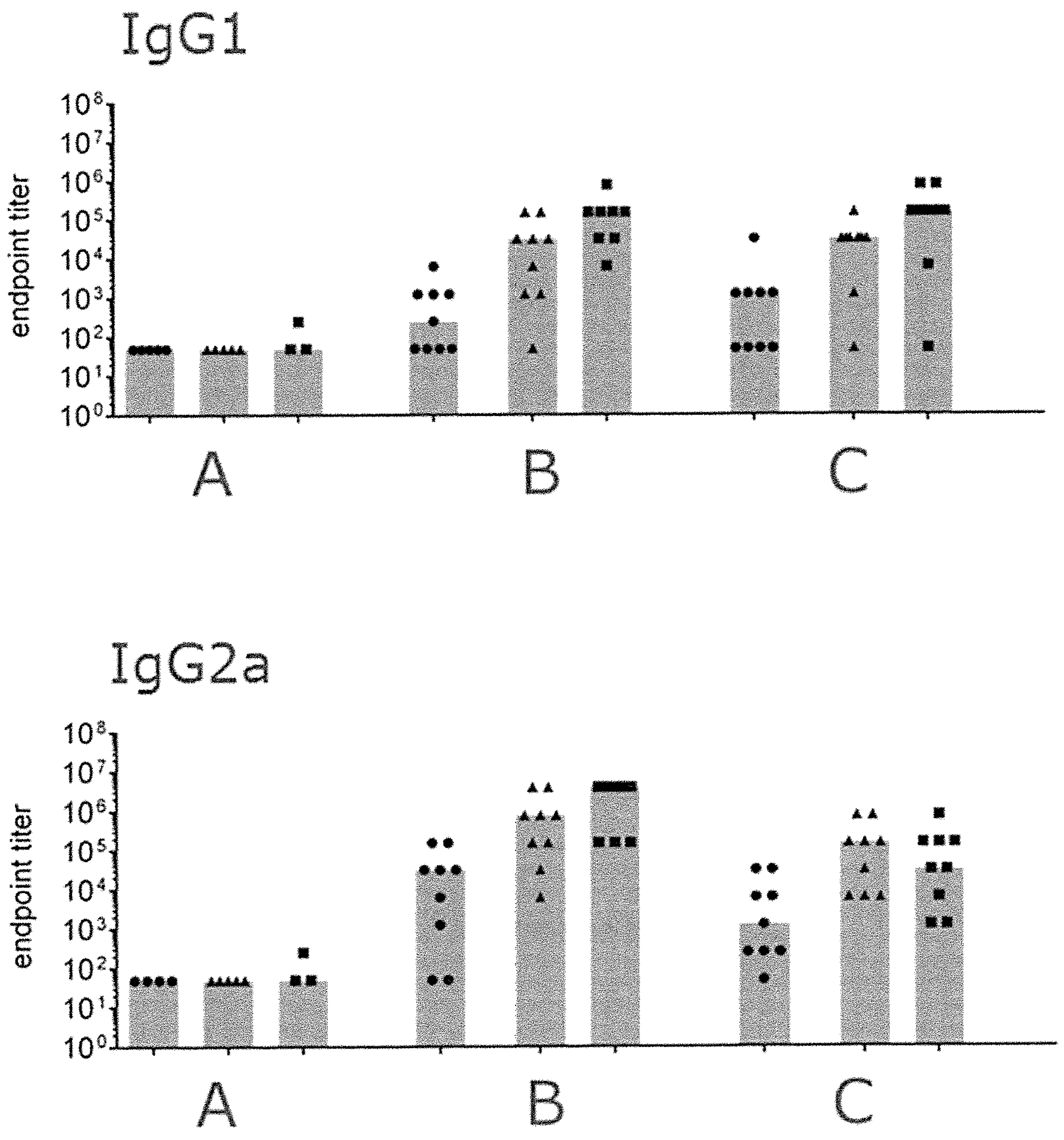
Figure 16:
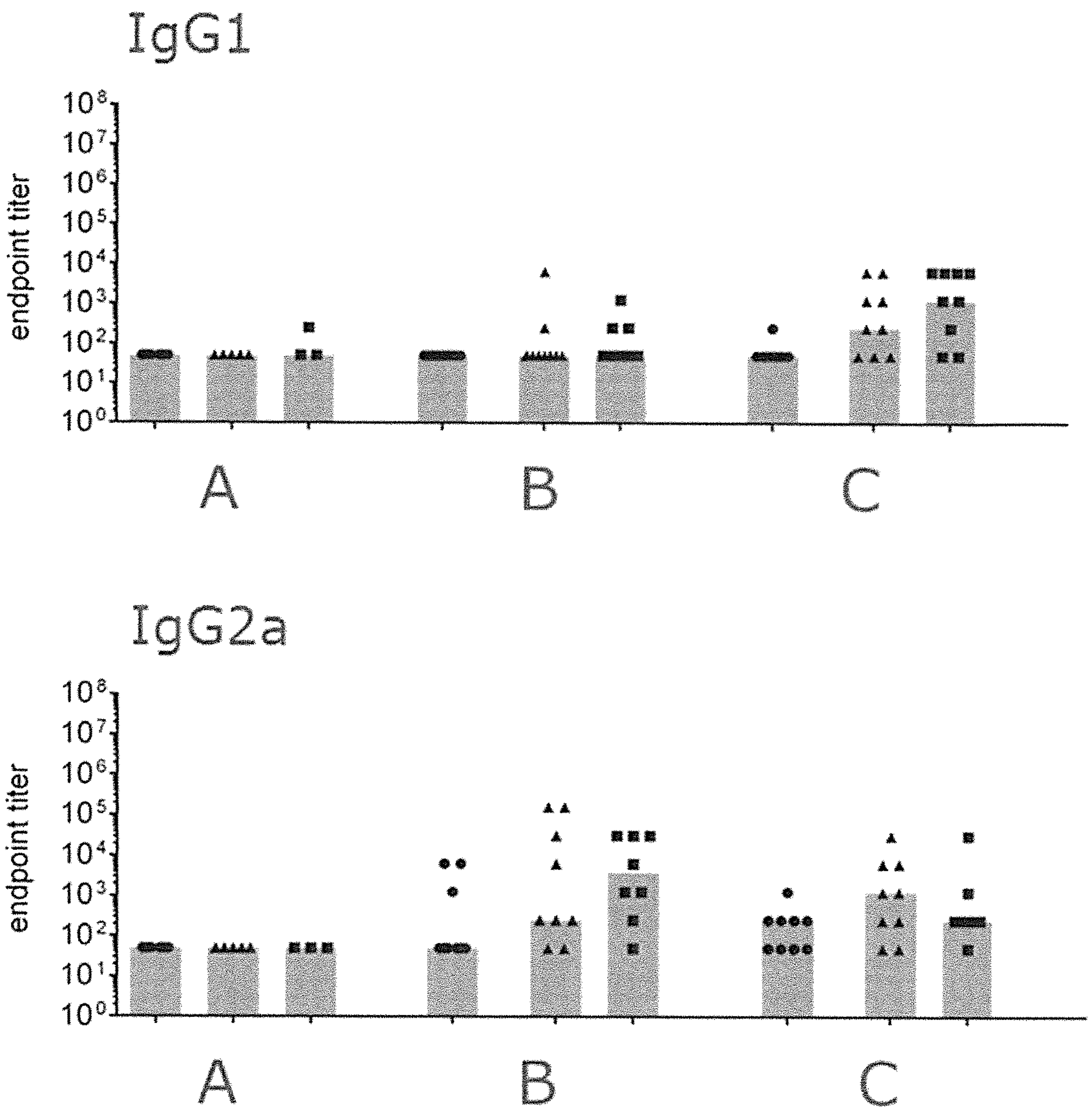
Figure 18:
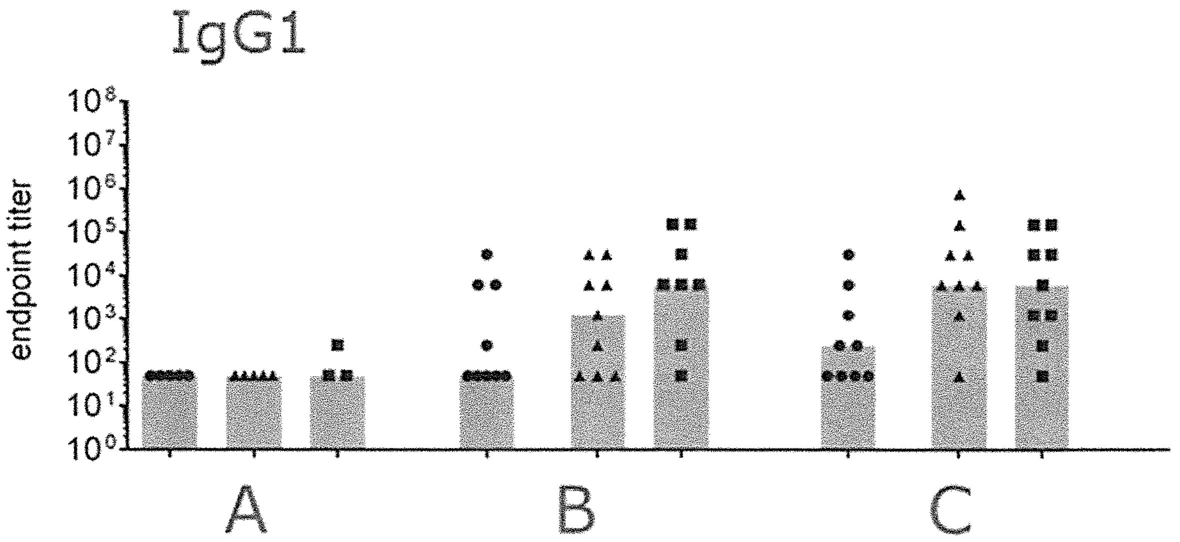
Figure 18:
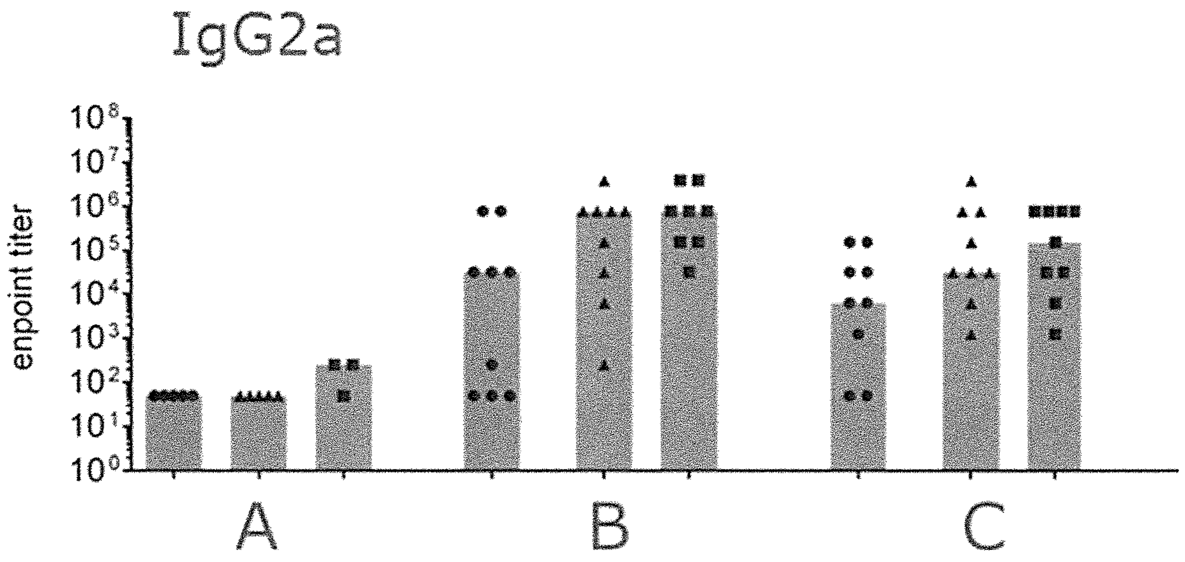
Figure 19:
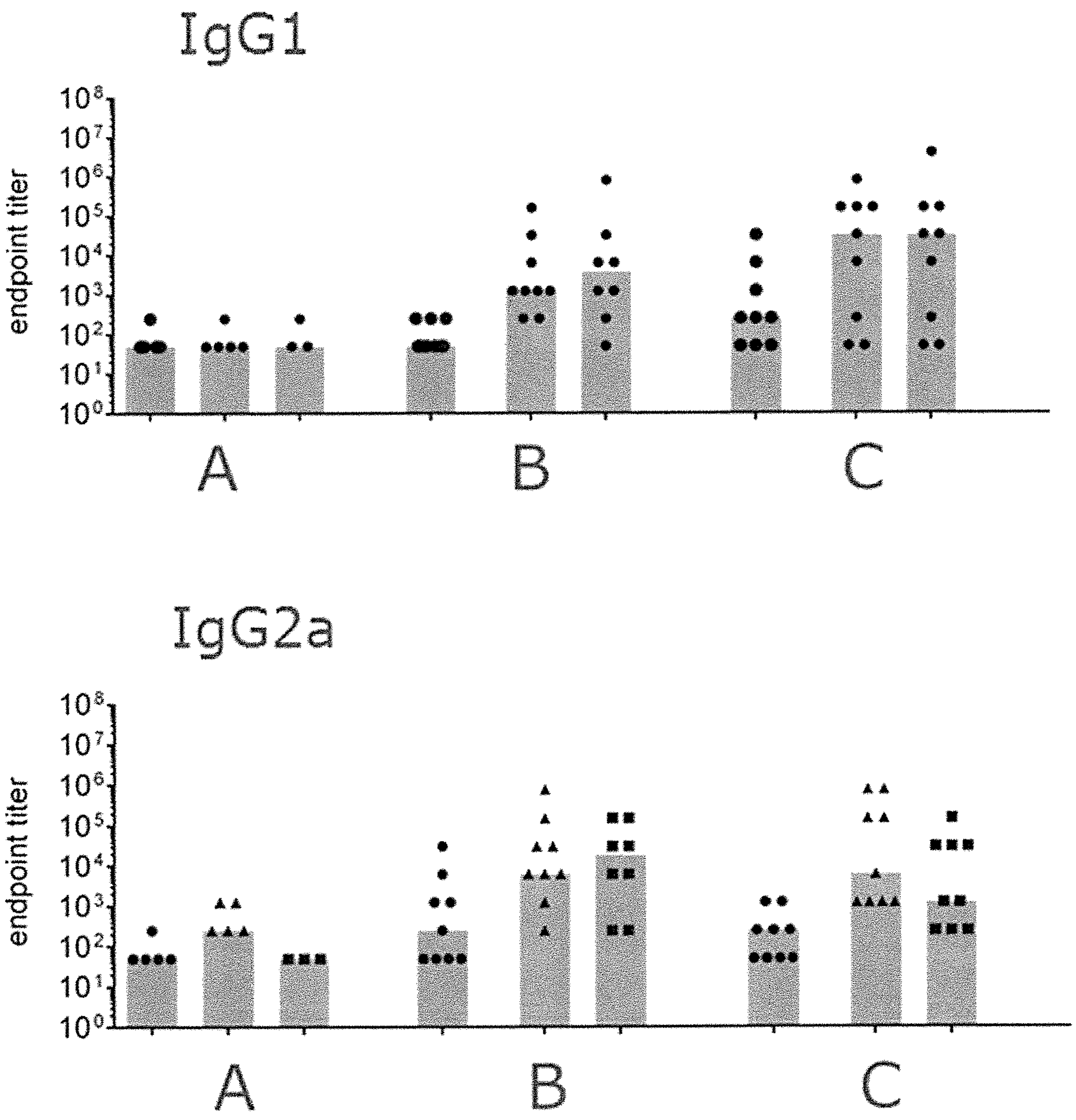

8.1. Determination of Anti HA Protein Specific IgG1 and IgG2a Antibodies by ELISA ELISA assay was performed essentially as commonly known in the art, or as described above. ELISA was performed for each antigen comprised in the mRNA vaccine composition (as indicated in Table 6). Results are shown in FIG. 15 (H1N1 (A/California/7/2009)), FIG. 16 (H3N2 (A/HongKong/4801/2014)), FIG. 18 (Influenza B (B/Brisbane/60/2008)), and FIG. 19 (H5N1 (A/Vietnam/1203/2004).

8.2. Hemagglutination Inhibition Assay (HI) and Virus Neutralizing Assay

Figure 17:
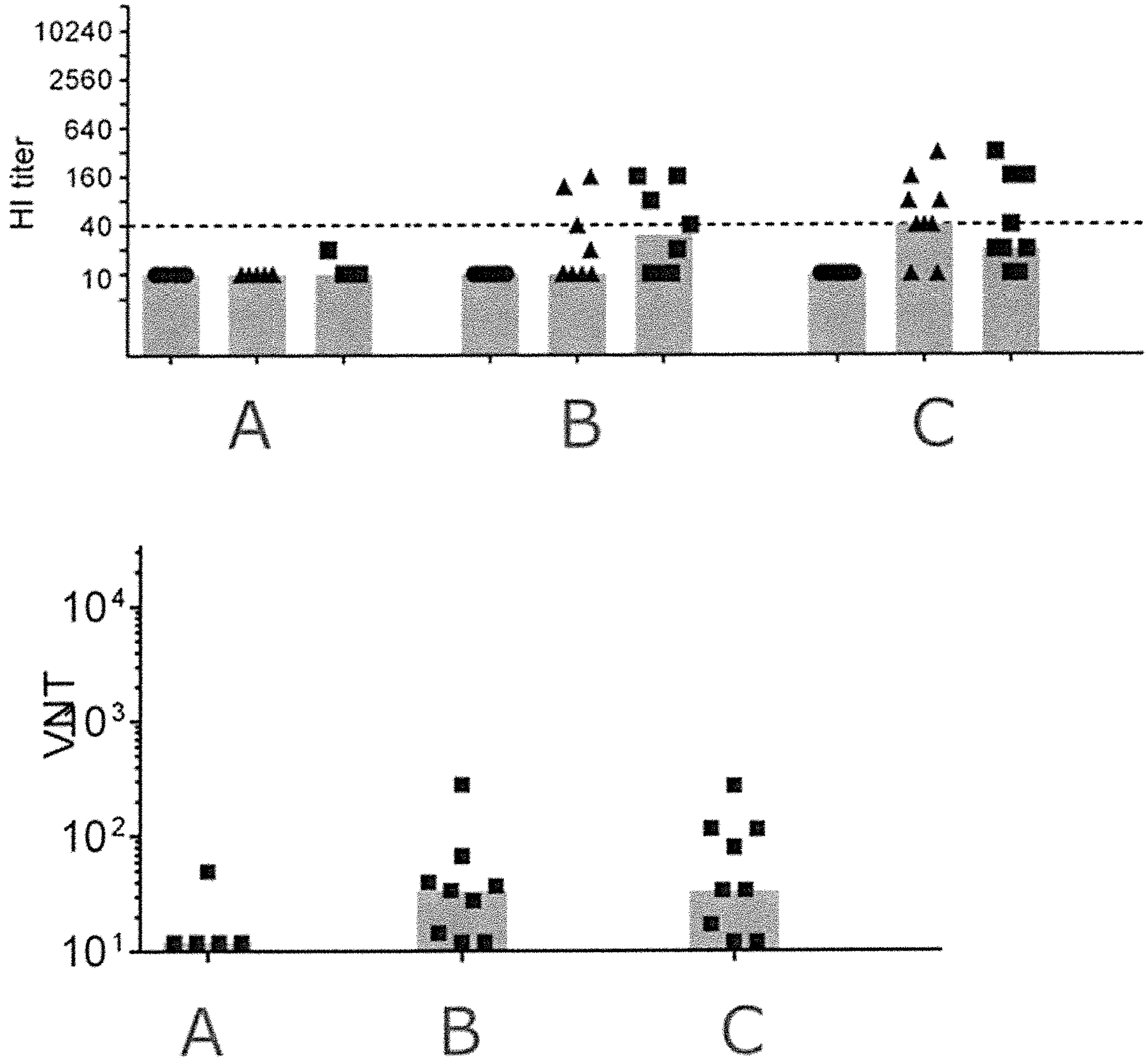

HI-assay was performed as described above. The VNT assay was performed as commonly known in the art. The results are shown in FIG. 17.

Example 9: Vaccination Experiment with a Combination of mRNAs Encoding HA of Different Influenza Viruses and Detection of T-Cell Responses Female BALB/c mice were immunized intradermally (i.d.) or intramuscularly (i.m.) with mRNA vaccine compositions with doses, application routes and vaccination schedules as indicated in Table 7 (mRNA Sequences according to Example 1). As a negative control, one group of mice was injected with buffer (ringer lactate, RiIa). As positive control, one group of mice was injected i.m. with a combination of recombinant protein and Alum as adjuvant. All animals were vaccinated an day 0 and day 21. T cell responses were analyzed by intracellular cytokine staining (ICS) using splenocytes isolated on day 49.

TABLE 7

Immunization regimen (Example 9)

| Setup | No. of mice | mRNA composition | Formulation | Amount | Treatment |
|---|---|---|---|---|---|
| A | Rila buffer | — | — | — | i.m., 2 × 25 μl |
| B | 6 | Recombinant Protein<br>H1N1 (A/California/07/2009)<br>H3N2 (A/Hong Kong/4801/2014)<br>HA (B/Brisbane/60/2008)<br>H5N1 (A/Vietnam/1203/2004) | — | 6 μg total<br>(1.5 μg each) +<br>Alum | i. m., 2 × 25 μl |
| B | 9 | H1N1 A/Netherlands/602/2009<br>H3N2 A/Hong Kong/4801/20I4<br>HA B/Brisbane/60/20118<br>H5N1 A/Vietnam/1203/2004 | Protamine | 20 μg total<br>(5 μg each) | i.d., 2 × 50 μl |
| C | 9 | H1N1 A/Netherlands/602/2009<br>H3N2 A/Hong Kong/4801/2014<br>HA B/Brisbane/60/2008<br>H5N1 A/Vietnam/1203/2004 | non-complexed<br>mRNA | 80 μg total<br>(20 μg each) | i.m., 2 × 25 μl |

Figure 5:
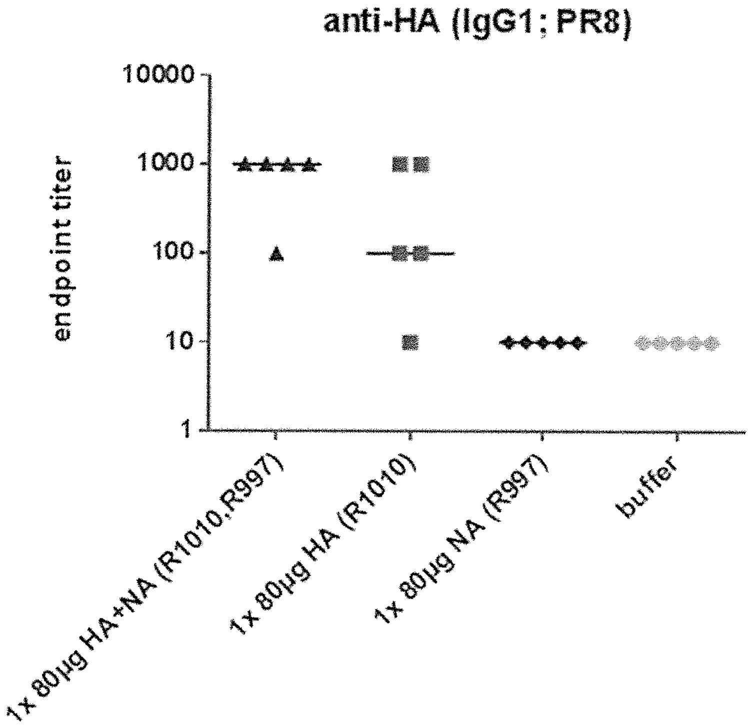
Figure 5:
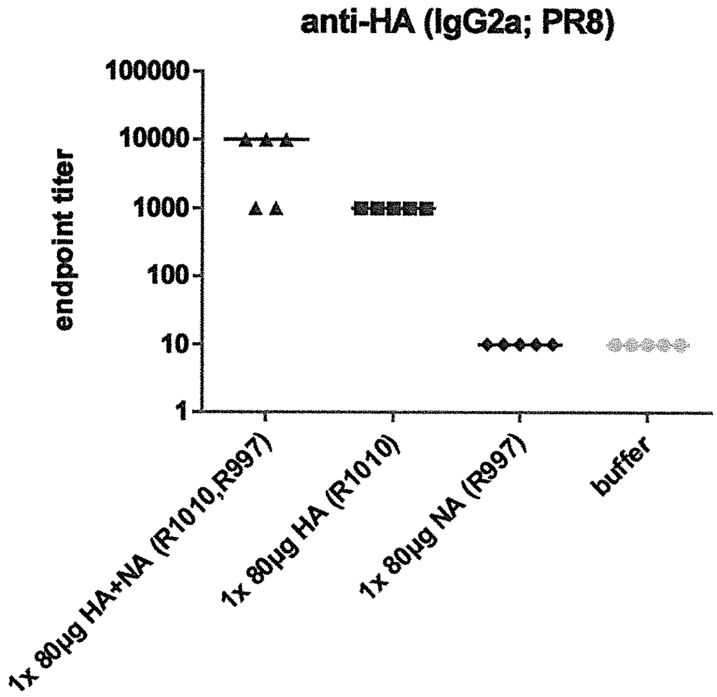
Figure 6:
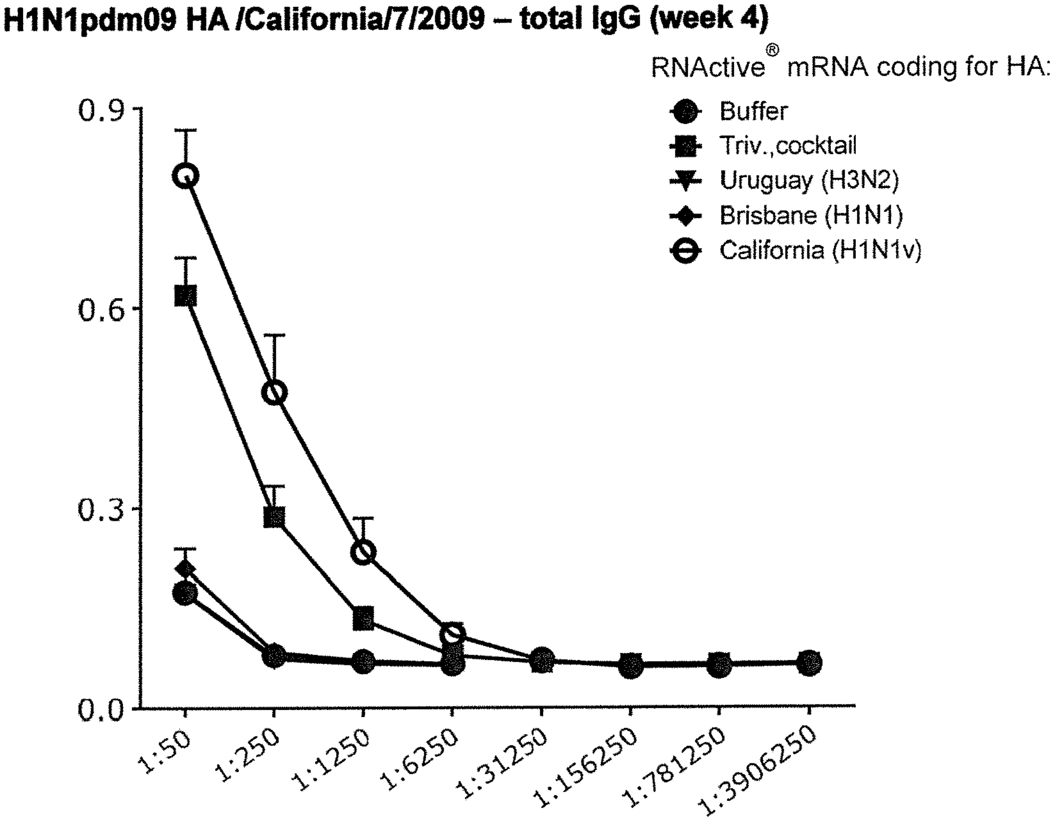
Figure 1:
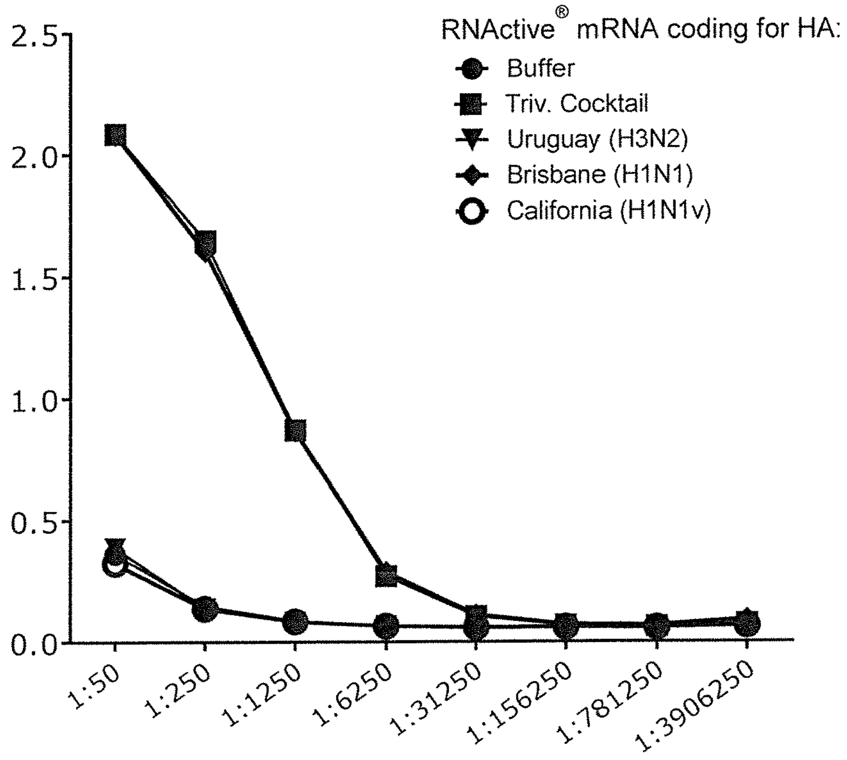
Figures 2, 6:
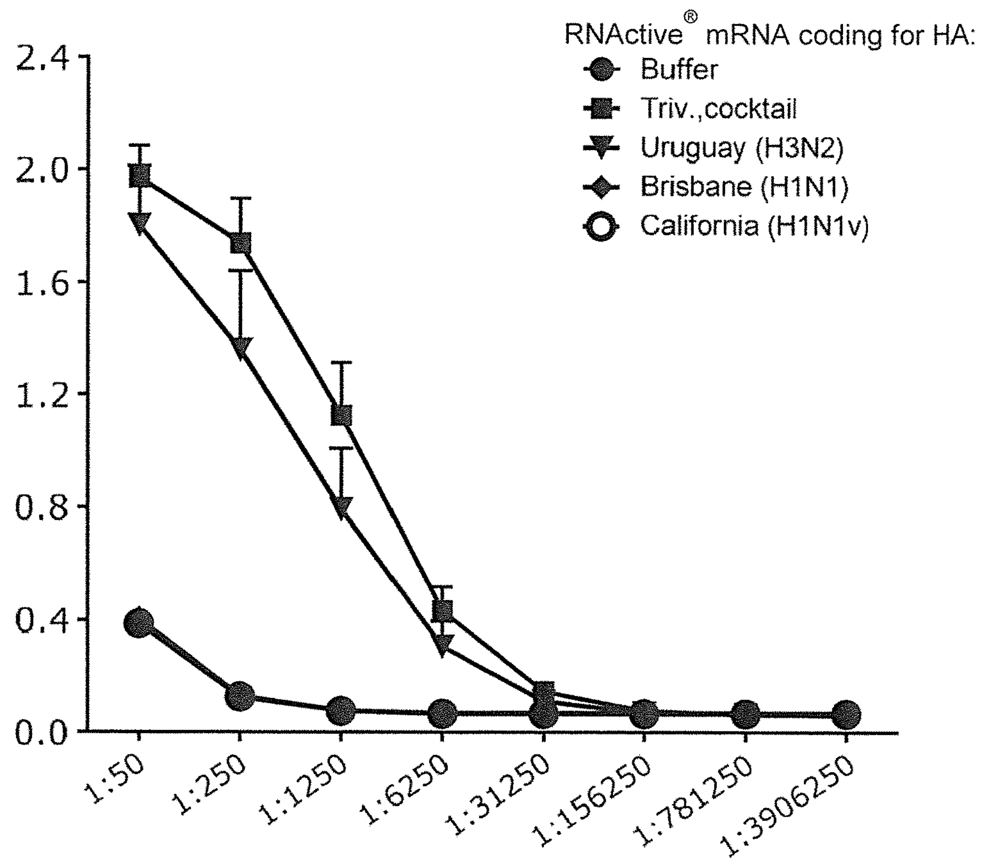
Figure 7:
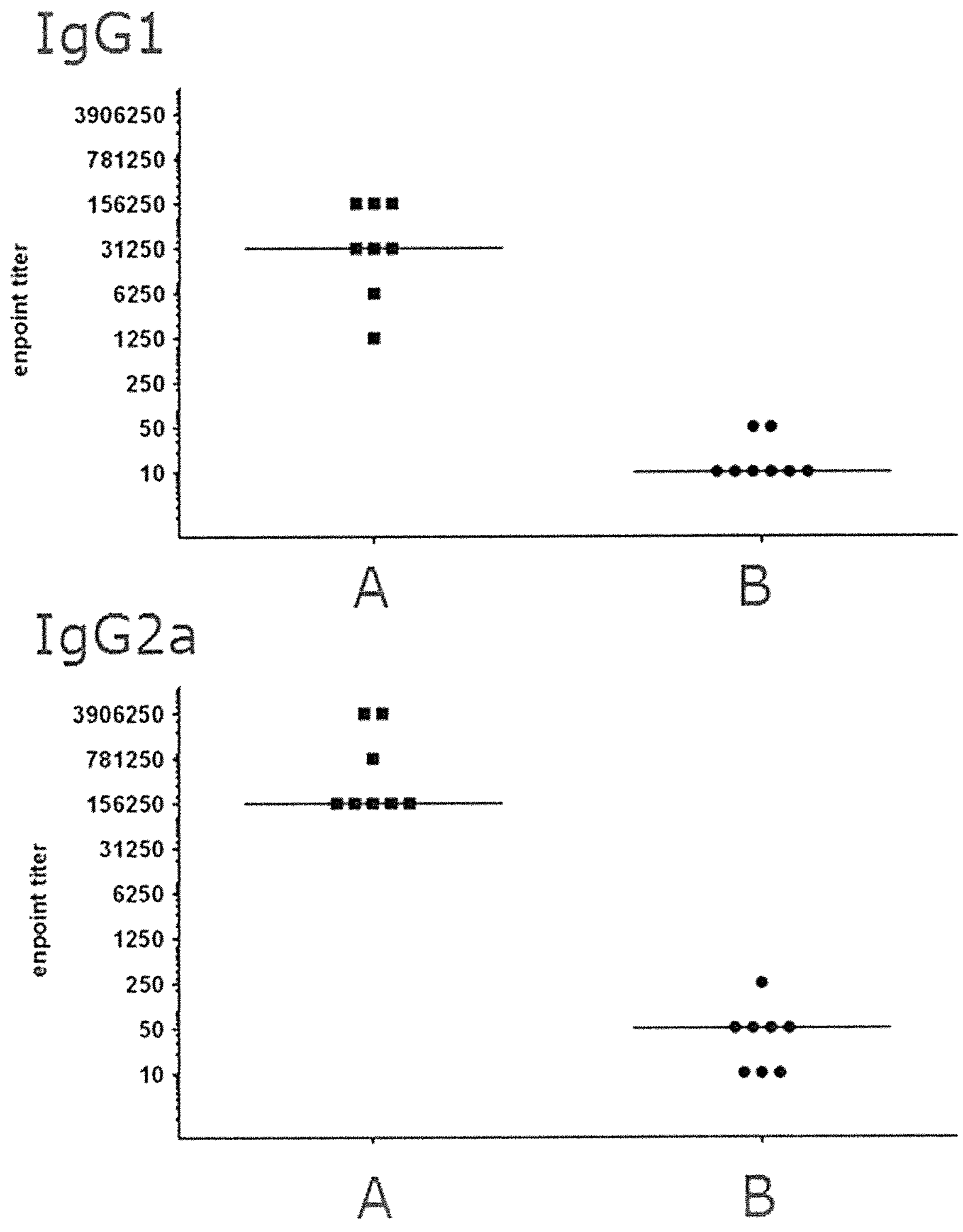
Figure 8:
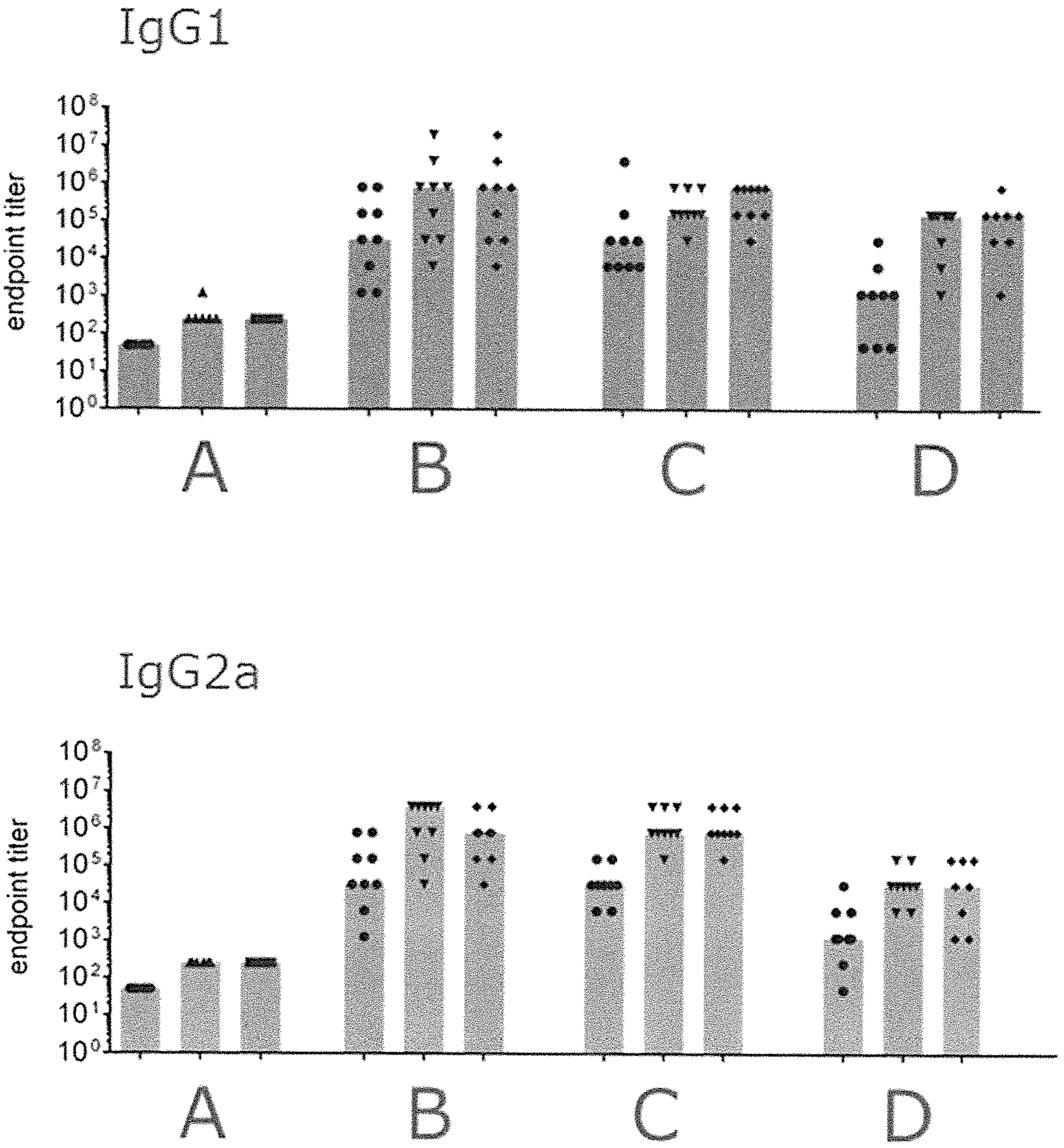
Figure 9:
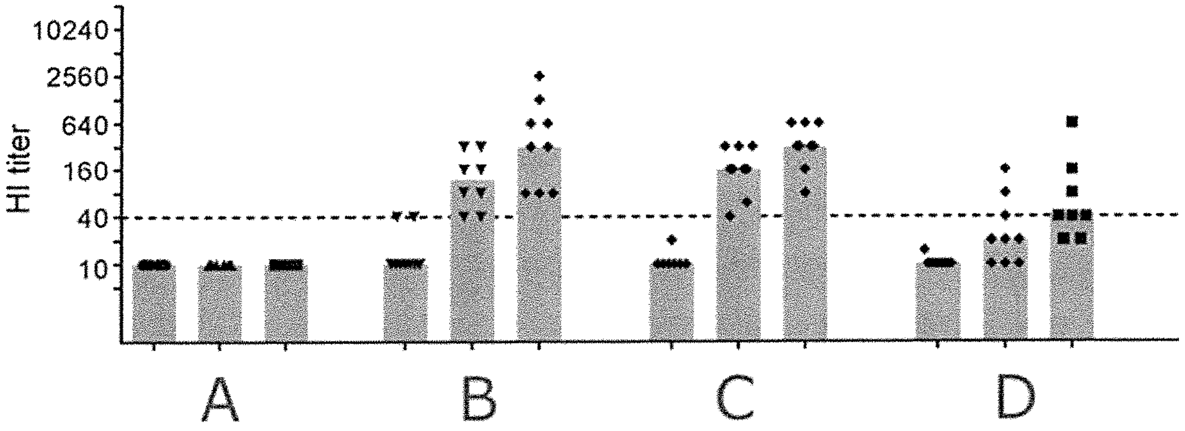
Figure 10:
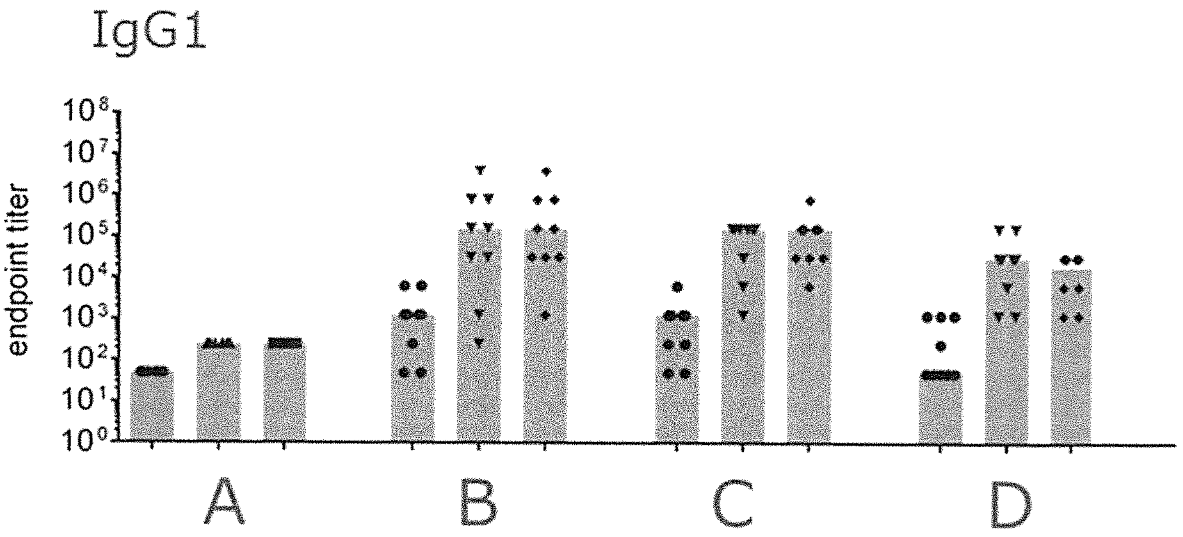
Figure 10:
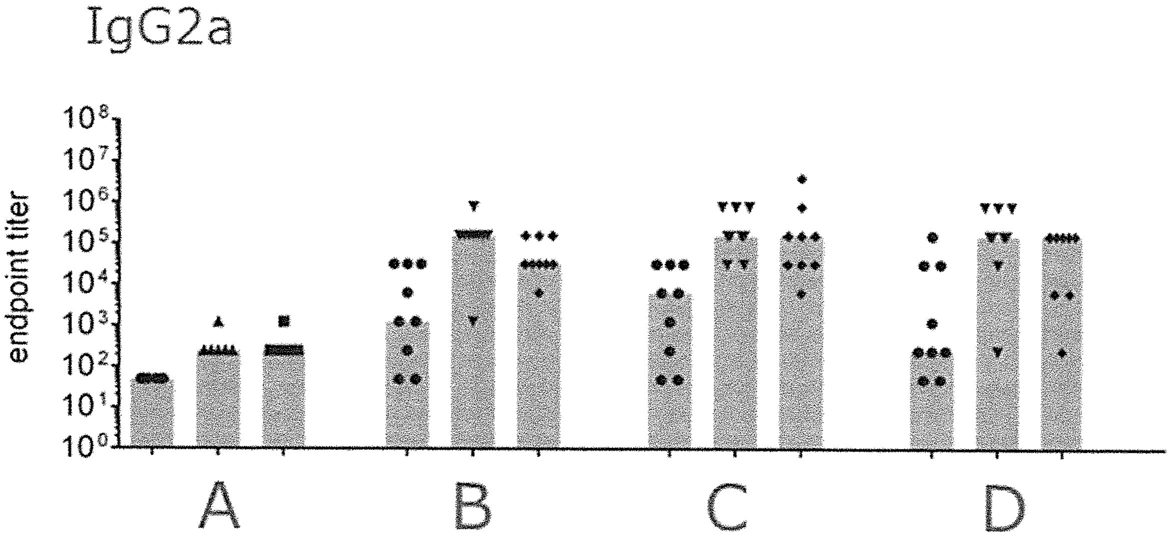
Figure 11:
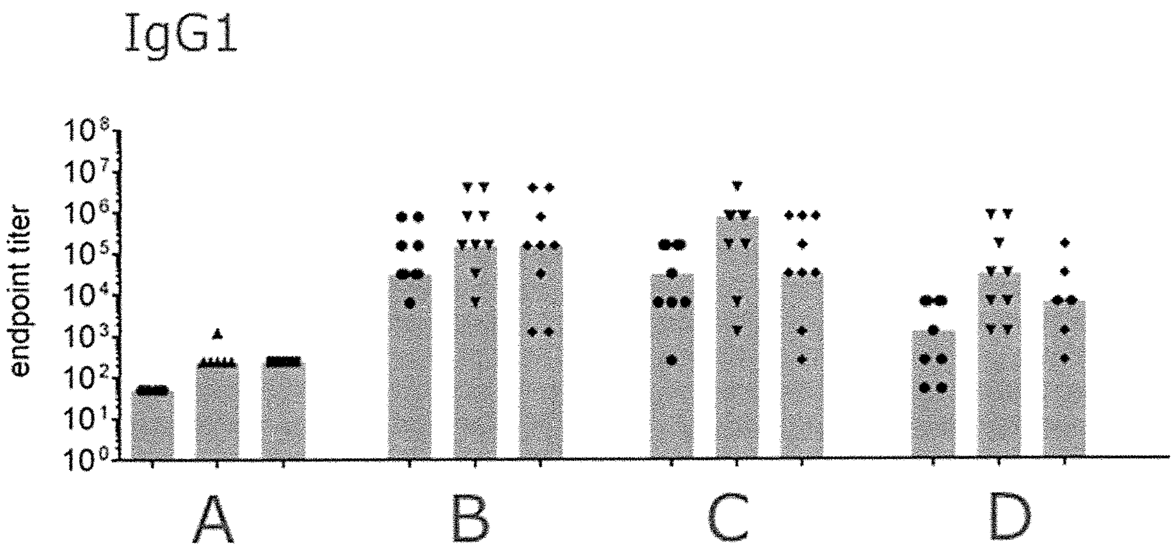
Figure 11:
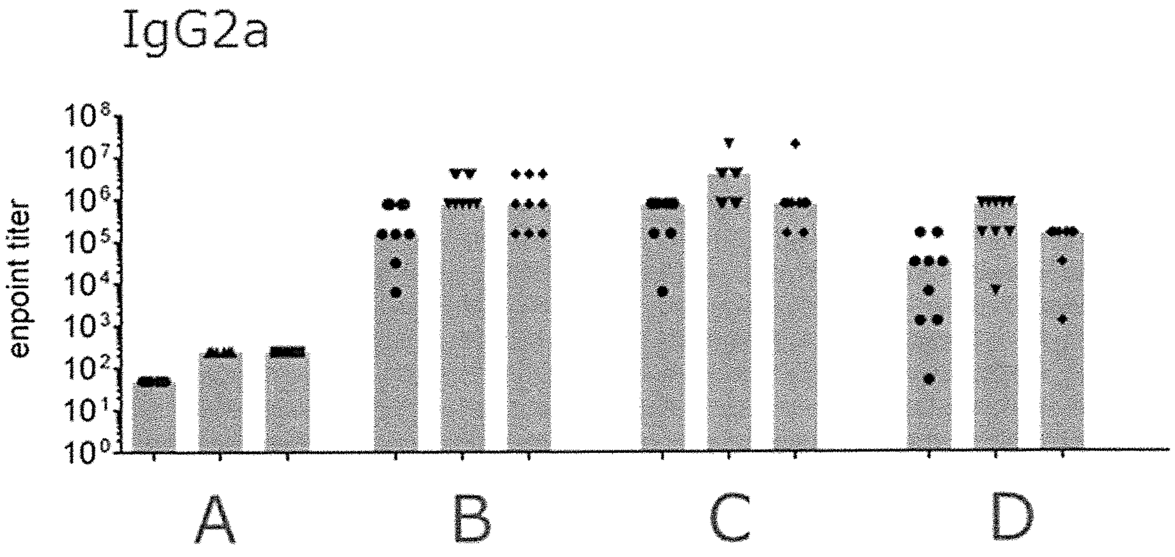
Figure 12:
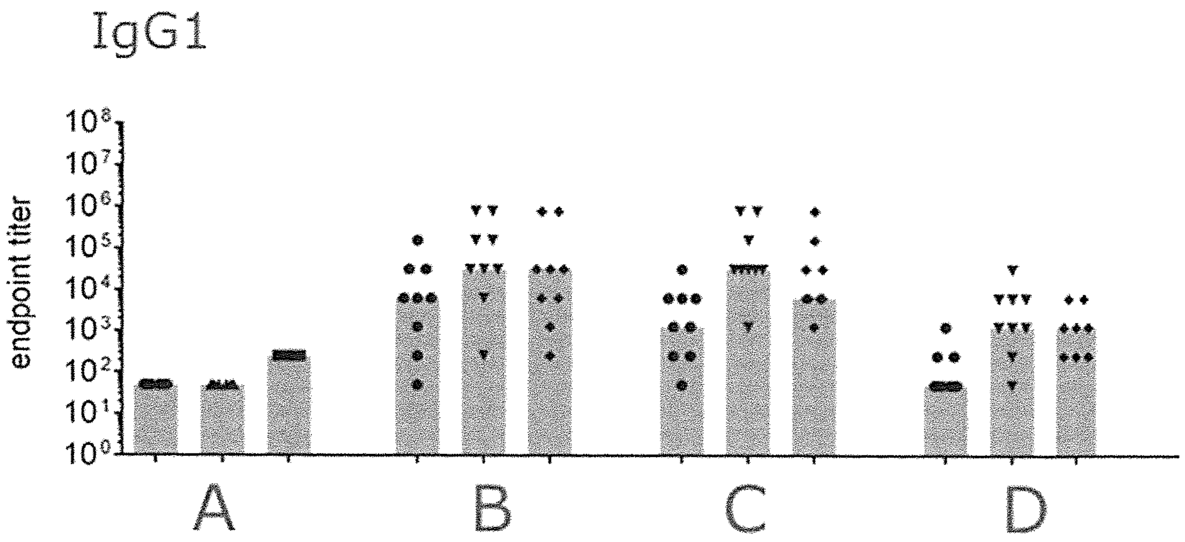
Figure 12:
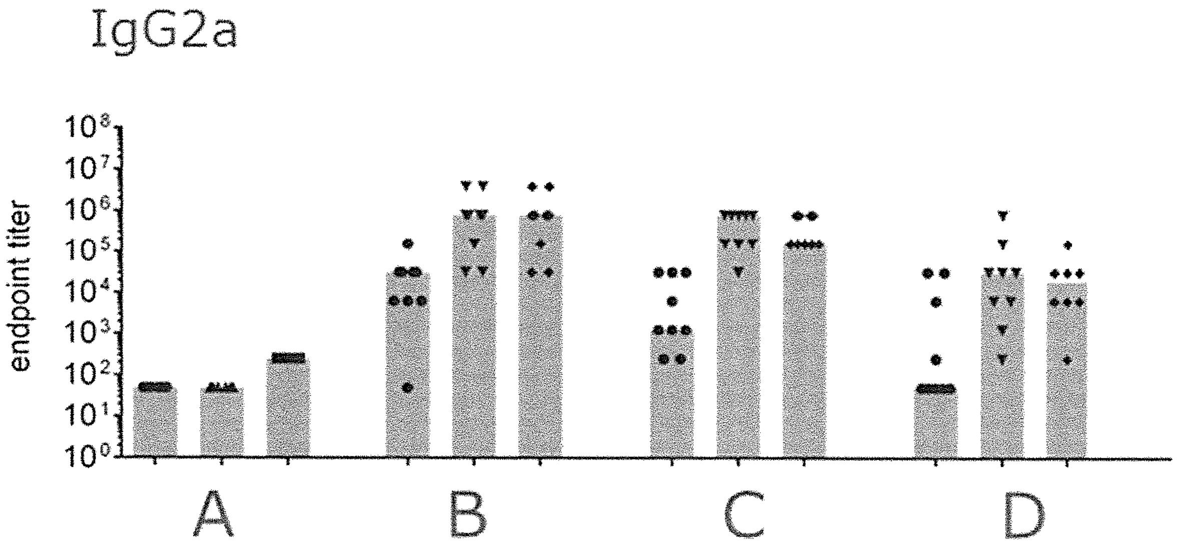
Figure 13:
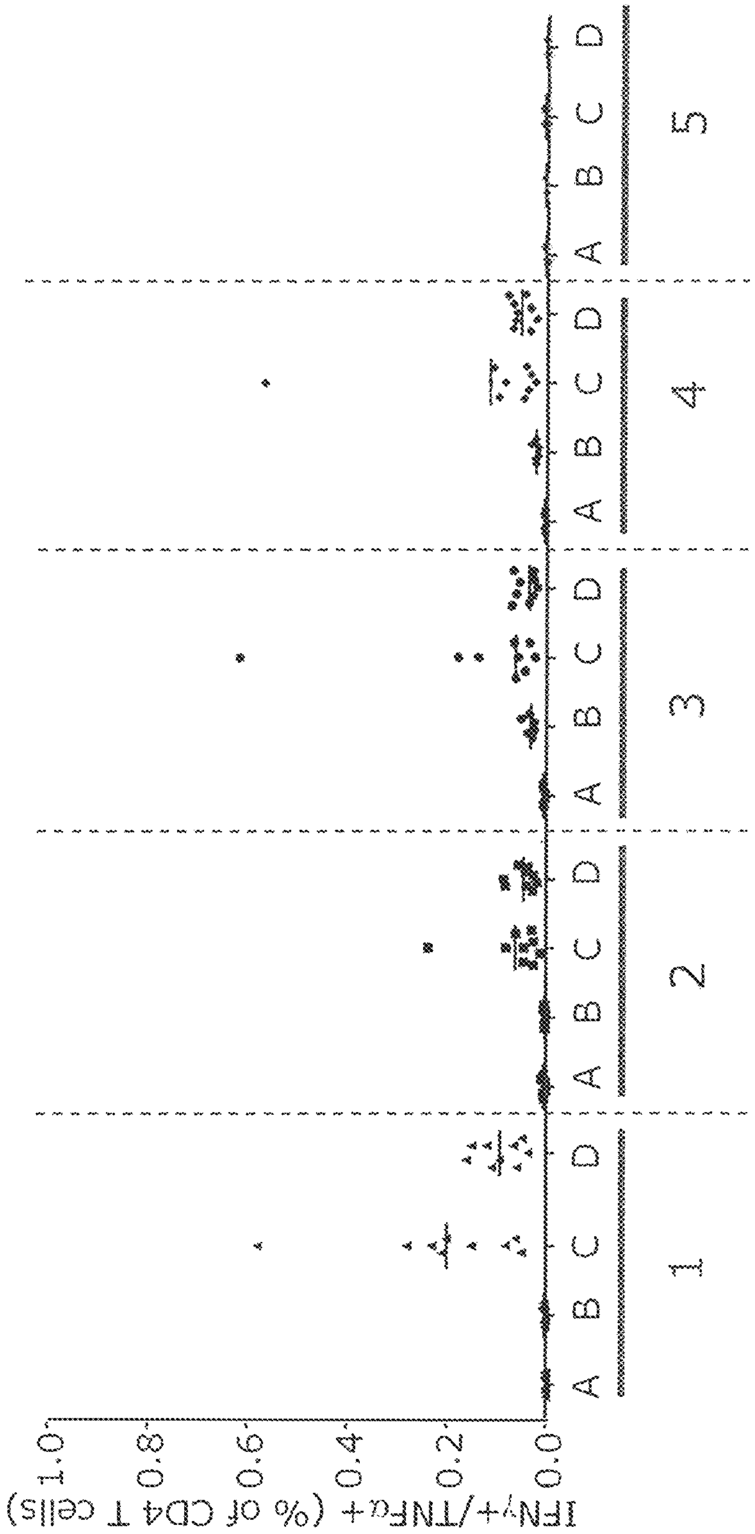
FIG. 13 shows that the tested influenza mRNA combinations stimulated robust CD4+IFNγ/TNF-α T-cell responses in spleen of immunized mice for all antigens, whereas the combination of antigenic protein did not induce T-cell responses.
Figure 14:
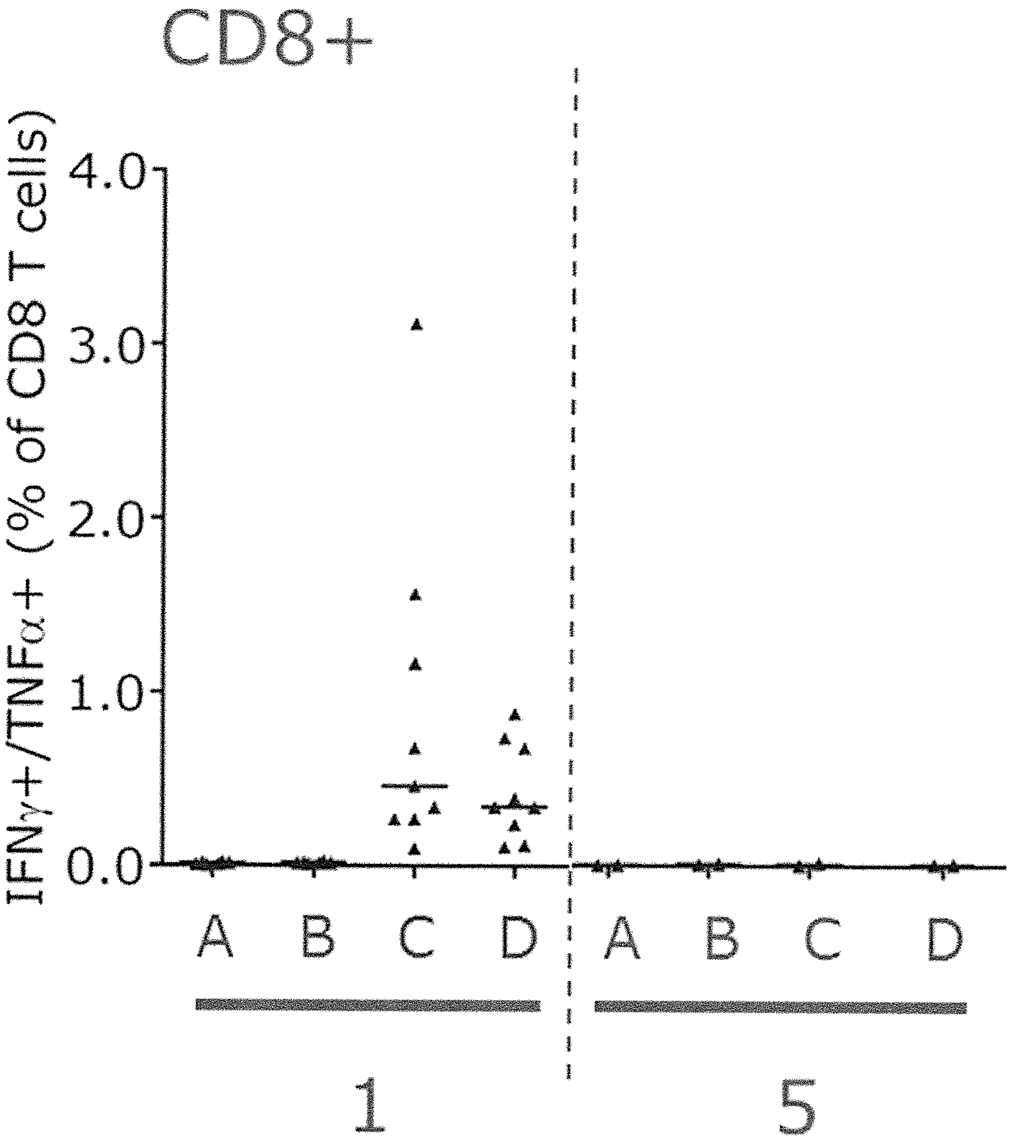
FIG. 14 shows that the tested influenza mRNA combinations stimulated robust CD8+IFN-γ/TNF-α T-cell responses in spleen of immunized mice as shown for H1N1 (A/California/07/2009), whereas the combination of protein antigens did not induce T-cell responses.

Results:

The data shows that IgG1 and IgG2a antibodies could be detected after vaccination with the mRNA combination vaccines. Notably, for all mRNA encoded antigens comprised in the respective combination, specific IgG1 and IgG2a antibodies could be detected, irrespective of the used formulation (protamine, non-complexed) or application route (i.d., i.m.) demonstrating that all mRNAs comprised in the respective compositions are translated into protein and trigger a humoral immune response in mice (FIG. 15 (H1N1 (A/California/7/2009)), FIG. 16 (H3N2 (A/HongKong/4801/2014)), FIG. 18 (Influenza B (B/Brisbane/60/2008)), and FIG. 1B (H5N1 (A/Vietnam/1203/2004))). Functional neutralizing antibodies were shown for H3N2 (A/HongKong/4801/2014) (see FIG. 17).

Overall, the data demonstrates that mRNA based combination vaccines for HA antigens derived from different influenza viruses (A types and B types) induce strong and durable humoral immune responses. The data suggests that analogous mRNA combinations encoding combinations of different other Influenza antigens as specified in the underlying invention may also induce immune responses in a similar manner.

Splenocytes from vaccinated mice were isolated according to a standard protocol known in the art. ICS experiment was performed essentially as described in Example 7. Results for CD4+ T-cells are shown in FIG. 21; the results for CD8+ T-cells are shown in FIG. 20.

Figure 21:
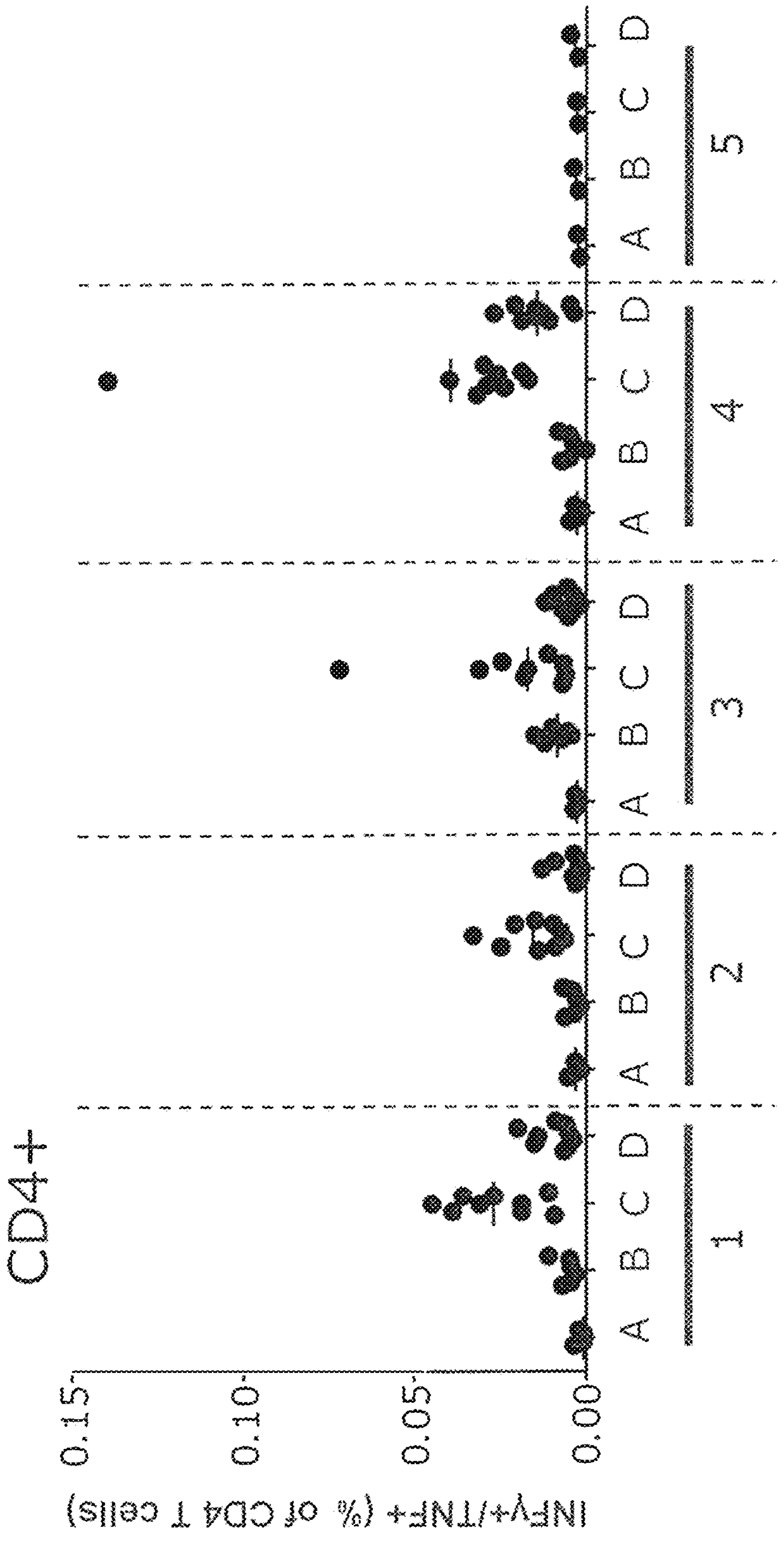

Results:

FIG. 21 shows that the tested influenza mRNA combinations stimulated robust CD4+IFNγ/TNF-α T-cell responses in spleen of immunized mice for all antigens, irrespective of the used formulation (protamine, non-complexed) or application route (i.d., i.m.), whereas the combination of protein antigens did not induce T-cell responses.

Figure 20:
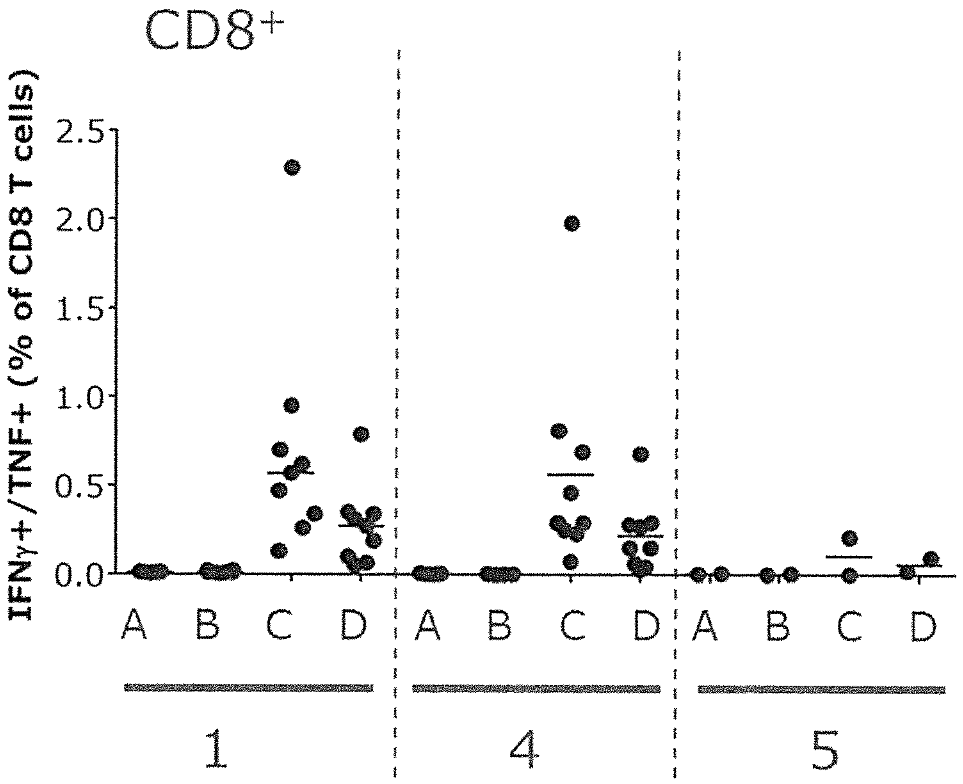

FIG. 20 shows that the tested influenza mRNA combinations stimulated robust CD8+IFN-γ/TNF-α T-cell responses in spleen of immunized mice as shown for H1N1 (A/California/07/2009), irrespective of the used formulation (protamine, non-complexed) or application route (i.d., i.m.), whereas the combination of antigenic protein did not induce T-cell responses.

Overall, the data demonstrates that mRNA based combination vaccines for HA antigens derived from different influenza viruses (A types and B types) induce T-cell mediated cellular immune responses. The data suggests that analogous mRNA combinations encoding combinations of different other Influenza antigens as specified in the underlying invention may also induce cellular immune responses in a similar manner.

Example 10: Expression Analysis of Neuraminidase Antigens Using FACS

To determine in vitro protein expression of the mRNA constructs coding for Influenza Neuraminidase antigens/proteins, Hela cells were transiently transfected with mRNA encoding Neuraminidase antigens, specifically stained, and expression was determined using FACS.

HeLa cells were seeded in a G-well plate at a density of 300,000 cells/well in cell culture medium (RPMI, 10% FCS, 1% L-Glutamine, % Pen/Strep). 24 h prior to transfection. HeLa cells were transfected with 1 µg and 2 µg mRNA ("naked") using Lipofectamine 2000 (Invitrogen).

The following mRNA constructs were used in the experiment (mRNA Sequences according to Example 1):

mRNA encoding NA of influenza A/California/7/2009;

mRNA encoding NA of influenza A/Hong Kong/4801/2014;

mRNA encoding NA of influenza B/Brisbane/60/2008

24 hours post transfection, Hela cells were stained with mouse anti-influenza N1 NA antibody (2 µg/ml, Sino Biological) followed by anti-mouse IgG FITC labelled secondary antibody (1:500, Sigma Aldrich), sheep-anti influenza N2 NA serum (NIBSC) and sheep-anti influenza B NA serum (both 1:100, NIBSC) followed by anti-sheep IgG FITC labelled secondary antibody (1:100, Invitrogen). The cells were subsequently analyzed by flow cytometry (FACS) on a BD FACS Canto II using the FACS Diva software. Quantitative analysis of the fluorescent FITC signal was performed using FlowJo software (Tree Star, Inc.). Results are shown in FIG. 22A (NA of HA A/California/7/2009), FIG. 22B (NA of A/Hong Kong/4801/2014) and FIG. 22C (NA of B/Brisbane/60/2008).

Figure 22:
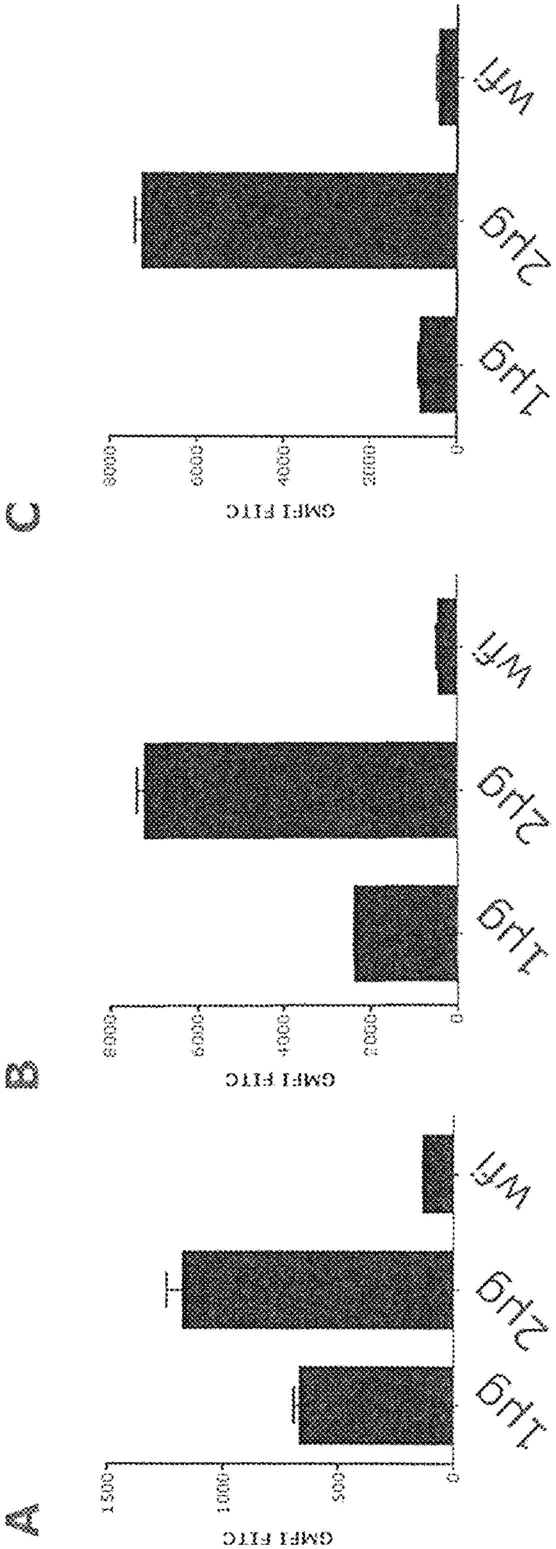

Results:

As shown in FIG. 22 all tested mRNA constructs coding for Influenza Neuraminidase proteins/antigens are expressed in Hela cells.

Example 11: Vaccination Experiment with mRNA Encoding Neuraminidase NA1 of Influenza Virus Female BALB/c mice were immunized intradermally (i.d.) and intramuscularly (i.m.) with mRNA vaccine compositions with doses, application routes and vaccination schedules as indicated in Table 8 (mRNA Sequences according to Example 1). As a negative control, one group of mice was injected with buffer (ringer lactate, RiIa). As positive control, one group of mice was injected i.m. with Influsplit Tetra® 2016/2017 (A/California/7/2009 (H1N1); A/Hong Kong/4801/2014 (H3N2); B/Brisbane/60/2008; B/Phuket/3073/2013). All animals were vaccinated on day 0 and day 21. Blood samples were collected on day 21, 35, and 48 for determination of immune responses. T cell responses wore analyzed by intracellular cytokine staining (ICS) using splenocytes isolated on day 48.

TABLE 8

| Immunization regimen (Example 11) | | | | | |
|---|---|---|---|---|---|
| Setup | No. of mice | mRNA | Formulation | Dose | Route, Volume |
| A | 6 | NA1 A/California/07/2009 | non-complexed mRNA | 40 µg | i.m., 1 × 25 µl |
| B | 6 | NA1 A/California/07/2009 | Protamine | 80 µg | i.d., 2 × 50 µl |
| C | 6 | Influsplit Tetra ® 2016/2017 | — | 1/10 of human dose | i.m., 2 × 25 µl |
| D | 6 | Rila | — | — | i.m., 1 × 25 µl |

11.1. Determination of Immune Responses for N1 NA (A/California/7/2009)

Functional NA-specific antibodies were analyzed using an enzyme-linked lectin assay (ELLA), essentially performed as previously described in the art. ELLA was performed in R6 well plates coated with a large glycoprotein substrate fetuin. NA cleaves terminal sialic acids from fetuin, exposing the penultimate sugar, galactose. Peanut agglutinin (PNA) is a lectin with specificity for galactose and therefore the extent of desialylation can be quantified using a PNA-horseradish peroxidase conjugate, followed by addition of a chromogenic peroxidase substrate. The optical density that is measured is proportional to NA activity. To measure functional NA inhibiting (N1) antibody titers, serial dilutions of sera were incubated on fetuin-coated plates with either A/California/7/2009(H1N1) virus or B/Brisbane/60/2008 virus (both pre-treated with Triton-X-100) or pseudo-typed influenza virus displaying NA of A/Hong Kong/4801/2014 (H3N2)). The reciprocal of the highest serum dilution that results in 50% inhibition of NA activity is designated as the N1 antibody titer. The result is shown in FIG. 23.

To determine T-cell responses, an ICS experiment was performed, essentially as outlined above. Cells were stimulated with NA specific peptide mixture and CD8+ T-cell responses and CD4+ T-cell responses were determined. The results are shown in FIG. 24 (CD8+) and FIG. 25 (CD4+).

Figure 23:
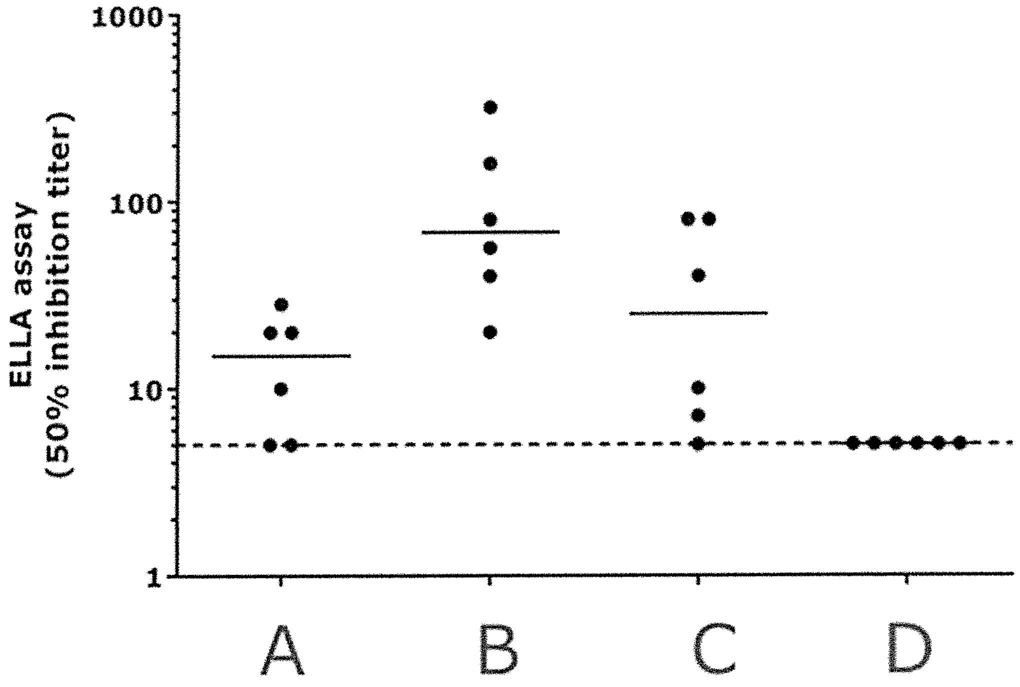
Figure 24:
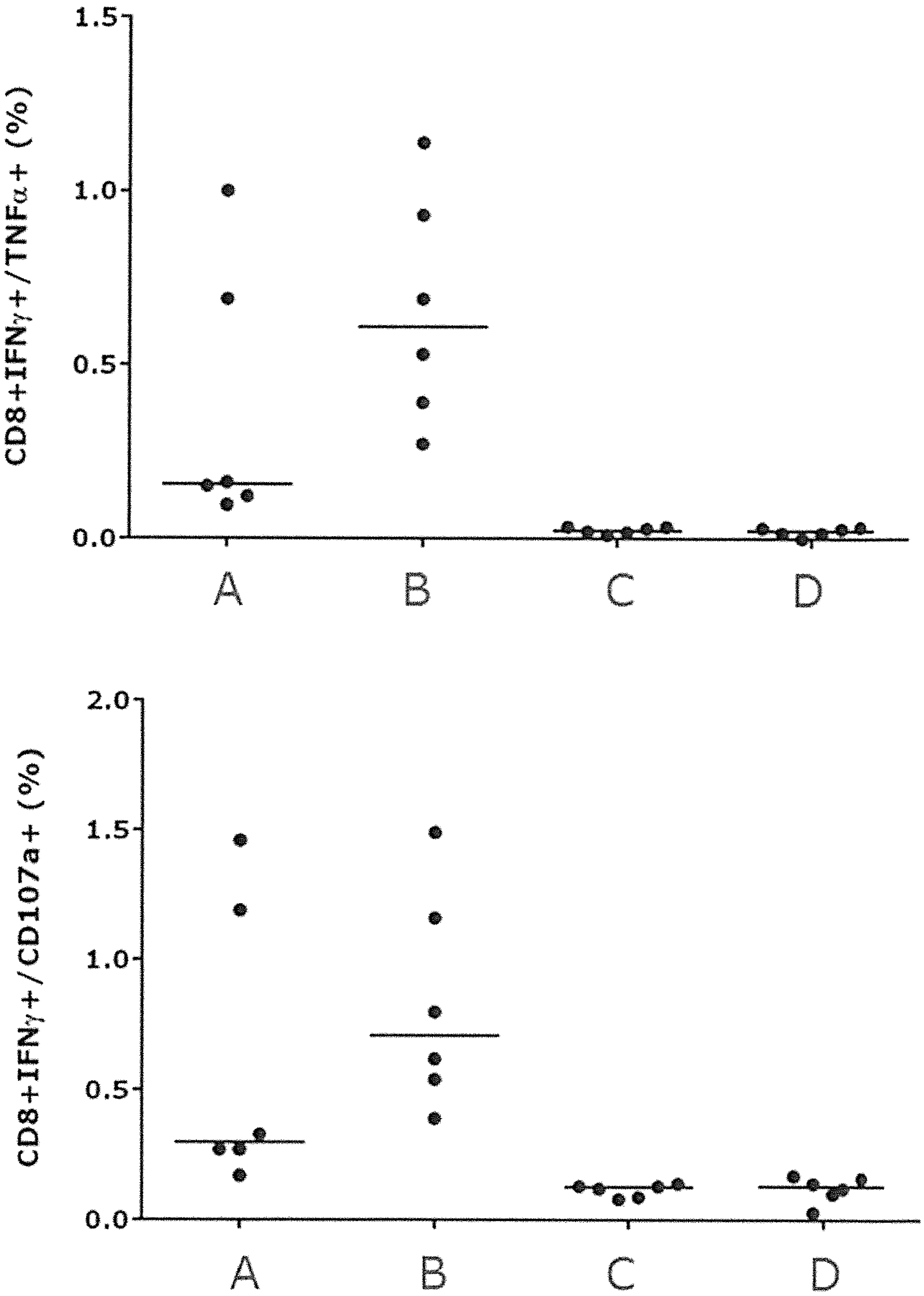
Figure 25:
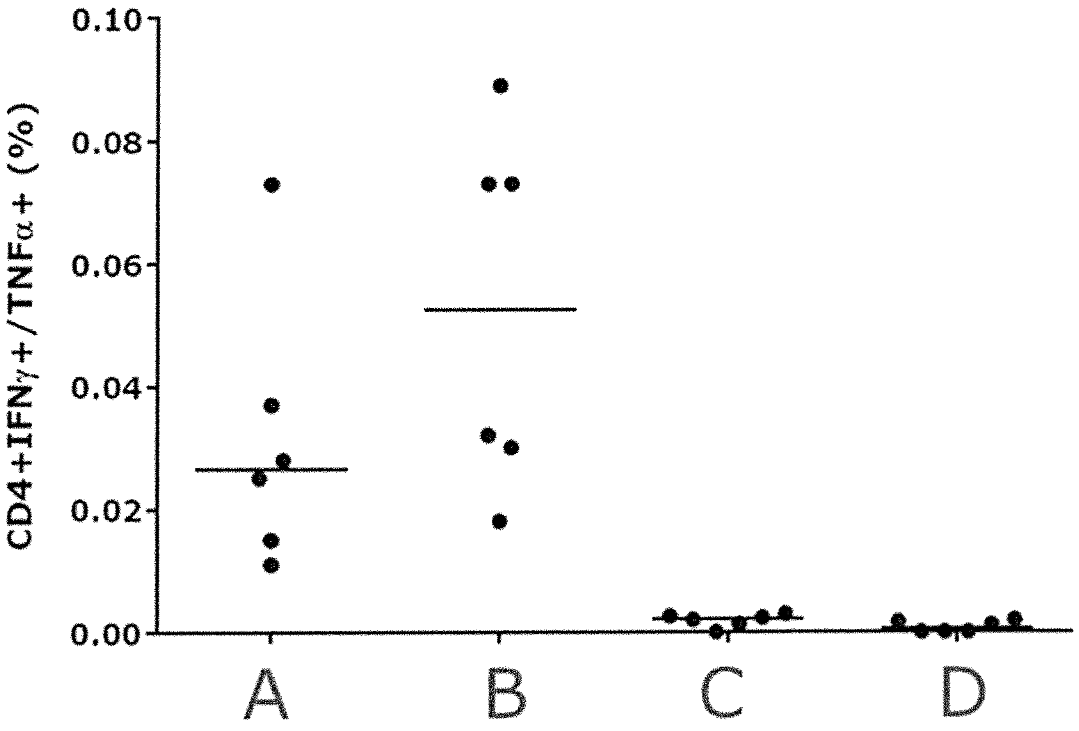

Results:

As shown in FIGS. 23 to 25, specific immune responses in mice could be detected after vaccination with mRNA coding for NA1 A/California/2009, irrespective of the application route or the formulation.

Example 12: Vaccination Experiment with mRNA Encoding Neuraminidase NA2 of Influenza Virus Female BALB/c mice were immunized intradermally (i.d.) and intramuscularly (i.m.) with mRNA vaccine compositions with doses, application routes and vaccination schedules as indicated in Table 9 (mRNA Sequences according to Example 1). As a negative control, one group of mice was injected with buffer (ringer lactate, RiIa). As positive control, one group of mice was injected i.m. with Influsplit Tetra® 2016/2017 (A/California/7/2009 (H1N1); A/Hong Kong/4801/2014 (H3N2); B/Brisbane/60/2008; B/Phuket/3073/2013). All animals were vaccinated on day 0 and day 21. Blood samples were collected on day 21, 35, and 49 for determination of homologous and heterologous antibody responses. T cell responses were analyzed by intracellular cytokine staining (ICS) using splenocytes isolated on day 49.

TABLE 9

Immunization regimen (Example 12)

| Setup | No. of mice | mRNA | Formulation | Dose | Route, Volume |
|---|---|---|---|---|---|
| A | 6 | NA2 A/Hong Kong/4801/2014 | non-complexed mRNA | 40 μg | i.m., 1 × 25 μl |
| B | 6 | NA2 A/Hong Kong/4801/2014 | Protamine | 80 μg | i.d., 2 × 50 μl |
| C | 6 | Influsplit Tetra ® 2016/2017 | — | 1/10 of human dose | i.m., 2 × 25 μl |
| D | 6 | Rila | — | — | i.m., 1 × 25 μl |

12.1. Determination of Immune Responses for NA2 A/Hong Kong/4801/2014

Functional NA-specific antibodies were analyzed using an enzyme-linked lectin assay (ELLA), essentially performed as previously described in the art and as described in paragraph 11.1. The result is shown in FIG. 26.

Figure 26:
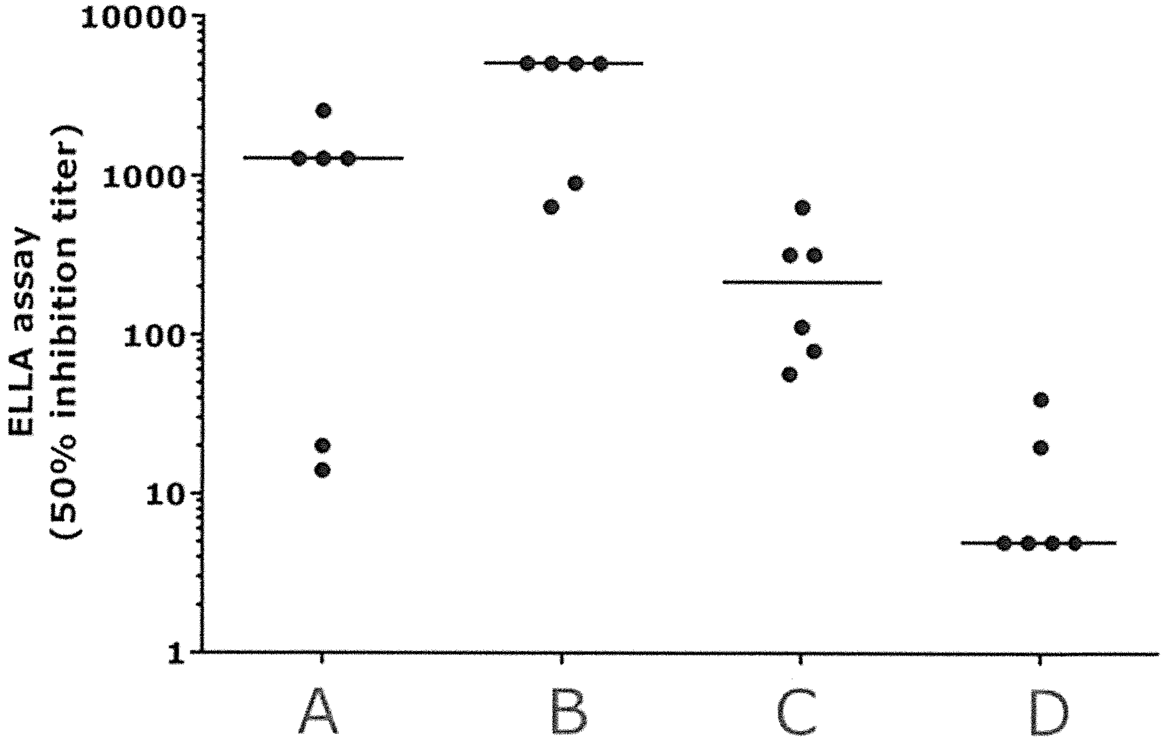

Results:

As shown in FIG. 26, specific immune responses in mice could be detected after vaccination with mRNA coding for NA2 A/Hong Kong/4801/2014, irrespective of the application route or the formulation.

Example 13: Vaccination Experiment with mRNA Encoding Neuraminidase NA of Influenza B Female BALB/c mice were immunized intradermally (i.d.) and intramuscularly (i.m.) with mRNA vaccine compositions with doses, application routes and vaccination schedules as indicated in Table 10 (mRNA Sequences according to Example 1). As a negative control, one group of mice was injected with buffer (ringer lactate, RiIa). As positive control, one group of mice was injected i.m. with Influsplit Tetra® 2016/2017 (A/California/7/2009 (H1N1); A/Hong Kong/4801/2014 (H3N2); B/Brisbane/60/2008; B/Phuket/3073/2013). All animals were vaccinated on day 0 and day 21. Blood samples were collected on day 21, 35, and 49 for determination of homologous and heterologous antibody responses. T cell responses were analyzed by intracellular cytokine staining (ICS) using splenocytes isolated on day 49.

TABLE 10

Immunization regimen (Example 13)

| Setup | No. of mice | mRNA | Formulation | Dose | Route, Volume |
|---|---|---|---|---|---|
| A | 6 | NA B/Brisbane/60/2008) | non-complexed mRNA | 40 μg | i.m., 1 × 25 μl |
| B | 6 | NA2 A/Hong Kong/4801/2014 | Protamine | 80 μg | i.d., 2 × 50 μl |
| C | 6 | Influsplit Tetra ® 2016/2017 | — | 1/10 of human dose | i.m., 2 × 25 μl |
| D | 6 | Rila | — | — | i.m., 1 × 25 μl |

13.1. Determination of Immune Responses for NA B/Brisbane/60/2008

Functional NA-specific antibodies were analyzed using an enzyme-linked lectin assay (ELLA), essentially performed as previously described in the art and as described in paragraph 11.1. The result is shown in FIG. 27.

Figure 27:
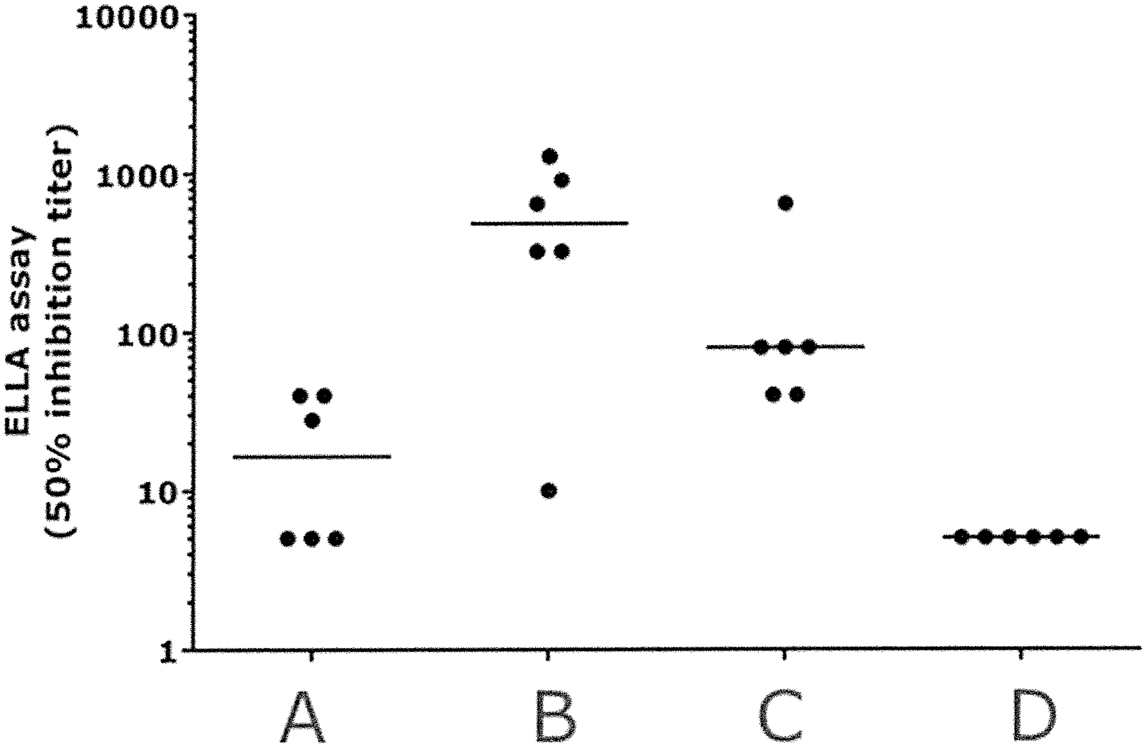

Results:

As shown in FIGS. 27, specific immune responses in mice could be detected after vaccination with mRNA coding for NA B/Brisbane/60/2008, irrespective of the application route or the formulation.

Example 14: Vaccination Experiment with a Combination of mRNAs Encoding Neuraminidase of Different Influenza Viruses (NA1, NA2, NAB)

Female BALB/c mice are immunized intradermally (i.d.) and intramuscularly (i.m.) with mRNA vaccine compositions with doses, application routes and vaccination schedules as indicated in Table 11 (mRNA Sequences according to Example 1). As a negative control, one group of mice is injected with buffer (ringer lactate, RiIa). As positive control, one group of mice is injected i.m. with Influsplit Tetra® 2016/2017 (A/California/7/2009 (H1N1); A/Hong Kong/4801/2014 (H3N2); B/Brisbane/60/2008; B/Phuket/3073/2013). All animals are vaccinated on day 0 and day 21. Blood samples are collected on day 21, 35, and 49 for determination of antibody responses (ELLA). T cell responses were analyzed by intracellular cytokine staining (ICS) using splenocytes isolated on day 48.

TABLE 11

Immunization regimen (Example 14)

| Setup | No. of mice | mRNA | Formulation | Dose | Route, Volume |
|---|---|---|---|---|---|
| A | 6 | NA1 A/California/07/2009<br>NA2 A/Hong Kong/4801/2014<br>NA B/Brisbane/60/2008) | non-complexed mRNA | 30 µg | i.m., 1 × 25 µl |
| B | 6 | NA1 A/California/07/2009<br>NA2 A/Hong Kong/4801/2014<br>NA B/Brisbane/60/2008) | Protamine | 80 µg | i.d., 2 × 50 µl |
| C | 6 | Influsplit Tetra ® 2016/2017 | — | 1/10 of human dose | i.m., 2 × 25 µl |
| D | 6 | Rila | — | — | i.m., 1 × 25 µl |

Example 15: Vaccination Experiment with a Combination of mRNAs Encoding Different Influenza Antigens in Non-Human Primates Non-human primates (NHPs) are immunized (6 animals per group) with mRNA vaccines (non-complexed mRNA ("naked"), LNP formulated) with doses, application routes and vaccination schedules as indicated in Table 12 (mRNA Sequences preferably according to Example 1). As vaccines, an mRNA composition comprising four HA antigens is used ("tetravalent HA") or an mRNA composition comprising seven HA+NA antigens (four HA, three NA; heptavalent or "septivalent HA+NA") is used. All animals are vaccinated on day D and day 21. Blood samples are collected on day 21, 35, and 48 for determination of antibody responses. T cell responses are analyzed by intracellular cytokine staining (ICS) using splenocytes isolated on day 49. Analysis of immune responses performed essentially as described above (ELLA, HI assay, ELISA. ICS).

TABLE 12

Immunization regimen (Example 15)

| Treatment | Formulation | Dose | Route, Volume |
|---|---|---|---|
| HA A/California/7/2009 H1N1<br>HA A/Hong Kong/4801/2014 H3N2<br>HA B/Brisbane/60/2008<br>HA B/Phuket/3073/2013<br>"Tetravalent HA" | non-complexed mRNA | 40 µg* | i.m., 500 µl |
| HA A/California/7/2009 H1N1<br>HA A/Hong Kong/4801/2014 H3N2<br>HA B/Brisbane/60/2008<br>HA B/Phuket/3073/2013<br>"Tetravalent HA" | non-complexed mRNA | 200 µg* | i.m., 500 µl |
| NA1 A/California/07/2009<br>NA2 A/Hong Kong/4801/2014<br>NA B/Brisbane/60/2008)<br>HA A/California/7/2009 H1N1<br>HA A/Hong Kong/4801/2014 H3N2<br>HA B/Brisbane/60/2008<br>HA B/Phuket/3073/2013<br>"Septavalent HA + NA" | non-complexed mRNA | 70 µg* | i.m., 500 µl |
| NA1 A/California/07/2009<br>NA2 A/Hong Kong/4801/2014<br>NA B/Brisbane/60/2008)<br>HA A/California/7/2009 H1N1<br>HA A/Hong Kong/4801/2014 H3N2<br>HA B/Brisbane/60/2008<br>HA B/Phuket/3073/2013<br>"Septavalent HA + NA" | non-complexed mRNA | 350 µg* | i.m., 500 µl |

TABLE 12-continued

Immunization regimen (Example 15)

| Treatment | Formulation | Dose | Route, Volume |
|---|---|---|---|
| HA A/California/7/2009 H1N1<br>HA A/Hong Kong/4801/2014 H3N2<br>HA B/Brisbane/60/2008<br>HA B/Phuket/3073/2013<br>"Tetravalent HA" | LNP formulated mRNA | 40 µg* | i.m., 500 µl |
| HA A/California/7/2009 H1N1<br>HA A/Hong Kong/4801/2014 H3N2<br>HA B/Brisbane/60/2008<br>HA B/Phuket/3073/2013<br>"Tetravalent HA" | LNP formulated mRNA | 200 µg* | i.m., 500 µl |
| NA1 A/California/07/2009<br>NA2 A/Hong Kong/4801/2014 | LNP formulated mRNA | 70 µg* | i.m., 500 µl |

TABLE 12-continued

| Immunization regimen (Example 15) | | | |
|---|---|---|---|
| Treatment | Formulation | Dose | Route, Volume |
| NA B/Brisbane/60/2008)<br>HA A/California/7/2009 H1N1<br>HA A/Hong Kong/4801/2014 H3N2<br>HA B/Brisbane/60/2008<br>HA B/Phuket/3073/2013<br>"Septavalent HA + NA"<br>NA1 A/California/07/2009<br>NA2 A/Hong Kong/4801/2014<br>NA 8/Brisbane/60/2008)<br>HA A/California/7/2009 H1N1<br>HA A/Hong Kong/4801/2014 H3N2<br>HA B/Brisbane/60/2008<br>HA B/Phuket/3073/2013<br>"Septavalent HA + NA" | LNP formulated mRNA | 350 μg* | i.m., 500 μl |

*Each mRNA represented equally in the composition

Example 16: In Ovo Vaccination of Chicken Using mRNA Coding for H5N1 and/or H5N8 Influenza Antigens mRNA vaccine composition(s) coding for influenza antigens HA and/or NA derived from avian subtype H5N1 and/or H5N8 are administered via in ovo injection to chicken embryos as commonly known in the art. After hatching, immune responses of immunized chicken are analyzed as described above (HI assay. ELISA, ELLA, ICS).

Example 17: Vaccination of Pigs mRNA vaccine composition(s) coding for influenza antigens HA and/or NA derived from swine subtypes H1N1, H1N2, H2N1, H3N1, H3N2, or H2N3 are injected i.m., i.d., or s.c. to pigs. Immune responses of immunized pigs are analyzed as described above (HI assay. ELISA, ELLA, ICS).

Example 18: Clinical Development of an Influenza mRNA Vaccine

To demonstrate safety and efficiency of the Influenza mRNA vaccine composition, a randomized, double blind, placebo-controlled clinical trial (phase I) is initiated.

For clinical development, GMP-grade RNA is produced using an established GMP process, implementing various quality controls on DNA level and RNA level as described in detail in WD 2016/80430A1.

In the clinical trial, human volunteers (adult subjects, 18-45 years of age) are intramuscularly (i.m.) injected for at least two times with an mRNA composition comprising one mRNA coding for one influenza antigen as specified herein ("monovalent", H3N2 A/Hong Kong/4801/2014), or with an mRNA composition comprising four HA influenza antigens as specified herein ("tetravalent HA"), or with an mRNA composition comprising four HA and three NA influenza antigens as specified herein ("septivalent HA-NA") or with an mRNA composition comprising multiple HA and multiple NA influenza antigens as specified herein ("multivalent HA+NA"). In addition, a group of elderly volunteers is treated (elderly adults >65 years of age). The design of the studies is indicated in tables 13-16.

TABLE 13

Clinical design of a tetravalent HA influenza study:

| Group | Treatment | Total mRNA per dose (μg) | Formulation/Route | Clinical dose volume (ml) | No. human of adult subjects |
|---|---|---|---|---|---|
| 1 | Control (saline) | 0 | — | 0.5 | 30 |
| 2 | mRNA vaccine tetravalent HA | 20* | LNP or non-complexed (i.m.) | 0.5 | 30 |
| 3 | mRNA vaccine tetravalent HA | 40* | LNP or non-complexed (i.m.) | 0.5 | 30 |
| 4 | mRNA vaccine tetravalent HA | 80* | LNP or non-complexed (i.m.) | 0.5 | 30 |
| 5 | Licensed vaccine control | — | i.m. | 0.5 | 30 |
| 6 elderly | mRNA vaccine | 40 or 80* | LNP or non-complexed (i.m.) | 0.5 | 30 |

*each mRNA represented equally in the composition

TABLE 14

Clinical design of a monovalent influenza study (H3N2):

| Group | Treatment | Total mRNA per dose (μg) | Formulation/Route | Clinical dose volume (mL) | No. human of adult subjects |
|---|---|---|---|---|---|
| 1 | Control (saline) | 0* | i.m. | 0.5 | 30 |
| 2 | mRNA vaccine H3N2 A/Hong Kong/4801/2014 | 20* | LNP or non-complexed (i.m.) | 0.5 | 30 |
| 3 | mRNA vaccine H3N2 A/Hong Kong/4801/2014 | 40* | LNP or non-complexed (i.m.) | 0.5 | 30 |
| 4 | mRNA vaccine H3N2 A/Hong Kong/4801/20I4 | 80* | LNP or non-complexed (i.m.) | 0.5 | 30 |
| 5 | Licensed vaccine control | — | i.m. | 0.5 | 30 |
| 6 elderly | mRNA vaccine | 40 or 80* | LNP or non-complexed (i.m.) | 0.5 | 30 |

*each mRNA represented equally in the composition

TABLE 15

Clinical design of a heptavalent/septivalent HA + NA influenza study:

| Group | Treatment | Total mRNA per dose (μg) | Formulation/Route | Clinical dose volume (ml) | No. human of adult subjects |
|---|---|---|---|---|---|
| 1 | Control (saline) | 0 | i.m. | 0.5 | 30 |
| 2 | mRNA vaccine septavalent HA + NA | 20* | LNP or non-complexed (i.m.) | 0.5 | 30 |
| 3 | mRNA vaccine septavalent HA + NA | 40* | LNP or non-complexed (i.m.) | 0.5 | 30 |
| 4 | mRNA vaccine septavalent HA + NA | 80* | LNP or non-complexed (i.m.) | 0.5 | 30 |
| 5 | Licensed vaccine control | — | i.m. | 0.5 | 30 |
| 6 elderly | mRNA vaccine | 40 or 80* | LNP or non-complexed (i.m.) | 0.5 | 30 |

*each mRNA represented equally in the composition

TABLE 16

Clinical design of a multivalent HA + NA influenza study:

| Group | Treatment | Total mRNA per dose (μg) | Formulation/Route | Clinical dose volume (ml) | No. human of adult subjects |
|---|---|---|---|---|---|
| I | Control (saline) | 0 | i.m. | 0.5 | 30 |
| 2 | mRNA vaccine multivalent | 20* | LNP or non-complexed (i.m.) | 0.5 | 30 |
| 3 | mRNA vaccine multivalent | 40* | LNP or non-complexed (i.m.) | 0.5 | 30 |
| 4 | mRNA vaccine multivalent | 80* | LNP or non-complexed (i.m.) | 0.5 | 30 |
| 5 | Licensed vaccine control | — | i.m. | 0.5 | 30 |
| 6 elderly | mRNA vaccine | 40 or 80* | LNP or non-complexed (i.m.) | 0.5 | 30 |

*each mRNA represented equally in the composition

In order to assess the safety profile of the Influenza vaccine compositions according to the invention, subjects are monitored after administration (vital signs, vaccination site tolerability assessments, hematologic analysis).

The efficacy of the immunization is analysed by determination of HI-titers and ELLA assay. Blood samples are collected on day 0 as baseline and after completed vaccination. Sera are analyzed for functional antibodies (HI assay, ELLA).

Furthermore, a subset of healthy subjects is challenged with live Influenza virus or placebo by oral administration. Subjects are followed post-challenge for symptoms of Influenza associated illness, infection and immune responses.

SEQUENCE LISTING (215894 sequences)

SEQ ID NO: 1 - protein, 566 aa, Artificial Sequence
  hemagglutinin__InfluenzaA__AAA16879
MEAKLFVLFCTFTVLKADTICVGYHANNSTDTVDTVLEKNVTVTHSVNLLEDSHNGKLCSLNGIAPLQLGKCNVAGWLLGNPECDLLLTANSWSYIIETSNSENGTCYPGEFIDYEELREQLSSVSSFEKFEIFPKASSWPNHETTKGVTAACSYSGASSFYRNLLWITKKGTSYPKLSKSYTNNKGKEVLVLWGVHHPPTTSEQQSLYQNADAYVSVGSSKYNRRFTPEIAARPKVRGQAGRMNYYWTLLDQGDTITFEATGNLIAPWYAFALNKGSDSGIITSDAPVHNCDTRCQTPHGALNSSLPFQNVHPITIGECPKYIKSTKLRMATGLRNVPSIQSRGLFGAIAGFIEGGWTGMIDGWYGYHHQNEQGSGYAADQKSTQNAIDGITNKVNSVIEKMNTQFTAVGKEFNNLERRIENLNKKVDDGFLDVWTYNAELLVLLENERTLDFHDSNVRNLYEKVKSQLRNNAKELGNGCFEFYHKCDDECMEREKNGTYDYPKYSEESKLNREEIDGVKLESMGVYQILAIYSTVASSLVLLVSLGAISFWMCSNGSLQCRICI

SEQ ID NO: 2 - protein, 566 aa, Artificial Sequence
  hemagglutinin__InfluenzaA__AAA16880
MEAKLFVLFCTFTVLKADTICVGYHANNSTDTVDTVLEKNVTVTHSVNLLEDSHNGKLCSLNGIAPLQLGKCNVAGWLLGNPECDLLLTANSWSYIIETSNSENGTCYPGEFIDYEELREQLSSVSSFEKFEIFPKASSWPNHETTKGVTAACSYSGASSFYRNLLWITKKGTSYPTLSKSYTNNKGKEVLVLWGVHHPPTVNEQQSLYQNADAYVSVGSSKYNRRFTPEIAARPKVRGQAGRMNYHWTLLDQGDTITFEATGNLIAPWYAFALNKGSDSGIITSDAPVHNCDTRCQTPHGALNSSLPFQNVHPITIGECPKYVKSTKLRMATGLRNVPSIQSRGLFGAIAGFIEGGWTGMIDGWYGYHHQNEQGSGYAADQKSTQNAIDGITNKVNSVIEKMNTKFTAVGKEFNNLERRIENLNKKVDDGFLDVWTYNAELLVLLENERTLDFHDSNVRNLYEKVKSQLRNNAKELGNGCFEFYHKCDDECIESVKNGTYDYPKYSEESKLNREEIDGVKLESMGVYQILAIYSTVASSLVLLVSLGAISFWMCSNGSLQCRICI

SEQ ID NO: 3 - protein, 562 aa, Artificial Sequence
  hemagglutinin__InfluenzaA__AAA64362
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKYLLSSVKHFEKVKILPKDRWTQHTTTGGSRACAVSGNPSFFRNMVWLTKKGSDYPVAKGSYNNTSGEQMLIIWGVHHPNDETEQRTLYQNVGTYVSVGTSTLNKRSTPEIATRPKVNGLGSRMEFSWTLLDMWDTINFESTGNLIAPEYGFKISKRGSSGIMKTEGTLENCETKCQTPLGAINTTLPFHNVHPLTIGECPRYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 4 - protein, 562 aa, Artificial Sequence
  hemagglutinin__InfluenzaA__AAA64363
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKKGSNYPVAKGSYNNTSGEQMLIIWGVHHPNDETEQRTLYQNVGTYVSVGTSTLNKRSTPDIATRPKVNGQGGRMEFSWTLLDMWDTINFESTGNLIAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKINTQFEAVEKEFSNLERRLENLNKKMEDGFLDVWTYNAELLVLMENERTLDFHDSSVKNLYDKVRMQLRDNVKELGNGCFEFYHKCDDECMNSVKNGTYDYPKYEEESKLNRNEIKGVKLSSMGIYQILAIYATVAGSLSLAIMMAGISFWMCSNGSLQCRICI

SEQ ID NO: 5 - protein, 562 aa, Artificial Sequence
  hemagglutinin__InfluenzaA__AAA64365
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKKGSNYPVAKGSYNNTSGEQMLIIWGVHHPNDETEQRTLYQNVGTYVSVGTSTLNKRSTPDIATRPKVDGLGSRMEFSWTLLDMWDTINFESTGNLIAPEYGFKISKRGSSGIMKTEGTLGNCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVEKEFSNLERRLENLNKKMEDGFLDVWTYNAELLVLMENERTLDFHDSNVKNLYNKVRMQLRDNVKELGNGCFEFYHKCDDECMNSVKNGTYDYPKYEEESKLNRNEIKGVKLSSMGIYQILAIYATVAGSLSLAIMMAGISFWMCSNGSLQCRICI

SEQ ID NO: 6 - protein, 562 aa, Artificial Sequence
  hemagglutinin__InfluenzaA__AAA64366
MAIIYLILLFTAVRGDQICIGYHANNSTEKVDTILERNVTVTHAKDILEKTHNGKLCKLNGIPPLELGDCSIAGWLLGNPECDRLLSVPEWSYIMEKENPRDGLCYPGSFNDYEELKHLLSSVKHFEKVKILPKDRWTQHTTTGGSRACAVSGNPSFFRNMVWLTKKESNYPVAKGSYNNTSGEQMLIIWGVHHPNDETEQRTLYQNVGTYVSVGTSTLNKRSTPDIATRPKVNGLGSRMEFSWTLLDMWDTINFESTGNLIAPEYGFKISKRGSSGIMKTEGTLENCETKCQTPLGAINTTLPFHNVHPLTIGECPKYVKSEKLVLATGLRNVPQIESRGLFGAIAGFIEGGWQGMVDGWYGYHHSNDQGSGYAADKESTQKAFDGITNKVNSVIEKMNTQFEAVGKEFSNLERRLENLNKKMEDGFLDVWTYNAELLVLMENERTLDFHDSNVKNLYDKVRMQLRDNVKELGNGCFEFYHKCDDECMNSVKNGTYDYPKYEEESKLNRNEIKGVKLSSMGVYQILAIYATVAGSLSLAIMMAGISFWMCSNGSLQCRICI

SEQ ID NO: 7 - protein, 566 aa, Artificial Sequence
  hemagglutinin__InfluenzaA__AAA85781
MKTIIALSYIFCLVFAQDLPGNDNSTATLCLGHHAVPNGTLVKTITNDQIEVTNATELVQSSSTGKICDNPHRILDGINCTLIDALLGDPHCDGFQNEKWDLFVERSKAFSNCYPYDVPDYASLRSLVASSGTLEFINEGFNWTGVTQNGGSSACKRGPDNGFFSRLNWLYKSGSTYPVQNVTMPNNDNSDKLYIWGVHHPSTDKEQTNLYVQASGKVTVSTKRSQQTVIPNVGSRPWVRGLSSRVSIYWTIVKPGDILVINSNGNLIAPRGYYKMRTGKSSIMRSDAPIGTCSSECITPNGSIPNDKPFQNVNKITYGACPKYVKQNTLKLATGMRNVPEKQIRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNPCIGSIRNGTYDHDVYRDEALNNRFQIKGVELKSGYKDWILWISFAISCFLLCVVLLGFIMWACQKGNIRCNICI

SEQ ID NO: 8 - protein, 568 aa, Artificial Sequence
  hemagglutinin__InfluenzaA__AAC14418
MERIVLLLATVSLVKSDQICIGYHANNSTEQVDTIMEKNVTVTHAQDILERTHNGKLCDLNGVKPLILRDCSVAGWLLGNPMCDEFINVPEWSYIVEKASPANDLCYPGNFNDYEELKHLLSRINHFEKIQIIPKSSWSNHDASSGVSSACPYLGRSSFFRNVVWLIKKNSTYPTIKRSYNNTNQEDLLVLWGIHHPNDAAEQTKLYQNPTTYISVGTSTLNQRLVPEIATRPKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNAPQRERRRKKRGLFGAIAGFIEGGWQGMVDGWYGYHHSNEQGSGYAADQESTQKAIDGVTNKVNSIINKMNTQFEAVGREFNNLERRIENLNKKMEDGFLDVWTYNAELLVLMENERTLDFHDSNVKNLYDKVRLQLRDNAKELGNGCFEFYHKCDNECMESVKNGTYDYPQYSEEARLNREEISGVKLESMGTYQILSIYSTVASSLALAIMVAGLSLWMCSNGSLQCRICI

SEQ ID NO: 9 - protein, 568 aa, Artificial Sequence
  hemagglutinin__InfluenzaA__AAC40508
MERTVLLLATVSLVKSDQICIGYHANNSTEQVDTIMEKNVTVTHAQDILERTHNGKLCDLNGVKPLILRDCSVAGWLLGNPMCDEFINVPEWSYIVEKASPANDLCYPGNFNDYEELKHLLSRINHFEKIQIIPKSSWSNHDASSGVSSACPYLGRSSFFRNVVWLIKKNSAYPTIKRSYNNTNQEDLLVLWGVHHPNDAAEQTKLYQNPTTYISVGTSTLNQRLVPEIATRPKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNTPQRERRRKKRGLFGAIAGFIEGGWQGMVDGWYGYHHSNEQGSCYSADKESTQKAIDGVTNKVNSIINKMNTQFEAVGREFNNLERRIENLNKKMEDGFLDVWTYNAELLVLMENERTLDFHDSNVKNLYDKVRLQLRDNAKELGNGCFEFYHKCDNECMESVKNGTYDYPQYSEEARLNREEISGVKLESMGTYQILSIYSTVASSLALAIMVAGLSLWMCSNGSLQCRICI

SEQ ID NO: 10 - protein, 566 aa, Artificial Sequence
  hemagglutinin__InfluenzaA__AAF87274
MKAILVVLLYTFTTANADTLCIGYHANNSTDTVDTVLEKNVTVTHSVNLLENRHNGKLCKLKGVAPLHLGKCNIAGWLLGNPECELLFTASSWSYIVETSNSDNGTCYPGDFINYEELREQLSSVSSFERFEIFPKANSWPNHETNRGVTSACPYAGANSFYRNLIWLVKKGNSYPKLSKSYINNKGKEVLVLWGIHHPPTSNDQQSLYQNADAYVFVGSSKYNKKFMPEIATRPKVRGQAGRMNYYWTLIEPGDTITFEATGNLVAPRYAFAMERGSGSGIIISDTPVHDCNATCQTPKGAINTNLPFQNIHPVTIGECPKYVKSTRLRMATGLRNIPSIQSRGLFGAIAGFIEGGWTGMIDGWYGYHHQNEQGSGYAADRKSTQNAIDGITNKVNSVIEKMNTQFTAVGKEFNHLEKRIKNLNKKVDDGFLDVWTYNAELLVLLENERTLDYHDSNVKNLYEKVRSQLRNNAKEIGNGCFEFYHKCDDTCMESIKNGTYDYPKYSEEAKLTREEIDGVKLESTRIYQILAIYSTIASSLVLLVSLGAISFWMCSNGSLQCRICI

SEQ ID NO: 11 - protein, 566 aa, Artificial Sequence
  hemagglutinin__InfluenzaA__AAF87275
MKAILVVLLYTFTTANADTLCIGYHANNSTDTVDTVLEKNVTVTHSVNLLENRHNGKLCKLKGVAPLHLGKCNIAGWLLGNPECELLFTASSWSYIVETSNSDNGTCYPGDFINYEELREQLSSVSSFERFEIFPKANSWPNHETNRGVTSACPYAGANSFYRNLIWLVKKGNSYPKLSKSYINNKGKEVLVLWGIHHPPTSNDQQSLYQNADAYVFVGSSKYNKKFMPEIATRPKVRGQAGRMNYYWTLIEPGDTITFEATGNLVAPRYAFAMERGSGSGIIISDTPVHDCNATCQTPKGAINTNLPFQNIHPVTIGECPKYVKSTRLRMATGLRNIPSIQSRGLFGAIAGFIEGGWTGMIDGWYGYHHQNEQGSGYAADRKSTQNAIDGITNKVNSVIEKMNTQFTAVGKEFNHLEKRIENLNKKVDDGFLDVWTYNAELLVLLENERTLDYHDSNVKNLYEKVRSQLRNNAKEIGNGCFEFYHKCDDTCMESIKNGTYDYPKYSEEAKLTREEIDGVKLESTRIYQILAIYSTIASSLVLLVSLGAISFWMCSNGSLQCRICI

SEQ ID NO: 12 - protein, 566 aa, Artificial Sequence
  hemagglutinin__InfluenzaA__AAF87277
MKAILLVLLYTFTAANADTLCIGYHANNSTDTVDTVLEKNVTVTHSVNLLEDRHNGKLCKLRGIAPLHLGKCNIAGWLLGNPECELLFTASSWSYIVETSNSDNGTCYPGDFINYEELREQLSSVSSFERFEIFPKASSWPDHETNRGVTAACPYAGANSFYRNLIWLVKKGNSYPKLSKSYINNKEKEVLVLWGIHHPPTSTDQQSLYQNADAYVFVGSSKYNKKFKPEIASRPKVRGQAGRMDYYWTLVEPGDTITFEATGNLVVPRYAFAMKRGSGSGIIISDTPVHDCNTTCQTPKGAINTSLPFQNIHPVTIGECPKYVKSTKLRMATGLRNIPSIQSRGLFGAIAGFIEGGWTGMIDGWYGYHHQNEQGSGYAADRKSTQNAIDGVTNKVNSVIEKMNTQFTAVGKEFNHLEKRIENLNKKVDDGFLDVWTYNAELLVLLENERTLDYHDSNVKNLYEKVRSQLKNNAKEIGNGCFEFYHKCDDTCMESVKNGTYDYPKYSEESKLNREEIDGVKLESTRIYQILAIYSTVASSLILLVSLGAISFWMCSNGSLQCRICI

SEQ ID NO: 13 - protein, 566 aa, Artificial Sequence
  hemagglutinin__InfluenzaA__AAF87278
MKAILLVLLYTFTAANADTLCIGYHANNSTDTVDTVLEKNVTVTHSVNLLEDRHNGKLCKLRGIAPLHLGKCNIAGWLLGNPECELLFTASSWSYIVETSNSDNGTCYPGDFINYEELREQLSSVSSFERFEIFPKASSWPNHETNRGVTAACPYAGANSFYRNLIWLVKKGNSYPKLSKSYINNKEKEVLVLWGIHHPPTSTDQQSLYQNADAYVFVGSSKYNKKFKPEIASRPKVRGQAGRMDYYWTLVEPGDTITFEATGNLVVPRYAFAMKRGSGSGIIISDTPVHDCNTTCQTPKGAINTSLPFQNIHPVTIGECPKYVKSTKLRMATGLRNIPSIQSRGLFGAIAGFIEGGWTGMIDGWYGYHHQNEQGSGYAADRKSTQNAIDGVTNKVNSVIEKMNTQFTAVGKEFNHLEKRIENLNKKVDDGFLDVWTYNAELLVLLENERALDYHDSNVKNLYEKVRSQLKNNAKEIGNGCFEFYHKCDDTCMESVKNGTYDYPKYSEESKLNREEIDGVKLESTRIYQILAIYSTVASSLILLVSLGAISFWMCSNGSLQCRICI

SEQ ID NO: 14 - protein, 566 aa, Artificial Sequence
  hemagglutinin__InfluenzaA__AAF87279
MKAILLVLLYTFTAANADTLCIGYHANNSTDTVDTVLEKNVTVTHSVNLLEDRHNGKLCKLRGIAPLHLGKCNIAGWLLGNPECELLFTASSWSYIVETSNSDNGTCYPGDFINYEELREQLSSVSSFERFEIFPKASSWPNHETNRGVTAACPYAGANSFYRNLIWLVKKGNSYPKLSKSYINNKEKEVLVLWGIHHPPTSTDQQSLYQNADAYVFVGSSKYNKKFKPEIASRPKVRGQAGRMDYYWTLVEPGDTITFEATGNLVVPRYAFAMKRGSGSGIIISDTPVHDCNTTCQTPKGAINTSLPFQNIHPVTIGECPKYVKSTKLRMATGLRNIPSIQSRGLFGAIAGFIEGGWTGMIDGWYGYHHQNEQGSGYAADRKSTQNAIDGVTNKVNSVIEKMNTQFTAVGKEFNHLEKRIENLNKKVDDGFLDVWTYNAELLVLLENERTLDYHDSNVKNLYEKVRSQLKNNAKEIGNGCFEFYHKCDDTCMESVKNGTYDYPKYSEESKLNREEIDGVKLESTRIYQILAIYSTVASSLILLVSLGAISFWMCSNGSLQCRICI

SEQ ID NO: 15 - protein, 566 aa, Artificial Sequence
  hemagglutinin__InfluenzaA__AAF87281
MKAILVVLLYTFTTANADTLCIGYHANNSTDTVDTVLEKNVTVTHSVNLLEDRHNGKLCKLKGIAPLHLGKCNIAGWLLGNPECELLFTASSWSYIVETSNSDNGTCYPGDFINYEELREQLSSVSSFERFEIFPKASSWPNHETNRGVTSACPYAGANSFYRNLIWLVKKGNSYPKLSKSYINNKGKKVLVLWGIHHPPTSTDQQSLYQNADAYVFVGSSKYNKKFMPEIATRPKVRGQAGRMNYYWTLIEPGDTITFEATGNLVVPRYAFAMERGYGSGIIISDTPVHDCNTTCQTPKGAINTSLPFQNIHPVTIGECPKYVKSTKLRMATGLRNIPSIQSRGLFGAIAGFIEGGWTGMIDGWYGYHHQNEQGSGYAADRKSTQNAIDGITNKVNSVIEKMNTQFTAVGKEFNHLEKRIENLNKKVDDGFLDVWTYNAELLVLLENERTLDYHDSNVKNLYEKVKSQLKNNAKEIGNGCFEFYHKCDDTCMESVKNGTYDYPKYSEEAKLNREEIDGVKLESTRIYQILAIYSTIASSLVLLVSLGAISFWMCSNGSLQCRICI

SEQ ID NO: 16 - protein, 566 aa, Artificial Sequence; identical to SEQ ID NO: 14
  hemagglutinin__InfluenzaA__AAF87282

SEQ ID NO: 17 - protein, 566 aa, Artificial Sequence
  hemagglutinin__InfluenzaA__AAF87283
MKAILVVLLYAFTTANADTLCIGYHANNSTDTVDTVLEKNVTVTHSVNLLEDRHNGKLCKLKGVAPLHLGKCNIAGWLLGNPECELLFTASSWSYIVETSNSDNGTCYPGDFINYEELREQLSSVSSFERFEIFPKASSWPNHETNRGVTSACPYSGANSFYRNLIWLVKKGNSYPKLSKSYINNKGKEVLVLWGIHHPPTSTDQQSLYQNADAYVFVGSSKYNKKFMPEIATRPKVRGQAGRMNYYWTLIEPGDTITFEATGNLVAPRYAFAMERGSGSGIIISDTPVYDCNTACQTPKGAINTSLPFQNIHPVTIGECPKYVKSTKLRMATGLRNIPSIQSRGLFGAIAGFIEGGWTGMIDGWYGYHHQNEQGSGYAPDRKSTQNAIDGITNKVNSVIEKMNTQFTAVGKEFNHLEKRIENLNKKVDDGFLNVWTYNAELLVLLENERTLDYHDSNVKNLYEKVRSQLKNNAKEIGNGCFEFYHKCDDTCMESVKNGTYDYPKYSEEARLNREEIDGVKLESTRIYQILAIYSTIASSLVLLVSLGAISFWMCSNGSLQCRICI

SEQ ID NO: 18 - protein, 566 aa, Artificial Sequence
  hemagglutinin__InfluenzaA__AAF87284
MKAILVVLLYAFTTANADTLCIGYHANNSTDTVDTVLEKNVTVTHSVNLLEDRHNGKLCKLKGVAPLHLGKCNIAGWLLGNPECELLFTASSWSYIVETSNSDNGTCYPGDFINYEELREQLSSVSSFERFEIFPKASSWPNHETNRGVTSACLLFWSKQLLQKLNMAGKKGNSYPKLSKSYINNKGKEVLVLWGIHHPPTSTDQQSLYQNADAYVFVGSSKYNKKFMPEIATRPKVRGQAGRMNYYWTLIEPGDTITFEATGNLVAPRYAFAMERGSGSGIIISDTPVYDCNTACQTPKGAINTSLPFQNIHPVTIGECPKYVKSTKLRMATGLRNIPSIQSRGLFGAIAGFIEGGWTGMIDGWYGYHHQNEQGSGYAADRKSTQNAIDGITNKVNSVIEKMNTQFTAVGKEFNHLEKRIENLNKKVDDGFLNVWTYNAELLVLLENERTLDYHDSNVKNLYEKVRSQLKNNAKEIGNGCFEFYHKCDDTCMESVKNGTYDYPKYSEEARLNREEIDGVKLESTRIYQILAIYSTIASSLVLLVSLGAISFWMCSNGSLQCRICI

SEQ ID NO: 19 - protein, 566 aa, Artificial Sequence
  hemagglutinin__InfluenzaA__AAG01749
MSTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRSGKSSIMRSDAPIDNCNSECITPNGSIPNEKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 20 - protein, 566 aa, Artificial Sequence
  hemagglutinin__InfluenzaA__AAG01767
MNTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFIERSKAYSNCYPYDVPDYSSLRSLVASSGTLEFTNEDFNWTGVAQDGGSYSCKRESVKSFFSRLNWLHKLEYKYPALNVTMPNNDKFDKLYIWGVHHPSTDSEQTSLYVQAIGRVTVSTKSSQQTVIPNIGSRPWVRGISSRISIYWTIVKPGDILLISSTGNLIAPRGYFKIRNGKSSIMRSDAPIDNCYSECITPNGSIPNDKPFQNVNRITYGACPKYVKQKTLKLATGMRNVPEKQTRGIFGAIAGFIENGWEGMVDGWYGFRHQNSEGTGQAADLKSTQAAIDQVNGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 21 - protein, 566 aa, Artificial Sequence
  hemagglutinin__InfluenzaA__AAG01776
MNTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFIERSKAYSNCYPYDVPDYSSLRSLVASSGTLEFTNEDFNWTGVAQDGGSYSCKRESVKSFFSRLNWLHKLEYKYPALNVTMPNNDKFDKLYIWGVHHPSTDSEQTSLYVQAIGRVTVSTKSSQQTVIPNIGSRPWVRGISSRISIYWTIVKPGDILLISSTGNLIAPRGYFKIRNGKSSIMRSDAPIDNCYSECITPNGSIPNDKPFQNVNRITYGACPKYVKQKTLKLATGMRNVPEKQTRGIFGAIAGFIENGWEGMVDGWYGFRHQNSEGTGQAADLKSTQAAIDQVNGKLNWLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 22 - protein, 566 aa, Artificial Sequence
  hemagglutinin__InfluenzaA__AAG01785
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFIERSKAYSNCYPYDVPDYSSLRSLVASSGTLEFTNEDFNWTGVAQDGGSYSCKRESVKSFFSRLNWLHKLEYKYPALNVTMPNNDKFDKLYIWGVHHPSTDSEQTSLYVQAIGRVTVSTKSSQQTVIPNIGSRPWVRGISSRISIYWTIVKPGDILLISSTGNLIAPRGYFKIRNGKSSIMRSDAPIDNCYSECITPNGSIPNDKPFQNVNRITYGACPKYVKQKTLKLATGMRNVPEKQTRGIFGAIAGFIENGWEGMVDGWYGFRHQNSEGTGQAADLKSTQAAIDQVNGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 23 - protein, 566 aa, Artificial Sequence
  hemagglutinin__InfluenzaA__AAK52911
MKTIIALSYILCLVFAQKLPGNDNSTATLCLGHHAVPNGTLVKTITNDQIEVTNATELVQSSSTGRICDSPHQILDGKNCTLIDALLGDPHCDGFQNKEWDLFVERSTAYSNCYPYDVPDYASLRSLVASSGTLEFTKEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 24 - protein, 566 aa, Artificial Sequence
  hemagglutinin__InfluenzaA__AAK52912
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERTKAYSNCYPYDVPDYASLRSLVASSGTLEFTNEGFNWTGVAQNGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 25 - protein, 566 aa, Artificial Sequence
  hemagglutinin__InfluenzaA__AAK71687
MKAILVVLLYTFTTANADTLCIGYHANNSTDTVDTVLEKNVTVTHSVNLLEDRHNGKLCKLRGVAPLHLGKCNIAGWLLGNPECESLFTASSWSYIVETSNSDNGTCYPGDFINYEELREQLSSVSSFERFEIFPETSSWPNHDTNRGVTAACPHAGANSFYRNLIWLAKKGDSYPKLSKSYINNKGKEVLVLWGIHHPPTSADQQSLYQNADAYVFVGSSRYSKKFKPEIATRPKVRGQAGRMNYYWTLVEPGDKITFEATGNLVVPRYAFAMKRNSESGIIISDISVHDCNTTCQTPKGAINTSLPFQNIHPVTIGECPKYVKSTKLRMATGLRNVPSIQSRGLFGAIAGFIEGGWTGMIDGWYGYHHQNEQGSGYAADLKSTQNAIDGITNKVNSVIEKMNTQFTVVGKEFNHLEKRIENLNKKVDDGFLDIWTYNAELLVLLENERTLDYHDSNVKNLYEKVRSQLKNNAKEIGNGCFEFYHKCDDTCMESVKNGTYDYPKYSEEAKLNREEIDGVKLESTRIYQILAIYSTVASSLVLVVSLGTISFWMCSNGSLQCRICI

SEQ ID NO: 26 - protein, 568 aa, Artificial Sequence
  hemagglutinin__InfluenzaA__AAS65618
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEVSLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAAAKESTQKAIDGVTNKVNSIIDKMNTQFEAVGREFNNLERRIENLNKKMEDGFLDVWTYNAELLVLMENERTLDFHDSNVKNLYDKVRLQLKDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 27 - protein, 567 aa, Artificial Sequence
  hemagglutinin__InfluenzaA__AAT38819
MNTQILAFIACMLIGTKGDKICLGHHAVANGTKVNTLTERGIEVVNATETVETVNIKKICTQGKRPTDLGQCGLLGTLIGPPQCDQFLEFDANLIIERREGTDVCYPGKFTNEESLRQILRGSGGIDKESMGFTYSGIRTNGATSACRRSGSSFYAEMKWLLSNSDNAAFPQMTKSYRNPRNKPALIIWGVHHSGSATEQTKLYGSGNKLITVGSSKYQQSFTPSPGARPQVNGQSGRIDFHWLLLDPNDTVTFTFNGAFIAPDRASFFRGESLGVQSDVPLDSGCEGDCFHSGGTIVSSLPFQNINPRTVGKCPRYVKQTSLLLATGMRNVPENPKQAYQKQMTRGLFGAIAGFIENGWEGLIDGWYGFRHQNAQGEGTAADYKSTQSAIDQITGKLNRLIDKTNQQFELIDNEFSEIEQQIGNVINWTRDSMTEVWSYNAELLVAMENQHTIDLADSEMNKLYERVRKQLRENAEEDGTGCFEIFHKCDDQCMESIRNNTYDHTQYRTESLQNRIQIDPVKLSSGYKDIILWFSFGASCFLLLAIAMGLVFICIKNGNMRCTICI

SEQ ID NO: 28 - protein, 568 aa, Artificial Sequence
  hemagglutinin__InfluenzaA__AAV32636
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 29 - protein, 568 aa, Artificial Sequence; identical to SEQ ID NO: 28
  hemagglutinin__InfluenzaA__AAV34704

SEQ ID NO: 30 - protein, 568 aa, Artificial Sequence
  hemagglutinin__InfluenzaA__AAV65826
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKANPVNDLCYPGDFNDYEELKHLLSRINHFEKIQIIPKSSWSSHEASLGVSSACPYQGKSSFFRNVVWLIKKNSTYPTIKRSYNNTNQEDLLVLGGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 31 - protein, 566 aa, Artificial Sequence
  hemagglutinin__InfluenzaA__AAX11505
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACERRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCDICI

SEQ ID NO: 32 - protein, 566 aa, Artificial Sequence
  hemagglutinin__InfluenzaA__AAX11525
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 33 - protein, 566 aa, Artificial Sequence; identical to SEQ ID NO: 32
  hemagglutinin__InfluenzaA__AAX11535

SEQ ID NO: 34 - protein, 566 aa, Artificial Sequence; identical to SEQ ID NO: 32
  hemagglutinin__InfluenzaA__AAX11545

SEQ ID NO: 35 - protein, 566 aa, Artificial Sequence; identical to SEQ ID NO: 31
  hemagglutinin__InfluenzaA__AAX11555

SEQ ID NO: 36 - protein, 566 aa, Artificial Sequence; identical to SEQ ID NO: 32
  hemagglutinin__InfluenzaA__AAX11565

SEQ ID NO: 37 - protein, 566 aa, Artificial Sequence
  hemagglutinin__InfluenzaA__AAX11585
MKTIIALSYILCLVFAQKLPGNDNSTATLCLGHHAVPNGTIVKTITNDQIEVTNATELVQISSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDNDQISLYAQASGRITVSTKRSQQTVIPNIGSRPRVRDVSSQISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 38 - protein, 566 aa, Artificial Sequence; identical to SEQ ID NO: 32
  hemagglutinin__InfluenzaA__AAX11605

SEQ ID NO: 39 - protein, 566 aa, Artificial Sequence; identical to SEQ ID NO: 32
  hemagglutinin__InfluenzaA__AAX11615

SEQ ID NO: 40 - protein, 566 aa, Artificial Sequence
  hemagglutinin__InfluenzaA__AAX11625
MKTIIALSYILCLVFAQKLPGNDNSTATLCLGHHAVPNGTLVKTITNDQIEVTNATELVQSSSTSRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSGPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQARGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 41 - protein, 566 aa, Artificial Sequence; identical to SEQ ID NO: 32
  hemagglutinin__InfluenzaA__AAX12731

SEQ ID NO: 42 - protein, 566 aa, Artificial Sequence
  hemagglutinin__InfluenzaA__AAX12741
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFATSCFLLCVALLGFIMWACQKGNIRCNICI

SEQ ID NO: 43 - protein, 566 aa, Artificial Sequence; identical to SEQ ID NO: 32
  hemagglutinin__InfluenzaA__AAX12751

SEQ ID NO: 44 - protein, 566 aa, Artificial Sequence
  hemagglutinin__InfluenzaA__AAX12761
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNVCIGSIRNGTYDHDVYRDEALNNRFQIKGVELKSGYKDWILWISFAISCFLLCIVLLGFIMWACQKGNIRCNICI

SEQ ID NO: 45 - protein, 566 aa, Artificial Sequence
  hemagglutinin__InfluenzaA__AAX12791
MKTIIALSYILCLVFAQKLPGNDNSMATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSGPWVRGVSSRISIYWTIVKPGDILLINSTGNLIAPRGYFKIRSGKSSIMRSDAPIDKCNSECITPNGSIPNDKPFQNVNRITYGLCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 46 - protein, 566 aa, Artificial Sequence
  hemagglutinin__InfluenzaA__AAX12801
MKTIIALSYILCLVFAQKFPGNDNSTATLCLGHHAVPNGTLVKTITNDQIEVTNATELVQSSSTDRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 47 - protein, 566 aa, Artificial Sequence
  hemagglutinin__InfluenzaA__AAX12811
MKTIIALSYILCLVFAQKLPGNDNSTATLCLGHHAVPNGTLVKTITNDQIEVTNATELVQSSSTSRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 48 - protein, 566 aa, Artificial Sequence
  hemagglutinin__InfluenzaA__AAX34061
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYIKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 49 - protein, 566 aa, Artificial Sequence
  hemagglutinin__InfluenzaA__AAX35821
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRKSNKSFFSRLNWLTHLKYKYPALNVTMPNNEKFDKLYIWGVHHPGTDNDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPERQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 50 - protein, 566 aa, Artificial Sequence; identical to SEQ ID NO: 31
  hemagglutinin__InfluenzaA__AAX35831

SEQ ID NO: 51 - protein, 566 aa, Artificial Sequence
  hemagglutinin__InfluenzaA__AAX35851
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 52 - protein, 566 aa, Artificial Sequence
  hemagglutinin__InfluenzaA__AAX35861
MKTIIALSYILCLVFAQKLPGNDNSTATLCLGHHAVPNGTLVKTITNDQIEVTNATELVQSSSTSRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRITVSTKRSQQTVIPNIGSGPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 53 - protein, 566 aa, Artificial Sequence
  hemagglutinin__InfluenzaA__AAX35871
MKTIIALSYILCLVFAQKLPGNDNSTATLCLGHHAVPNGTLVKTITNDQIEVTNATELVQSSSASRICDSPHQILDGENCTLIDALLGDPHCDGFQNKEWDLFVERSKAYSNCYPYDVPDYVSLRSLVASSGTLEFNNESFNWTGVAQNGTSFACKRRSDKSFFSRLNWLHQLKYKYPALNVTMPNNEKFDKLYIWGVHHPGTDSDQISLYAQASGRVTVSTKRSQQTVIPNIGSGPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 54 - protein, 566 aa, Artificial Sequence; identical to SEQ ID NO: 47
  hemagglutinin__InfluenzaA__AAX38237

SEQ ID NO: 55 - protein, 566 aa, Artificial Sequence
  hemagglutinin__InfluenzaA__AAX47515
MKAIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 56 - protein, 566 aa, Artificial Sequence
  hemagglutinin__InfluenzaA__AAX47525
MKTIIALSYILCLVFAQKLPGNDNSTATLCMGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSNKSFFSRLNWLHQLKYKYPALNVTMPNNEKFDKLYIWGVHHPDTDSNQISLYAQASGRVTVSTKRSQQTVIPNIGSGPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 57 - protein, 566 aa, Artificial Sequence; identical to SEQ ID NO: 47
  hemagglutinin__InfluenzaA__AAX47535

SEQ ID NO: 58 - protein, 566 aa, Artificial Sequence; identical to SEQ ID NO: 31
  hemagglutinin__InfluenzaA__AAX56380

SEQ ID NO: 59 - protein, 566 aa, Artificial Sequence; identical to SEQ ID NO: 31
  hemagglutinin__InfluenzaA__AAX56390

SEQ ID NO: 60 - protein, 566 aa, Artificial Sequence
  hemagglutinin__InfluenzaA__AAX56400
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACERRSNKSFFSRLNWLTHLKYKYPALNVTMPNNEKFDKLYIWGVHHPGTDSDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCDICI

SEQ ID NO: 61 - protein, 566 aa, Artificial Sequence; identical to SEQ ID NO: 31
  hemagglutinin__InfluenzaA__AAX56410

SEQ ID NO: 62 - protein, 566 aa, Artificial Sequence
  hemagglutinin__InfluenzaA__AAX56420
MKTIIALSYFLCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 63 - protein, 566 aa, Artificial Sequence
  hemagglutinin__InfluenzaA__AAX56430
MKTIIALSYILCLVFTQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACERRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCDICI

SEQ ID NO: 64 - protein, 566 aa, Artificial Sequence
  hemagglutinin__InfluenzaA__AAX56440
MKTIIALSYILCLVFAQKLPGNDNSTATLCLGHHAVPNGTLVKTITNDQIEVTNATELVQNSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDNDQISLYAQASGRVTVSTKRSQQTVIPNIGSGPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 65 - protein, 566 aa, Artificial Sequence; identical to SEQ ID NO: 47
  hemagglutinin__InfluenzaA__AAX56450

SEQ ID NO: 66 - protein, 566 aa, Artificial Sequence
  hemagglutinin__InfluenzaA__AAX56460
MKTIIALSYILCLVFAQKLPENDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITHGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 67 - protein, 566 aa, Artificial Sequence
  hemagglutinin__InfluenzaA__AAX56470
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKMRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 68 - protein, 566 aa, Artificial Sequence; identical to SEQ ID NO: 51
  hemagglutinin__InfluenzaA__AAX56480

SEQ ID NO: 69 - protein, 566 aa, Artificial Sequence
  hemagglutinin__InfluenzaA__AAX56510
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSKISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 70 - protein, 566 aa, Artificial Sequence; identical to SEQ ID NO: 47
  hemagglutinin__InfluenzaA__AAX56520

SEQ ID NO: 71 - protein, 566 aa, Artificial Sequence
  hemagglutinin__InfluenzaA__AAX56530
MKAKLLVLLCAFTATYADTICIGYHANNSTDTVDTVLEKNVTVTHSVNLLEDSHNGKLCRLKGTAPLQLGNCSIAGWILGNPECESLFSKESWSYIAETPNPKNGTCYPGYFADYEELREQLSSVSSFERFEIFPKDSSWPNHTVTKGVTASCSHNGKSSFYKNLLWLTEKNGLYPNLSKSYVNKKGKEVLVLWGVHHPSNMGDQRAIYHKENAYVSVLSSHYSRRFTPEIAKRPKVRDQEGRINYYWTLLEPGDTIIFEANGNLIAPWYAFALSRGFGSGIIISNASMGECDAKCQTPQGAINSSLPFQNVHPVTIGECPKYVRSTKLRMVTGLRNVPSIQSRGLFGAIAGFIEGGWTGMIDGWYGYHHQNEQGSGYAADQKSTQNAINGITNKVNSIIEKMNTQFTAVGKEFNKLEKRMENLNKKVDDGFLDIWTYNAELLVLLENERTLDFHDLNVKNLYEKVKNQLKNNAKEIGNGCFEFYHKCNNECMESVKNGTYDYPKYSKESKLNREKIDGVKLESMGVYQILAIYSTVASSLVLLVSLGAISFWMCSNGSLQCRICI

SEQ ID NO: 72 - protein, 566 aa, Artificial Sequence
  hemagglutinin__InfluenzaA__AAX56550
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 73 - protein, 566 aa, Artificial Sequence
  hemagglutinin__InfluenzaA__AAX56560
MKTIIALSYILCLVFAQKLPGNDNSTATLCLGHHAVPNGTIVKTITNDQIEVTNATELVQISSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 74 - protein, 566 aa, Artificial Sequence
  hemagglutinin__InfluenzaA__AAX56570
MKTIIALSYILCLVFAQKLPGNDNSTATLCLGHHAVPNGTLVKTITNDQIEVTNATELVQSSSTSRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSGISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 75 - protein, 566 aa, Artificial Sequence
  hemagglutinin__InfluenzaA__AAX56590
MKTIIALSYILCLVFAQKLPGNDNSTATLCLGHHAVPNGTLVKTITNDQIEVTNATELVQSSSTSRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 76 - protein, 566 aa, Artificial Sequence; identical to SEQ ID NO: 73
  hemagglutinin__InfluenzaA__AAX56600

SEQ ID NO: 77 - protein, 566 aa, Artificial Sequence
  hemagglutinin__InfluenzaA__AAX57644
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTVVKPGDILLINSTGNLIAPRGYFKMRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 78 - protein, 566 aa, Artificial Sequence; identical to SEQ ID NO: 31
  hemagglutinin__InfluenzaA__AAX57654

SEQ ID NO: 79 - protein, 566 aa, Artificial Sequence; identical to SEQ ID NO: 47
  hemagglutinin__InfluenzaA__AAX57664

SEQ ID NO: 80 - protein, 566 aa, Artificial Sequence
  hemagglutinin__InfluenzaA__AAX57684
MKTIIALSYILCLVFAQKLPGNDNSTATLCLGHHAVPNGTLVKTITNDQIEVTNATELVQSSSTSRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSGPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 81 - protein, 566 aa, Artificial Sequence; identical to SEQ ID NO: 51
  hemagglutinin__InfluenzaA__AAX57694

SEQ ID NO: 82 - protein, 566 aa, Artificial Sequence; identical to SEQ ID NO: 73
  hemagglutinin__InfluenzaA__AAX57704

SEQ ID NO: 83 - protein, 566 aa, Artificial Sequence; identical to SEQ ID NO: 51
  hemagglutinin__InfluenzaA__AAX57714

SEQ ID NO: 84 - protein, 566 aa, Artificial Sequence; identical to SEQ ID NO: 80
  hemagglutinin__InfluenzaA__AAX57733

SEQ ID NO: 85 - protein, 566 aa, Artificial Sequence
  hemagglutinin__InfluenzaA__AAX57734
MKTIIALSYILCLVFAQKLPGNDNSTATLCLGHHAVPNGTLVKTITNDQIEVTNATELVQSSSTSRICNSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSGPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 86 - protein, 566 aa, Artificial Sequence; identical to SEQ ID NO: 72
  hemagglutinin__InfluenzaA__AAX57744

SEQ ID NO: 87 - protein, 566 aa, Artificial Sequence; identical to SEQ ID NO: 72
  hemagglutinin__InfluenzaA__AAX57764

SEQ ID NO: 88 - protein, 566 aa, Artificial Sequence; identical to SEQ ID NO: 72
  hemagglutinin__InfluenzaA__AAX57774

SEQ ID NO: 89 - protein, 566 aa, Artificial Sequence
  hemagglutinin__InfluenzaA__AAX57784
MKTIIALSYILCLVFAQKLPGNDNSTATLCLGHHAVPNGTLVKTITNDQIEVTNATELVQNSSTSRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 90 - protein, 566 aa, Artificial Sequence
  hemagglutinin__InfluenzaA__AAX57794
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIHWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 91 - protein, 566 aa, Artificial Sequence; identical to SEQ ID NO: 72
  hemagglutinin__InfluenzaA__AAX57814

SEQ ID NO: 92 - protein, 566 aa, Artificial Sequence
  hemagglutinin__InfluenzaA__AAX57824
MKTIIALSYILCMVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 93 - protein, 566 aa, Artificial Sequence; identical to SEQ ID NO: 72
  hemagglutinin__InfluenzaA__AAX57834

SEQ ID NO: 94 - protein, 566 aa, Artificial Sequence; identical to SEQ ID NO: 72
  hemagglutinin__InfluenzaA__AAX57844

SEQ ID NO: 95 - protein, 566 aa, Artificial Sequence
  hemagglutinin__InfluenzaA__AAX57864
MKTIIALSYFLCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 96 - protein, 566 aa, Artificial Sequence; identical to SEQ ID NO: 72
  hemagglutinin__InfluenzaA__AAX57874

SEQ ID NO: 97 - protein, 566 aa, Artificial Sequence; identical to SEQ ID NO: 72
  hemagglutinin__InfluenzaA__AAX57884

SEQ ID NO: 98 - protein, 566 aa, Artificial Sequence
  hemagglutinin__InfluenzaA__AAX57894
MKTIIALSYILCLVFAQKLPVNDNSTATLCLGHHAVPNGTLVKTITNDHIEVTNATELVQSSSTGRICDSPHQVLDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 99 - protein, 566 aa, Artificial Sequence
  hemagglutinin__InfluenzaA__AAX57924
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSFACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 100 - protein, 566 aa, Artificial Sequence; identical to SEQ ID NO: 72
  hemagglutinin__InfluenzaA__AAX57934

SEQ ID NO: 101 - protein, 566 aa, Artificial Sequence
  hemagglutinin__InfluenzaA__AAX57944
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSGPWVRGVSSRISIYWTIVKPGDILLINSTGNLIAPRGYFKIRSGKSSIMRSDAPIGKCNSECITPNGSIPNGKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKSVELKSGYKDWILWISFAISCFLLCIVLLGFIMWACQKGNIRCNICI

SEQ ID NO: 102 - protein, 566 aa, Artificial Sequence
  hemagglutinin__InfluenzaA__AAX76623
MKTIIALSYILCLVFAQKLPGNDKSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELRSGYKDWILWISFAISCFLLCVASLGFIMWACQKGNIRCNICI

SEQ ID NO: 103 - protein, 566 aa, Artificial Sequence
  hemagglutinin__InfluenzaA__AAX76643
MKTIIALSYFLCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACERRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCDICI

SEQ ID NO: 104 - protein, 566 aa, Artificial Sequence
  hemagglutinin__InfluenzaA__AAX76653
MKTIIALSYFLCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACERRSNKSFFSRLNWLTHLKYKYPALNVTMPNNEKFDKLYIWGVHHPGTDSDQISLFAQASGRITVSTKRSQQTVIPNIGSGPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCDICI

SEQ ID NO: 105 - protein, 566 aa, Artificial Sequence
  hemagglutinin__InfluenzaA__AAX76663
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSGPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 106 - protein, 566 aa, Artificial Sequence
  hemagglutinin__InfluenzaA__AAX76673
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLERYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 107 - protein, 566 aa, Artificial Sequence
  hemagglutinin__InfluenzaA__AAX76683
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSVMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 108 - protein, 566 aa, Artificial Sequence; identical to SEQ ID NO: 72
  hemagglutinin__InfluenzaA__AAX76713

SEQ ID NO: 109 - protein, 566 aa, Artificial Sequence
  hemagglutinin__InfluenzaA__AAX76723
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEEFDKLYIWGVHHPSTDSDQISLYAQASGRVTVSTKRSQQTVIPNIGSRPWVRGVSSIISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 110 - protein, 566 aa, Artificial Sequence
  hemagglutinin__InfluenzaA__AAX76733
MKTIIALSYILCLVFAQKLPGNDNSTATLCLGHHAVPNGTLVKTITNDQIEVTNATELVQSSSTDRICDSPHQILDGGNCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKNKYPALNVAMPNNEKFDKLYIWGVHHPGTDSDQISLYAQASGRVTVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNYEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 111 - protein, 566 aa, Artificial Sequence
  hemagglutinin__InfluenzaA__AAX76743
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSNKSFFSRLNWLHQLKNKYPALNVAMPNNEKFDKLYIWGVHHPGTDSDQISLYAQASGRVTVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 112 - protein, 566 aa, Artificial Sequence
  hemagglutinin__InfluenzaA__AAX76763
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLIALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 113 - protein, 566 aa, Artificial Sequence; identical to SEQ ID NO: 32
  hemagglutinin__InfluenzaA__AAY18086

SEQ ID NO: 114 - protein, 566 aa, Artificial Sequence
  hemagglutinin__InfluenzaA__AAY18096
MKTIIALSCILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACERRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCDICI

SEQ ID NO: 115 - protein, 566 aa, Artificial Sequence; identical to SEQ ID NO: 47
  hemagglutinin__InfluenzaA__AAY18106

SEQ ID NO: 116 - protein, 566 aa, Artificial Sequence; identical to SEQ ID NO: 47
  hemagglutinin__InfluenzaA__AAY18116

SEQ ID NO: 117 - protein, 566 aa, Artificial Sequence
  hemagglutinin__InfluenzaA__AAY18126
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNEGFNWTGVTQNGTSSACKRKSNKSFFSRLNWLTHLKYKYPALNVTMPNNEKFDKLYIWGVHHPGTDNDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 118 - protein, 566 aa, Artificial Sequence
  hemagglutinin__InfluenzaA__AAY18136
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYIKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 119 - protein, 566 aa, Artificial Sequence; identical to SEQ ID NO: 72
  hemagglutinin__InfluenzaA__AAY18156

SEQ ID NO: 120 - protein, 566 aa, Artificial Sequence; identical to SEQ ID NO: 72
  hemagglutinin__InfluenzaA__AAY18176

SEQ ID NO: 121 - protein, 566 aa, Artificial Sequence; identical to SEQ ID NO: 72
  hemagglutinin__InfluenzaA__AAY18186

SEQ ID NO: 122 - protein, 566 aa, Artificial Sequence; identical to SEQ ID NO: 73
  hemagglutinin__InfluenzaA__AAY18564

SEQ ID NO: 123 - protein, 566 aa, Artificial Sequence
  hemagglutinin__InfluenzaA__AAY18585
MKTIIALSYILCLVFAQKLPENDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 124 - protein, 566 aa, Artificial Sequence; identical to SEQ ID NO: 32
  hemagglutinin__InfluenzaA__AAY18611

SEQ ID NO: 125 - protein, 566 aa, Artificial Sequence; identical to SEQ ID NO: 73
  hemagglutinin__InfluenzaA__AAY27843

SEQ ID NO: 126 - protein, 566 aa, Artificial Sequence; identical to SEQ ID NO: 32
  hemagglutinin__InfluenzaA__AAY27853

SEQ ID NO: 127 - protein, 566 aa, Artificial Sequence
  hemagglutinin__InfluenzaA__AAY27863
MKTIIALSYILCLVFAQKLPGNDNSTATLCLGHHAVPNGTIVKTITNDQIEVTNATELVQSSSTGGICDSPHQIIDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMISDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 128 - protein, 566 aa, Artificial Sequence; identical to SEQ ID NO: 51
  hemagglutinin__InfluenzaA__AAY27959

SEQ ID NO: 129 - protein, 566 aa, Artificial Sequence; identical to SEQ ID NO: 31
  hemagglutinin__InfluenzaA__AAY27994

SEQ ID NO: 130 - protein, 566 aa, Artificial Sequence; identical to SEQ ID NO: 31
  hemagglutinin__InfluenzaA__AAY28004

SEQ ID NO: 131 - protein, 566 aa, Artificial Sequence; identical to SEQ ID NO: 31
  hemagglutinin__InfluenzaA__AAY28265

SEQ ID NO: 132 - protein, 566 aa, Artificial Sequence
  hemagglutinin__InfluenzaA__AAY28275
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSVMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 133 - protein, 566 aa, Artificial Sequence
  hemagglutinin__InfluenzaA__AAY28285
MKTIIALSYILCLVFAQKLPGNDNSTATLCLGHHAVPNGTLVKTITNDQIEVTNATELVQNSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDNDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 134 - protein, 566 aa, Artificial Sequence
  hemagglutinin__InfluenzaA__AAY28295
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGKITVSTKRSQQTVIPNIGSRPRVRDVSSRISIYWTIVKPGDILLINSTGNLIAPRGYFKIQSGKSSIMRSDAPIGKCNSECITPNGSIPNDKPFQNVNRITYGACPRYVKQKTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 135 - protein, 566 aa, Artificial Sequence
  hemagglutinin__InfluenzaA__AAY28305
MKAIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSGPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 136 - protein, 566 aa, Artificial Sequence
  hemagglutinin__InfluenzaA__AAY28325
MKTIIALSYILCLVFAQKLPGNDNSTATLCLGHHAVPNGTLVKTITNDQIEVTNATELVQSSSTSRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVIVSTKRSQQTVIPNIGSGPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFAEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 137 - protein, 566 aa, Artificial Sequence
  hemagglutinin__InfluenzaA__AAY28335
MKTIIALSYILCLVSAQKLPGNDNSTATLCLGHHAVPNGTLVKTITNDQIEVTNATELVQSSSTSRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKVDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 138 - protein, 566 aa, Artificial Sequence; identical to SEQ ID NO: 32
  hemagglutinin__InfluenzaA__AAY28345

SEQ ID NO: 139 - protein, 566 aa, Artificial Sequence; identical to SEQ ID NO: 72
  hemagglutinin__InfluenzaA__AAY28355

SEQ ID NO: 140 - protein, 566 aa, Artificial Sequence
  hemagglutinin__InfluenzaA__AAY28363
MKTIIALSYILCMVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPSLNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 141 - protein, 566 aa, Artificial Sequence; identical to SEQ ID NO: 72
  hemagglutinin__InfluenzaA__AAY28375

SEQ ID NO: 142 - protein, 566 aa, Artificial Sequence; identical to SEQ ID NO: 32
  hemagglutinin__InfluenzaA__AAY28385

SEQ ID NO: 143 - protein, 566 aa, Artificial Sequence
  hemagglutinin__InfluenzaA__AAY28395
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQINLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYIKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 144 - protein, 566 aa, Artificial Sequence
  hemagglutinin__InfluenzaA__AAY28405
MKTIIALSYILCLVFAQKLPGNDNSTATLCLGHHAVPNGTLVKTITNDQIEVTNATELVQISSTGRICDNPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICV

SEQ ID NO: 145 - protein, 566 aa, Artificial Sequence; identical to SEQ ID NO: 32
  hemagglutinin__InfluenzaA__AAY28486

SEQ ID NO: 146 - protein, 566 aa, Artificial Sequence; identical to SEQ ID NO: 32
  hemagglutinin__InfluenzaA__AAY28521

SEQ ID NO: 147 - protein, 566 aa, Artificial Sequence; identical to SEQ ID NO: 31
  hemagglutinin__InfluenzaA__AAY28531

SEQ ID NO: 148 - protein, 566 aa, Artificial Sequence; identical to SEQ ID NO: 32
  hemagglutinin__InfluenzaA__AAY28541

SEQ ID NO: 149 - protein, 566 aa, Artificial Sequence
  hemagglutinin__InfluenzaA__AAY28551
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSGPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 150 - protein, 566 aa, Artificial Sequence; identical to SEQ ID NO: 32
  hemagglutinin__InfluenzaA__AAY28561

SEQ ID NO: 151 - protein, 566 aa, Artificial Sequence; identical to SEQ ID NO: 47
  hemagglutinin__InfluenzaA__AAY28581

SEQ ID NO: 152 - protein, 566 aa, Artificial Sequence
  hemagglutinin__InfluenzaA__AAY28591
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALDVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 153 - protein, 566 aa, Artificial Sequence; identical to SEQ ID NO: 72
  hemagglutinin__InfluenzaA__AAY28608

SEQ ID NO: 154 - protein, 566 aa, Artificial Sequence
  hemagglutinin__InfluenzaA__AAY28618
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRMSIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIESIRNGTYDHDVYRDEALNNRFQIKGVELKSGYKDWILWISFAISCFLLCVALLGFIMWACQKGNIRCNICI

SEQ ID NO: 155 - protein, 566 aa, Artificial Sequence; identical to SEQ ID NO: 47
  hemagglutinin__InfluenzaA__AAY28638

SEQ ID NO: 156 - protein, 566 aa, Artificial Sequence
  hemagglutinin__InfluenzaA__AAY28648
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSGPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 157 - protein, 566 aa, Artificial Sequence
  hemagglutinin__InfluenzaA__AAY44610
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERNKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 158 - protein, 566 aa, Artificial Sequence
  hemagglutinin__InfluenzaA__AAY44620
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINEKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 159 - protein, 566 aa, Artificial Sequence; identical to SEQ ID NO: 80
  hemagglutinin__InfluenzaA__AAY44621

SEQ ID NO: 160 - protein, 566 aa, Artificial Sequence; identical to SEQ ID NO: 47
  hemagglutinin__InfluenzaA__AAY44631

SEQ ID NO: 161 - protein, 566 aa, Artificial Sequence
  hemagglutinin__InfluenzaA__AAY44641
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIGLLGFIMWACQKGNIRCNICI

SEQ ID NO: 162 - protein, 566 aa, Artificial Sequence
  hemagglutinin__InfluenzaA__AAY44651
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWERGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLKENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 163 - protein, 566 aa, Artificial Sequence
  hemagglutinin__InfluenzaA__AAY44755
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRGQQTVIPNIGSRPWVRGVSSIISIYWTIVKPGDILLINSTGNLIAPRGYFKIRSGKSSVMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 164 - protein, 566 aa, Artificial Sequence
  hemagglutinin__InfluenzaA__AAY44775
MKTIIALSYILCLVFAQKLPVNDNSTATLCLGHHAVPNGTLVKTITNDHIEVTNATELVQSSSTGRICDSPHQILDGENCTLIDALLGDPHCDGFQDKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQTTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 165 - protein, 566 aa, Artificial Sequence; identical to SEQ ID NO: 72
  hemagglutinin__InfluenzaA__AAY44785

SEQ ID NO: 166 - protein, 566 aa, Artificial Sequence
  hemagglutinin__InfluenzaA__AAY44795
MKTIIALSYILCLVFAQKLPVNDNSTATLCLGHHAVPNGTLVKTITNDHIEVTNATELVQSSSTGRICDSTHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 167 - protein, 566 aa, Artificial Sequence
  hemagglutinin__InfluenzaA__AAY44796
MKTIIALSYTLCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYIKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 168 - protein, 566 aa, Artificial Sequence; identical to SEQ ID NO: 47
  hemagglutinin__InfluenzaA__AAY44896

SEQ ID NO: 169 - protein, 566 aa, Artificial Sequence
  hemagglutinin__InfluenzaA__AAY44906
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPERQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 170 - protein, 566 aa, Artificial Sequence
  hemagglutinin__InfluenzaA__AAY46371
MKTIIALSYILCLVFAQKLPGNDNSTATLCLGHHAVPNGTLVKTITSDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSFACKRRSIKSFFSRLNWLHQLKYKYPALNVTMPNNDKFDKLYIWGVHHPGTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNGKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFTEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFATSCFLLCVVLLGFIMWACQKGNIRCNICI

SEQ ID NO: 171 - protein, 566 aa, Artificial Sequence; identical to SEQ ID NO: 32
  hemagglutinin__InfluenzaA__AAY46381

SEQ ID NO: 172 - protein, 566 aa, Artificial Sequence
  hemagglutinin__InfluenzaA__AAY46391
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSIISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 173 - protein, 566 aa, Artificial Sequence
  hemagglutinin__InfluenzaA__AAY46426
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNKKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNIPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 174 - protein, 566 aa, Artificial Sequence
  hemagglutinin__InfluenzaA__AAY47013
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSGPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIKKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 175 - protein, 566 aa, Artificial Sequence
  hemagglutinin__InfluenzaA__AAY47023
MKTIIALSYILCLVFAQKLPGNDNSTATLCLGHHAVPNGTLVKTITNDQIEVTNATELVQSSSTSRICDSPHQILDGENCTLIDALLGDPHCDGFQNKEWGLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQARGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 176 - protein, 566 aa, Artificial Sequence; identical to SEQ ID NO: 172
  hemagglutinin__InfluenzaA__AAY47052

SEQ ID NO: 177 - protein, 566 aa, Artificial Sequence
  hemagglutinin__InfluenzaA__AAY47075
MKTIIALSYILCLVFAQKLPGNDNSMATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSNKSFFSRLNWLHQLKNKYPALNVTMPNNEKFDKLYIWGVHHPGTDSDQISLYAQASGRVTVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 178 - protein, 566 aa, Artificial Sequence
  hemagglutinin__InfluenzaA__AAY47085
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKYKYPALNVTMPNNEKFDKLYIWGVHHPGTDSDQISLYAQASGRITVSTKRSQQTVIPNVGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIESIRNGTYDHDVYRDEALNNRFQIKGVELKSGYKDWILWISFAISCFLLCVALLGFIMWACQKGNIRCNICI

SEQ ID NO: 179 - protein, 566 aa, Artificial Sequence
  hemagglutinin__InfluenzaA__AAY58320
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 180 - protein, 566 aa, Artificial Sequence
  hemagglutinin__InfluenzaA__AAY59035
MKTIIALSYILCLVFAQKLTVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 181 - protein, 566 aa, Artificial Sequence
  hemagglutinin__InfluenzaA__AAY64202
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACERRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQNRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCDICI

SEQ ID NO: 182 - protein, 566 aa, Artificial Sequence
  hemagglutinin__InfluenzaA__AAY64212
MKTIIALSYILCLVFAQKIPVNDNSTATLCLGHHAVPNGTLVKTITNEHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNALIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 183 - protein, 566 aa, Artificial Sequence
  hemagglutinin__InfluenzaA__AAY64222
MKTIIALSYILCLVFAQKLPGNDNSTATLCLGHHAVPNGTLVKTITNDQIEVTNATELVQSSSIGRICDSPHQILDGENCTLIDALLGDPHCDGFQNKEWDLFVERSKAYSNCYPYDVPDYVSLRSLVASSGTLEFNNESFNWTGVAQNGTSSSCKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 184 - protein, 566 aa, Artificial Sequence
  hemagglutinin__InfluenzaA__AAY64262
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACMGSIRNGTYDHDVYRDEALNNRFQIKGVELKSGYKDWILWISFAISCFLLCVVLLGFIMWACQKGNIRCNICI

SEQ ID NO: 185 - protein, 566 aa, Artificial Sequence
  hemagglutinin__InfluenzaA__AAY64272
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIESIRNGTYDHDVYRDEALNNRFQIKGVELKSGYKDWILWISFAISCFLLCVALLGFIMWACQKGNIRCNICI

SEQ ID NO: 186 - protein, 566 aa, Artificial Sequence
  hemagglutinin__InfluenzaA__AAY64282
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 187 - protein, 566 aa, Artificial Sequence
  hemagglutinin__InfluenzaA__AAY64292
MKTIIALSYILCLVFAQKLPGNDNSTATLCLGHHAVPNGTLVKTITNDQIEVTNATELVQSSSTDKICDSPHQILDGGNCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKNKYPALNVTMPNNEKFDKLYIWGVHHPGTDSDQISLYAQASGRVTVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 188 - protein, 566 aa, Artificial Sequence
  hemagglutinin__InfluenzaA__AAY64302
MKTIIALSYILCLVFAQKLPGNDNSTATLCLGHHAVPNGTLVKTITSDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSFACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMKSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFTEVEGRIQDLEKYVEDTKIDLWSYNAELLVALENQHTIDLTDSEMNKLFERTRKQLRENAEDMGNGCFKIYHKCDNVCIGSIRNGTYDHDVYRDEALNNRFQIKGVELKSGYKDWILWISFATSCFLLCVVLLGFIMWACQKGNIRCNICI

SEQ ID NO: 189 - protein, 566 aa, Artificial Sequence; identical to SEQ ID NO: 183
  hemagglutinin__InfluenzaA__AAY64312

SEQ ID NO: 190 - protein, 566 aa, Artificial Sequence; identical to SEQ ID NO: 186
  hemagglutinin__InfluenzaA__AAY64322

SEQ ID NO: 191 - protein, 566 aa, Artificial Sequence
  hemagglutinin__InfluenzaA__AAY64332
MKTIIALSYILCLVFTQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKFKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCDICI

SEQ ID NO: 192 - protein, 566 aa, Artificial Sequence
  hemagglutinin__InfluenzaA__AAY64342
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFATSCFLLCVVLLGFIMWACQKGNIRCNICI

SEQ ID NO: 193 - protein, 566 aa, Artificial Sequence; identical to SEQ ID NO: 32
  hemagglutinin__InfluenzaA__AAY64352

SEQ ID NO: 194 - protein, 566 aa, Artificial Sequence
  hemagglutinin__InfluenzaA__AAY64362
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYIKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 195 - protein, 566 aa, Artificial Sequence; identical to SEQ ID NO: 186
  hemagglutinin__InfluenzaA__AAY64382

SEQ ID NO: 196 - protein, 566 aa, Artificial Sequence
  hemagglutinin__InfluenzaA__AAY64392
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKYKYPALNVTMPNNEKFDKLYIWGVHHPGTDNDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 197 - protein, 566 aa, Artificial Sequence; identical to SEQ ID NO: 188
  hemagglutinin__InfluenzaA__AAY64402

SEQ ID NO: 198 - protein, 566 aa, Artificial Sequence; identical to SEQ ID NO: 186
  hemagglutinin__InfluenzaA__AAY98037

SEQ ID NO: 199 - protein, 566 aa, Artificial Sequence; identical to SEQ ID NO: 186
  hemagglutinin__InfluenzaA__AAY98047

SEQ ID NO: 200 - protein, 566 aa, Artificial Sequence; identical to SEQ ID NO: 47
  hemagglutinin__InfluenzaA__AAY98057

SEQ ID NO: 201 - protein, 566 aa, Artificial Sequence
  hemagglutinin__InfluenzaA__AAY98067
MKTIIALSYILCLVFAQELPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSGPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 202 - protein, 566 aa, Artificial Sequence
  hemagglutinin__InfluenzaA__AAY98077
MKTIIALSYILCLVFAQKLPGNDNSTATLCLGHHAVPNGTLVKTITNDQIEVTNATELVQSSSASRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 203 - protein, 566 aa, Artificial Sequence
  hemagglutinin__InfluenzaA__AAY98087
MKTIIALSYILCLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 204 - protein, 566 aa, Artificial Sequence; identical to SEQ ID NO: 186
  hemagglutinin__InfluenzaA__AAY98097

SEQ ID NO: 205 - protein, 566 aa, Artificial Sequence; identical to SEQ ID NO: 186
  hemagglutinin__InfluenzaA__AAY98107

SEQ ID NO: 206 - protein, 566 aa, Artificial Sequence
  hemagglutinin__InfluenzaA__AAY98117
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRGSNKSFFSRLNWLHQLKYKYPALNVTMPNNEKFEKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 207 - protein, 566 aa, Artificial Sequence; identical to SEQ ID NO: 186
  hemagglutinin__InfluenzaA__AAY98147

SEQ ID NO: 208 - protein, 566 aa, Artificial Sequence; identical to SEQ ID NO: 186
  hemagglutinin__InfluenzaA__AAY98157

SEQ ID NO: 209 - protein, 566 aa, Artificial Sequence
  hemagglutinin__InfluenzaA__AAY98167
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTQRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 210 - protein, 566 aa, Artificial Sequence
  hemagglutinin__InfluenzaA__AAY98177
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAGLLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 211 - protein, 566 aa, Artificial Sequence
  hemagglutinin__InfluenzaA__AAY98195
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 212 - protein, 566 aa, Artificial Sequence; identical to SEQ ID NO: 186
  hemagglutinin__InfluenzaA__AAY98207

SEQ ID NO: 213 - protein, 566 aa, Artificial Sequence; identical to SEQ ID NO: 188
  hemagglutinin__InfluenzaA__AAY98217

SEQ ID NO: 214 - protein, 566 aa, Artificial Sequence; identical to SEQ ID NO: 186
  hemagglutinin__InfluenzaA__AAY98227

SEQ ID NO: 215 - protein, 566 aa, Artificial Sequence; identical to SEQ ID NO: 186
  hemagglutinin__InfluenzaA__AAY98237

SEQ ID NO: 216 - protein, 566 aa, Artificial Sequence
  hemagglutinin__InfluenzaA__AAY98247
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYIKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 217 - protein, 566 aa, Artificial Sequence; identical to SEQ ID NO: 186
  hemagglutinin__InfluenzaA__AAY98319

SEQ ID NO: 218 - protein, 566 aa, Artificial Sequence
  hemagglutinin__InfluenzaA__AAY98329
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQALGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHLNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 219 - protein, 566 aa, Artificial Sequence; identical to SEQ ID NO: 186
  hemagglutinin__InfluenzaA__AAY98339

SEQ ID NO: 220 - protein, 566 aa, Artificial Sequence; identical to SEQ ID NO: 186
  hemagglutinin__InfluenzaA__AAY98353

SEQ ID NO: 221 - protein, 566 aa, Artificial Sequence
  hemagglutinin__InfluenzaA__AAY98366
MKTIIALSYILCLVFAQKLPGNDNSTATLCLGHHAVPNGTLVKTITSDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSFACKRRSIKSFFSRLNWLHQLKYKYPALNVTMPNNDKFDKLYIWGVHHPGTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFTEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFATSCFLLCVVLLGFIMWACQKGNIRCNICI

SEQ ID NO: 222 - protein, 566 aa, Artificial Sequence
  hemagglutinin__InfluenzaA__AAY98376
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 223 - protein, 566 aa, Artificial Sequence
  hemagglutinin__InfluenzaA__AAY98386
MKTIIALSYILCLVFAQKLPGNDNSTATLCLGHHAVPNGTLVKTITNDQIEVTNATELVQSSSTGRICDSPHQILDGGNCTLIDALLGDPHCDGFQNKEWDLFVERSKVYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 224 - protein, 566 aa, Artificial Sequence; identical to SEQ ID NO: 186
  hemagglutinin__InfluenzaA__AAY98396

SEQ ID NO: 225 - protein, 566 aa, Artificial Sequence; identical to SEQ ID NO: 186
  hemagglutinin__InfluenzaA__AAY98406

SEQ ID NO: 226 - protein, 566 aa, Artificial Sequence
  hemagglutinin__InfluenzaA__AAZ32946
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSEAYSNCYPYDVPDYASLRSLIASSGTLEFTNESFNWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNINRITYGTCPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 227 - protein, 566 aa, Artificial Sequence
  hemagglutinin__InfluenzaA__AAZ32949
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSEAYSNCYPYDVPDYASLRSLIASSGTLEFTNESFNWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNINRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 228 - protein, 566 aa, Artificial Sequence
  hemagglutinin__InfluenzaA__AAZ32950
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSEAYSNCYPYDVPDYASLRSLIASSGTLEFTNESFNWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNINRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKEQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 229 - protein, 566 aa, Artificial Sequence
  hemagglutinin__InfluenzaA__AAZ32951
MKTIIALSYILCLVFAQKIPGNDNSTATLCLGHHAVPNGTLVKTITNDQIEVTNATELVQSSSTGGICDSPHQILDGENCTLIDALLGDPHCDGFQNKKWDLFVERSKAYSNCYPYDVPDYASLRSLVASSGTLEFNNESFNWTGVTQNGTSSACKRRSNKSFFSRLNWLHQLKYKYPALNVAMPNNEKFDKLYIWGVHHPGTDSDQISLYAQASGRITVSTKRSQQTVIPNIGSRPRVRDISSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 230 - protein, 566 aa, Artificial Sequence
  hemagglutinin__InfluenzaA__AAZ32952
MKTIIALSYILCLVFAQKIPGNDNSTATLCLGHHAVPNGTLVKTITNDQIEVTNATELVQSSSTGGICDSPHQILDGENCTLIDALLGDPHCDGFQNKKWDLFVERSKAYSNCYPYDVPDYASLRSLVASSGTLEFNNESFNWTGVTQNGTSSACKRRSNKSFFSRLNWLHQLKYKYPALNVAMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNKITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 231 - protein, 566 aa, Artificial Sequence
  hemagglutinin__InfluenzaA__AAZ32953
MKTIIALSYILCLVFAQKIPGNDNSTATLCLGHHAVPNGTLVKTITNDQIEVTNATELVQSSSTGGICDSPHQILDGENCTLIDALLGDPHCDGFQNKKWDLFVERSKAYSNCYPYDVPDYASLRSLVASSGTLEFNNESFNWTGVTQNGTSSACKRRSNKSFFSRLNWLHQLKYKYPALNVAMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 232 - protein, 566 aa, Artificial Sequence
  hemagglutinin__InfluenzaA__AAZ38462
MKTIIALSYILCLVFAQKLPGNDNSTATLCLGHHAVPNGTLVKTITSDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSFACKRRSIKSFFSRLNWLHQLKYKYPALNVTMPNNDKFDKLYIWGVHYPGTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNGKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFTEVEGRIQDLEKYVEDTKIDLWSYNAELLVALENQHTIDLTDSEMNKLFERTRRQLRENAEDMGNGCFKIYHKCDNACIGSIRNGTYDHDVYRDEALNNRFQIKGVELKSGYKDWILWISFATSCFLLCVVLLGFIMWACQKGNIRCNICI

SEQ ID NO: 233 - protein, 566 aa, Artificial Sequence
  hemagglutinin__InfluenzaA__AAZ38473
MKTIIALSYILCLVFAQKLPGNDNSTATLCLGHHAVPNGTLVKTITSDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSFTCKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMKSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFTEVEGRIQDLEKYVEDTKIDLWSYNAELLVALENQHTIDLTDSEMNKLFERTRKQLRENAEDMGNGCFKIYHKCDNVCIGSIRNGTYDHDVYRDEALNNRFQIKGVELKSGYKDWILWISFATSCFLLCVVLLGFIMWACQKGNIRCNICI

SEQ ID NO: 234 - protein, 566 aa, Artificial Sequence; identical to SEQ ID NO: 186
  hemagglutinin__InfluenzaA__AAZ38484

SEQ ID NO: 235 - protein, 566 aa, Artificial Sequence
  hemagglutinin__InfluenzaA__AAZ38495
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSKISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 236 - protein, 566 aa, Artificial Sequence
  hemagglutinin__InfluenzaA__AAZ38517
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCNNACIGSIRNGTYDHDVYRDEALNNRFQIKGVELKSGYKDWILWISFAISCFLLCVVLLGFIMWACQKGNIRCNICI

SEQ ID NO: 237 - protein, 566 aa, Artificial Sequence
  hemagglutinin__InfluenzaA__AAZ38539
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSKISIYWTIVKPGDIFLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 238 - protein, 566 aa, Artificial Sequence; identical to SEQ ID NO: 186
  hemagglutinin__InfluenzaA__AAZ38561

SEQ ID NO: 239 - protein, 566 aa, Artificial Sequence
  hemagglutinin__InfluenzaA__AAZ38583
MKTIIALSYILCLVFAQKIPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTNNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWIIWISFAISCFLLCVALLGFIMWACQKGNIRCNICI

SEQ ID NO: 240 - protein, 566 aa, Artificial Sequence
  hemagglutinin__InfluenzaA__AAZ38594
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNSSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 241 - protein, 566 aa, Artificial Sequence
  hemagglutinin__InfluenzaA__AAZ38605
MKTIIALSYILCLVFTQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPSIGSRPRIRDVPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 242 - protein, 565 aa, Artificial Sequence
  hemagglutinin__InfluenzaA__AAZ38627
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMATGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 243 - protein, 566 aa, Artificial Sequence
  hemagglutinin__InfluenzaA__AAZ38638
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 244 - protein, 566 aa, Artificial Sequence; identical to SEQ ID NO: 243
  hemagglutinin__InfluenzaA__AAZ38650

SEQ ID NO: 245 - protein, 566 aa, Artificial Sequence
  hemagglutinin__InfluenzaA__AAZ43370
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFIERSKAFSNCYPYDVPDYASLRSLVASSGTLEFINEGFNWTGVTQSGGSYACKRGSVKSFFSRLNWLYESEYKYPALNVTMPNNGKFDKLYIWGVHHPSTEKEQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 246 - protein, 566 aa, Artificial Sequence; identical to SEQ ID NO: 118
  hemagglutinin__InfluenzaA__AAZ43394

SEQ ID NO: 247 - protein, 566 aa, Artificial Sequence
  hemagglutinin__InfluenzaA__AAZ43405
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 248 - protein, 566 aa, Artificial Sequence; identical to SEQ ID NO: 47
  hemagglutinin__InfluenzaA__AAZ74352

SEQ ID NO: 249 - protein, 566 aa, Artificial Sequence; identical to SEQ ID NO: 203
  hemagglutinin__InfluenzaA__AAZ74363

SEQ ID NO: 250 - protein, 565 aa, Artificial Sequence
  hemagglutinin__InfluenzaA__AAZ74374
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGACYPGYFADYEELREQLSSVSSFERFEIFPKESSWPNHTVTGVSASCSHNGKSSFYRNLLWLTGKNGLYPNLSKSYANNKEKEVLILWGVHHPPNIGDQRTLYHTENAYVSVVSSHYGRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDVWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCSNGSLQCRICI

SEQ ID NO: 251 - protein, 566 aa, Artificial Sequence
  hemagglutinin__InfluenzaA__AAZ74397
MNTIIALSYILCLVFAQKLPGNDNSTATLCLGHHAVPNGTLVKTITSDQIEVTNATELVQSSSTGRICDSPHRILDGENCTLIDALLGDPLCDGFQNKEWDLFVERSKAYSNCYPYDVPDYASLRSLVASSGTLEFNNESFNWTGVAQNGTSFACKRRSIKSFFSRLNWLHQLKYKYPALNVTMPNNDKFDKLYIWGVHHPGTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNGKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFTEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFATSCFLLCVVLLGFIMWACQKGNIRCNICI

SEQ ID NO: 252 - protein, 566 aa, Artificial Sequence
  hemagglutinin__InfluenzaA__AAZ74408
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYNHDVYRDEALNNRFQIKGVELKSGYKDWILWISFAISCFLLCVVLLGFIMWACQKGNIRCNICI

SEQ ID NO: 253 - protein, 566 aa, Artificial Sequence; identical to SEQ ID NO: 186
  hemagglutinin__InfluenzaA__AAZ74430

SEQ ID NO: 254 - protein, 566 aa, Artificial Sequence; identical to SEQ ID NO: 243
  hemagglutinin__InfluenzaA__AAZ74441

SEQ ID NO: 255 - protein, 566 aa, Artificial Sequence
  hemagglutinin__InfluenzaA__AAZ74452
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFIERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 256 - protein, 566 aa, Artificial Sequence
  hemagglutinin__InfluenzaA__AAZ74463
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 257 - protein, 566 aa, Artificial Sequence
  hemagglutinin__InfluenzaA__AAZ74474
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKKRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 258 - protein, 566 aa, Artificial Sequence; identical to SEQ ID NO: 255
  hemagglutinin__InfluenzaA__AAZ74485

SEQ ID NO: 259 - protein, 566 aa, Artificial Sequence; identical to SEQ ID NO: 256
  hemagglutinin__InfluenzaA__AAZ74496

SEQ ID NO: 260 - protein, 566 aa, Artificial Sequence; identical to SEQ ID NO: 255
  hemagglutinin__InfluenzaA__AAZ74507

SEQ ID NO: 261 - protein, 566 aa, Artificial Sequence; identical to SEQ ID NO: 256
  hemagglutinin__InfluenzaA__AAZ74518

SEQ ID NO: 262 - protein, 566 aa, Artificial Sequence; identical to SEQ ID NO: 255
  hemagglutinin__InfluenzaA__AAZ74529

SEQ ID NO: 263 - protein, 566 aa, Artificial Sequence
  hemagglutinin__InfluenzaA__AAZ74551
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTLDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 264 - protein, 566 aa, Artificial Sequence; identical to SEQ ID NO: 186
  hemagglutinin__InfluenzaA__AAZ74562

SEQ ID NO: 265 - protein, 566 aa, Artificial Sequence
  hemagglutinin__InfluenzaA__AAZ74573
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFIERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTGNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 266 - protein, 566 aa, Artificial Sequence
  hemagglutinin__InfluenzaA__AAZ74584
MKTIIALSYILCLVFAQKLPGNDNSTATLCLGHHAVPNGTLVKTIANDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPAQNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 267 - protein, 566 aa, Artificial Sequence; identical to SEQ ID NO: 243
  hemagglutinin__InfluenzaA__AAZ74595

SEQ ID NO: 268 - protein, 566 aa, Artificial Sequence
  hemagglutinin__InfluenzaA__AAZ74617
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSKISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 269 - protein, 566 aa, Artificial Sequence; identical to SEQ ID NO: 47
  hemagglutinin__InfluenzaA__AAZ79505

SEQ ID NO: 270 - protein, 566 aa, Artificial Sequence
  hemagglutinin__InfluenzaA__AAZ79516
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCLKIYHKCDNACIGSIRNGTYDHDVYRDEALNNRFQIKGVELKSGYKDWILWISFAISCFLLCVVLLGFIMWACQKGNIRCNICI

SEQ ID NO: 271 - protein, 566 aa, Artificial Sequence
  hemagglutinin__InfluenzaA__AAZ79527
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPERQTRGIFGAIAGFIENGWEGMVDGWYGFRHQNSEGTGQAADLKSTQAAINQINGKLNRLIGKTNEKFHQIEKEFSEVEGRIQDLERYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 272 - protein, 565 aa, Artificial Sequence
  hemagglutinin__InfluenzaA__AAZ79549
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGACYPGYFADYEELREQLSSVSSFERFEIFPKESSWPNHTVTGVSASCSHNGKSSFYRNLLWLTGKNGLYPNLSKSYANNKEKEVLILWGVHHPPNIGNQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCSNGSLQCRICI

SEQ ID NO: 273 - protein, 566 aa, Artificial Sequence
  hemagglutinin__InfluenzaA__AAZ79560
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLKSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 274 - protein, 566 aa, Artificial Sequence
  hemagglutinin__InfluenzaA__AAZ79571
MKTIIALSYILCLVFAQKLPGNDNSTATLCLGHHAVPNGTLVKTITNDQIEVTNATELVQSSSTGRICDSPHQILDGENCTLIDALLGDPRCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 275 - protein, 566 aa, Artificial Sequence
  hemagglutinin__InfluenzaA__AAZ79582
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSGPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 276 - protein, 565 aa, Artificial Sequence
  hemagglutinin__InfluenzaA__AAZ79604
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINRITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 277 - protein, 566 aa, Artificial Sequence
  hemagglutinin__InfluenzaA__AAZ79615
MKTIIALSYILCLVFAQKIPGNDNSTATLCVGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 278 - protein, 566 aa, Artificial Sequence
  hemagglutinin__InfluenzaA__AAZ79627
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNSSFFSRLNWLTHLKFKYPALKVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 279 - protein, 566 aa, Artificial Sequence; identical to SEQ ID NO: 256
  hemagglutinin__InfluenzaA__AAZ79941

SEQ ID NO: 280 - protein, 566 aa, Artificial Sequence; identical to SEQ ID NO: 255
  hemagglutinin__InfluenzaA__AAZ79944

SEQ ID NO: 281 - protein, 566 aa, Artificial Sequence
  hemagglutinin__InfluenzaA__AAZ79963
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPSIGSRPRIRDVPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 282 - protein, 566 aa, Artificial Sequence
  hemagglutinin__InfluenzaA__AAZ79974
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTNNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 283 - protein, 566 aa, Artificial Sequence; identical to SEQ ID NO: 255
  hemagglutinin__InfluenzaA__AAZ79996

SEQ ID NO: 284 - protein, 566 aa, Artificial Sequence
  hemagglutinin__InfluenzaA__AAZ80007
MKTIIALSHIFCLVLGQYLPGNDNSTATLCLGHHAVPNGTLVKTITNDQIEVTNATELVQSSSTGKICNNPHRILDGIDCTLIDALLGDPHCDGFQNETWDLFVERSKAFSNCYPYDVPDYASLRSLVASSGTLEFITEGFTWTGVTQNGGSNACKRGPGSGFFSRLNWLTKSESTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 285 - protein, 566 aa, Artificial Sequence; identical to SEQ ID NO: 256
  hemagglutinin__InfluenzaA__AAZ80017

SEQ ID NO: 286 - protein, 566 aa, Artificial Sequence
  hemagglutinin__InfluenzaA__AAZ80030
MKTIIALSYILCLVFAQELPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQTSLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 287 - protein, 566 aa, Artificial Sequence
  hemagglutinin__InfluenzaA__AAZ83242
MKTIIALSYILCLVFAQKLPGNDNSTATLCLGHHAVPNGTIVKTITNDQIEVTNATELVQSSSTGEICDSPHQILDGENCTLIDALLGDPQCDGFQNKKWDLFVERNKAYSNCYPYDVPDYASLRSLVASSGTLEFNNESFNWTGVTQNGTSSACKRRSNKSFFSRLNWLTHLKYKYPALNVTMPNNEKFDKLYIWGVHHPGTDSDQINLYAQASGRITVSTKRSQQTVIPNIGYRPRVRDVPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 288 - protein, 566 aa, Artificial Sequence
  hemagglutinin__InfluenzaA__AAZ83266
MKTIIALSYILCLVFAQKLPGNDNSTATLCLGHHAVPNGTLVKTITNDQIEVTNANELVQSSSTGRICDSPHQILDGENCTLIDALLGDPRCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 289 - protein, 566 aa, Artificial Sequence; identical to SEQ ID NO: 186
  hemagglutinin__InfluenzaA__AAZ83277

SEQ ID NO: 290 - protein, 566 aa, Artificial Sequence; identical to SEQ ID NO: 72
  hemagglutinin__InfluenzaA__AAZ83288

SEQ ID NO: 291 - protein, 566 aa, Artificial Sequence
  hemagglutinin__InfluenzaA__AAZ83312
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIIRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 292 - protein, 566 aa, Artificial Sequence
  hemagglutinin__InfluenzaA__AAZ83323
MKTIIALSYILCLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVQDYASLRSLVASSGTLEFNNESFNWTGVAQNGTSYACKRRSIKSFFSRLNWLHQLKYKYPALNVTMPNNDKFDKLYIWGVHHPSTDSDQTSLYAQASGRVTVSTKRSQQTVISNIGSRPWVRGVSSRISIYWTIVKPGDILLITSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 293 - protein, 566 aa, Artificial Sequence; identical to SEQ ID NO: 282
  hemagglutinin__InfluenzaA__AAZ83371

SEQ ID NO: 294 - protein, 566 aa, Artificial Sequence; identical to SEQ ID NO: 255
  hemagglutinin__InfluenzaA__AAZ83688

SEQ ID NO: 295 - protein, 565 aa, Artificial Sequence
  hemagglutinin__InfluenzaA__ABA06510
MKVKLLILLCTFTATYADTICIGYHANNSTDTVDTVLEKNVTVTHSVNLLEDSHNGKLCLLKGIAPLQLGNCSVAGWILGNPECELLIAKESWSYIVETPNPENGACYPGYFADYEELREQLSSVSSFERFEIFPKESSWPNHTVTGVSASCSHNGKSSFYRNLLWLTGKNGLYPNLSKSYANNKEKEVLILWGVHHPPNIGDQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCSNGSLQCRICI

SEQ ID NO: 296 - protein, 565 aa, Artificial Sequence
  hemagglutinin__InfluenzaA__ABA08464
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 297 - protein, 565 aa, Artificial Sequence; identical to SEQ ID NO: 296
  hemagglutinin__InfluenzaA__ABA08486

SEQ ID NO: 298 - protein, 565 aa, Artificial Sequence
  hemagglutinin__InfluenzaA__ABA08508
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGACYPGYFADYEELREQLSSVSSFERFEIFPKESSWPNHTVTGVSASCSHNGKSSFYRNLLWLTGKNGLYPNLSKSYANNKKKEVLILWGVHHPPNIGVQRTLYYTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCSNGSLQCRICI

SEQ ID NO: 299 - protein, 565 aa, Artificial Sequence
  hemagglutinin__InfluenzaA__ABA12707
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 300 - protein, 565 aa, Artificial Sequence
  hemagglutinin__InfluenzaA__ABA12715
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCDNECMESVKNGTYDYPKYSEESKLNREKIDGVKLESMGVYQILAIYSTVASSLVFLVSLGAISFWMCSNGSLQCRICI

SEQ ID NO: 301 - protein, 565 aa, Artificial Sequence
  hemagglutinin__InfluenzaA__ABA12729
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYISVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPRYSEESKLNREKIDGVKLESMGVYQILAIYSTVASSLVLLVSLGAISFWMCSNGSLQCRICI

SEQ ID NO: 302 - protein, 566 aa, Artificial Sequence; identical to SEQ ID NO: 286
  hemagglutinin__InfluenzaA__ABA12740

SEQ ID NO: 303 - protein, 566 aa, Artificial Sequence; identical to SEQ ID NO: 255
  hemagglutinin__InfluenzaA__ABA12751

SEQ ID NO: 304 - protein, 566 aa, Artificial Sequence
  hemagglutinin__InfluenzaA__ABA12762
MKTIIALSYILCLVFAQKFPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 305 - protein, 566 aa, Artificial Sequence
  hemagglutinin__InfluenzaA__ABA12773
MKTIIALSYIFCLVLGQDFPGNDNSTATLCLGHHAVPNGTLVKTITNDQIEVTNATELVQSSSTGKICNNPHRILDGIDCTLIDALLGDPHCDGFQNETWDLFVERSKAFSNCYPYDVPDYASLRSLVASSGTLEFINEGFTWTGVTQNGGSNACKRGPDSGFFSRLNWLYKSGSTYPVLNVTMPNNDNFDKLYIWGVHHPSTDQEQTSLYVQASGRVTVSTKRSQQTIIPNIGSRPWVRGLSSRISIYWTIVKPGDILVINSNGNLIAPRGYFKMRTGKSSIMRSDAPIGTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 306 - protein, 566 aa, Artificial Sequence
  hemagglutinin__InfluenzaA__ABA12780
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTNNDQISLYAQASGRITVSTKRSQQTVIPNIESRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 307 - protein, 566 aa, Artificial Sequence
  hemagglutinin__InfluenzaA__ABA16214
MKTIIALSYISCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYACKRGSVKSFFSRLNWLYESESKYPALNVTMPNNGKFDKLYIWGVHHPSTDKEQTNLYVRASGRVTVSTKRSQQTVIPNIGPRPWVRGLSSRISIYWTIVKPGDILLINSTGNLIAPRGYFKIRTGKSSIMRSDAPIGTCSSGCITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDMTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 308 - protein, 566 aa, Artificial Sequence; identical to SEQ ID NO: 256
  hemagglutinin__InfluenzaA__ABA18026

SEQ ID NO: 309 - protein, 565 aa, Artificial Sequence
  hemagglutinin__InfluenzaA__ABA18037
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELKEQLSSVSSFERFEIFPKGSSWPNHTVTGVSASCSHNGKSSFYRNLLWLTGKNGLYPNLSMSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 310 - protein, 566 aa, Artificial Sequence; identical to SEQ ID NO: 255
  hemagglutinin__InfluenzaA__ABA18048

SEQ ID NO: 311 - protein, 566 aa, Artificial Sequence
  hemagglutinin__InfluenzaA__ABA18123
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSNKSFFSRLNWLHQLKYKYPALNVTMPNNEKFDKLYIWGVHHPGTDSDQISLYAQASGRVTVSTKRSQQTVIPNIGSGPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 312 - protein, 566 aa, Artificial Sequence; identical to SEQ ID NO: 255
  hemagglutinin__InfluenzaA__ABA18134

SEQ ID NO: 313 - protein, 565 aa, Artificial Sequence; identical to SEQ ID NO: 299
  hemagglutinin__InfluenzaA__ABA18145

SEQ ID NO: 314 - protein, 566 aa, Artificial Sequence; identical to SEQ ID NO: 256
  hemagglutinin__InfluenzaA__ABA18156

SEQ ID NO: 315 - protein, 566 aa, Artificial Sequence
  hemagglutinin__InfluenzaA__ABA26700
MKTIIALSYILCLVFAQKLPGNDNSTATLCLGHHAVPNGTIVKTITNDQIEVTNATELVQSSSTGGICNSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQAPGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 316 - protein, 566 aa, Artificial Sequence
  hemagglutinin__InfluenzaA__ABA26711
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCKSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 317 - protein, 566 aa, Artificial Sequence
  hemagglutinin__InfluenzaA__ABA26722
MKTIIALSYILCLVFAQKLPGNDNSTATLCLGHHAVPNGTIVKTITNDQIEVTNATELVQSSPTGGICDSPHQILDGENCTLIDALLGDPQCDGFQNKKWDLFVERSKAHSNCYPYDVPDYASLRSLVASSGTLEFNNESFNWTGVTQNGTSSACKRRSNKSFFSRLNWLTHLKFKYPALNVTMPNNEKFDKLYIWGVHHPGTDNDQISLYAQASGRITVSTKRSQQTVIPNIGSRPRVRDVPSRISIYWTIVKPGDILLINSTGNLIAPRGYFKIRSGKSSIMRSDAPIGKCNSGCITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 318 - protein, 566 aa, Artificial Sequence; identical to SEQ ID NO: 243
  hemagglutinin__InfluenzaA__ABA26733

SEQ ID NO: 319 - protein, 566 aa, Artificial Sequence; identical to SEQ ID NO: 243
  hemagglutinin__InfluenzaA__ABA26755

SEQ ID NO: 320 - protein, 566 aa, Artificial Sequence; identical to SEQ ID NO: 282
  hemagglutinin__InfluenzaA__ABA26766

SEQ ID NO: 321 - protein, 566 aa, Artificial Sequence; identical to SEQ ID NO: 282
  hemagglutinin__InfluenzaA__ABA26788

SEQ ID NO: 322 - protein, 566 aa, Artificial Sequence; identical to SEQ ID NO: 282
  hemagglutinin__InfluenzaA__ABA26799

SEQ ID NO: 323 - protein, 565 aa, Artificial Sequence
  hemagglutinin__InfluenzaA__ABA42247
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYKNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 324 - protein, 565 aa, Artificial Sequence; identical to SEQ ID NO: 296
  hemagglutinin__InfluenzaA__ABA42258

SEQ ID NO: 325 - protein, 566 aa, Artificial Sequence; identical to SEQ ID NO: 255
  hemagglutinin__InfluenzaA__ABA42269

SEQ ID NO: 326 - protein, 565 aa, Artificial Sequence
  hemagglutinin__InfluenzaA__ABA42280
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGACYPGYFADYEELREQLSSVSSFERFEIFPKESSWPNHTVTGVSASCSHNGKSSFYRNLLWLTGKNGLYPNLSKSYANNKEKEVLILWGVHHPPNIGDQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCSNGSLQCRICI

SEQ ID NO: 327 - protein, 566 aa, Artificial Sequence
  hemagglutinin__InfluenzaA__ABA42291
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCKSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKTDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 328 - protein, 566 aa, Artificial Sequence; identical to SEQ ID NO: 51
  hemagglutinin__InfluenzaA__ABA42302

SEQ ID NO: 329 - protein, 566 aa, Artificial Sequence; identical to SEQ ID NO: 105
  hemagglutinin__InfluenzaA__ABA42313

SEQ ID NO: 330 - protein, 566 aa, Artificial Sequence; identical to SEQ ID NO: 51
  hemagglutinin__InfluenzaA__ABA42346

SEQ ID NO: 331 - protein, 566 aa, Artificial Sequence; identical to SEQ ID NO: 105
  hemagglutinin__InfluenzaA__ABA42357

SEQ ID NO: 332 - protein, 566 aa, Artificial Sequence
  hemagglutinin__InfluenzaA__ABA42379
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSKISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFVLCIVLLGFIMWACQKGNIRCNICI

SEQ ID NO: 333 - protein, 566 aa, Artificial Sequence; identical to SEQ ID NO: 80
  hemagglutinin__InfluenzaA__ABA42390

SEQ ID NO: 334 - protein, 566 aa, Artificial Sequence
  hemagglutinin__InfluenzaA__ABA42401
MKTIIALSYILCLVFAQKLPGNDNSTATLCLGHHAVPNGTLVKTITNDQIEVTNATELVQSSSTSRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQSSGRVTVSTKRSQQTVIPNIGSGPWVRGVSSRISIYWTIVKPGDILLINSTGNLIAPRGYFKIRSGKSSIMRSDAPIGKCNSKCITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 335 - protein, 566 aa, Artificial Sequence
  hemagglutinin__InfluenzaA__ABA42412
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSKISIYWTIVKPGDILLINSTGNLIAPRGYFKIRSGKSSIMRSDAPIGKCNSECITPSGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 336 - protein, 566 aa, Artificial Sequence; identical to SEQ ID NO: 47
  hemagglutinin__InfluenzaA__ABA42443

SEQ ID NO: 337 - protein, 566 aa, Artificial Sequence; identical to SEQ ID NO: 51
  hemagglutinin__InfluenzaA__ABA42454

SEQ ID NO: 338 - protein, 566 aa, Artificial Sequence
  hemagglutinin__InfluenzaA__ABA42465
MKTIIALSYILCLVFAQKLPGNDNSTATLCLGHHAVPNGTLVKTITNDQIEVTNATELVQSSSTSRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWGRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 339 - protein, 566 aa, Artificial Sequence
  hemagglutinin__InfluenzaA__ABA42476
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRNEALNNRFQIKGVELKSGYKDWILWISFAISCFLLCIVLLGFIMWACQKGNIRCNICI

SEQ ID NO: 340 - protein, 566 aa, Artificial Sequence
  hemagglutinin__InfluenzaA__ABA42498
MKTIIALSYILCLVFAQKLPGNDNSTATLCLGHHAVPNGTLVKTITNDQIEVTNATELVQSSSTSRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSIISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 341 - protein, 566 aa, Artificial Sequence; identical to SEQ ID NO: 72
  hemagglutinin__InfluenzaA__ABA42509

SEQ ID NO: 342 - protein, 566 aa, Artificial Sequence
  hemagglutinin__InfluenzaA__ABA42520
MKTIIALSYILCLVFAQKLPVNDNSTATLCLGHHAVPNGTLVKTITNDYIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSIISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 343 - protein, 566 aa, Artificial Sequence
  hemagglutinin__InfluenzaA__ABA42531
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYLYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 344 - protein, 566 aa, Artificial Sequence; identical to SEQ ID NO: 72
  hemagglutinin__InfluenzaA__ABA42542

SEQ ID NO: 345 - protein, 566 aa, Artificial Sequence
  hemagglutinin__InfluenzaA__ABA42553
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAHSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 346 - protein, 566 aa, Artificial Sequence; identical to SEQ ID NO: 72
  hemagglutinin__InfluenzaA__ABA42564

SEQ ID NO: 347 - protein, 566 aa, Artificial Sequence
  hemagglutinin__InfluenzaA__ABA42928
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSKISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVNGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 348 - protein, 566 aa, Artificial Sequence; identical to SEQ ID NO: 72
  hemagglutinin__InfluenzaA__ABA42939

SEQ ID NO: 349 - protein, 566 aa, Artificial Sequence
  hemagglutinin__InfluenzaA__ABA42978
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTIPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 350 - protein, 566 aa, Artificial Sequence; identical to SEQ ID NO: 243
  hemagglutinin__InfluenzaA__ABA43167

SEQ ID NO: 351 - protein, 566 aa, Artificial Sequence
  hemagglutinin__InfluenzaA__ABA43178
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIALLGFIMWACQKGNIRCNICI

SEQ ID NO: 352 - protein, 565 aa, Artificial Sequence
  hemagglutinin__InfluenzaA__ABA43189
MKAKLLVLLCTFTATYADTICVGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 353 - protein, 566 aa, Artificial Sequence
  hemagglutinin__InfluenzaA__ABA43200
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVVLENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 354 - protein, 566 aa, Artificial Sequence
  hemagglutinin__InfluenzaA__ABA43336
MKTIIALSYIFCLVFAQKLPGNDNSTATLCLGHHAVPNGTLVKTITNDQIEVTNATELVQNSSTGRICDSPHRILDGKNCTLIDALLGDPHCDGFQNKEWDLFVERSKAYSNCYPYDVPDYASLRSLVASSGTLEFINEDFNWTGVAQSGGSYACKRGSVNSFFSRLNWLHESEYKYPALNVTMPNNGKFDKLYVWGVHHPITDREQTKLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 355 - protein, 568 aa, Artificial Sequence
  hemagglutinin__InfluenzaA__ABA54915
MEKVVLLLATASLVKSDQICIGYHANNSTEQVDTIMEKNVTVTHAQDILEKTHNGKLCDLDGVKPLILRDCSVAGWLLGNPMCDEFINVPEWSYIVEKASPANDLCYPGDFNDYEELKHLLSRINHFEKIQIIPKSSWSNHEASSGVSAACPYHGKPSFFRNVVWLIKKNSAYPTIKRSYNNTNQEDLLVLWGIHHPNDAAEQTKLYQNPTTYISVGTSTLNQRLVPKIATRSKVNGQSGRMEFFWTILKPNDAINFESNGNFIAPEYAYKIVKKGDSAIMKSELEYGNCNTKCQTPMGAINSSMPFHNIHPLTIGECPKYVKSNRLVLATGLRNTPQRERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYNKVRLQLRDNAKELGNGCFEFYHKCDNECMESVKNGTYDYPQYSEEARLNREEISGVKLESMGTYQILSIYSTVASSLALAIMVAGLSLWMCSNGSLQCRICI

SEQ ID NO: 356 - protein, 565 aa, Artificial Sequence
  hemagglutinin__InfluenzaA__ABA87080
MKVKLLVLLCTFTATYADTICIGYHANNSTDTVDTVLEKNVTVTHSVNLLEDSHNGKLCLLKGIAPLQLGNCSVAGWILGNPECELLISKESWSYIIETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNMGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 357 - protein, 565 aa, Artificial Sequence; identical to SEQ ID NO: 296
  hemagglutinin__InfluenzaA__ABA87091

SEQ ID NO: 358 - protein, 565 aa, Artificial Sequence; identical to SEQ ID NO: 296
  hemagglutinin__InfluenzaA__ABA87231

SEQ ID NO: 359 - protein, 566 aa, Artificial Sequence; identical to SEQ ID NO: 255
  hemagglutinin__InfluenzaA__ABA87242

SEQ ID NO: 360 - protein, 566 aa, Artificial Sequence; identical to SEQ ID NO: 256
  hemagglutinin__InfluenzaA__ABA87253

SEQ ID NO: 361 - protein, 565 aa, Artificial Sequence
  hemagglutinin__InfluenzaA__ABB02781
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGACYPGYFADYEELREQLSSVSSFERFEIFPKESSWPNHTVTGVSASCSHNGKSSFYRNLLWLTGKNGLYPNLSKSYANNKEKEVLILWGVHHPPNIGDQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCSNGSLQCRVCI

SEQ ID NO: 362 - protein, 565 aa, Artificial Sequence; identical to SEQ ID NO: 301
  hemagglutinin__InfluenzaA__ABB02792

SEQ ID NO: 363 - protein, 565 aa, Artificial Sequence; identical to SEQ ID NO: 299
  hemagglutinin__InfluenzaA__ABB02803

SEQ ID NO: 364 - protein, 565 aa, Artificial Sequence
  hemagglutinin__InfluenzaA__ABB02814
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCDNECMESVKNGTYDYPKYSEESKLNREKIDGVKLESMGVYQILAIYSTVASSLVLLVSLGAISFWMCSNGSLQCRICI

SEQ ID NO: 365 - protein, 565 aa, Artificial Sequence
  hemagglutinin__InfluenzaA__ABB02825
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCDNECMESVKNGTYDYPKYSEESKLNRERIDGVKLESMGVYQILAIYSTVASSLVLLVSLGAISFWMCSNGSLQCRICI

SEQ ID NO: 366 - protein, 566 aa, Artificial Sequence
  hemagglutinin__InfluenzaA__ABB02836
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRNQQTVIPNIGSRPRVRDIPSRISIYWTIVKPGDILLINSTGNLIAPRGYFKIRSGKSSIMRSDAPIGKCKSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 367 - protein, 566 aa, Artificial Sequence
  hemagglutinin__InfluenzaA__ABB02847
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWIGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 368 - protein, 566 aa, Artificial Sequence; identical to SEQ ID NO: 47
  hemagglutinin__InfluenzaA__ABB02858

SEQ ID NO: 369 - protein, 566 aa, Artificial Sequence
  hemagglutinin__InfluenzaA__ABB02869
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFVENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 370 - protein, 566 aa, Artificial Sequence
  hemagglutinin__InfluenzaA__ABB02880
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINRKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 371 - protein, 566 aa, Artificial Sequence
  hemagglutinin__InfluenzaA__ABB02891
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSIISIYWTIVKPGDILLINSTGNLIAPRGYFKIRSGKSSIMRSNAPIGECNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 372 - protein, 566 aa, Artificial Sequence
  hemagglutinin__InfluenzaA__ABB02902
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 373 - protein, 565 aa, Artificial Sequence
  hemagglutinin__InfluenzaA__ABB02913
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHRPPNIGDQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINRITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 374 - protein, 565 aa, Artificial Sequence
  hemagglutinin__InfluenzaA__ABB02924
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNAVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 375 - protein, 565 aa, Artificial Sequence
  hemagglutinin__InfluenzaA__ABB02936
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGHFADYEELREQLSSVSSFERFEIFPKGSSWPNHTVTGVSASCSHNGKSSFYRNLLWLTGKNGLYPNLSMSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 376 - protein, 566 aa, Artificial Sequence
  hemagglutinin__InfluenzaA__ABB02947
MKTIIALSYILCLVFAQKIPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVQDYASLRSLVASSGTLEFNNESFNWTGVAQNGTSYACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 377 - protein, 566 aa, Artificial Sequence; identical to SEQ ID NO: 186
  hemagglutinin__InfluenzaA__ABB02958

SEQ ID NO: 378 - protein, 566 aa, Artificial Sequence; identical to SEQ ID NO: 186
  hemagglutinin__InfluenzaA__ABB02969

SEQ ID NO: 379 - protein, 566 aa, Artificial Sequence
  hemagglutinin__InfluenzaA__ABB02980
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSIISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 380 - protein, 566 aa, Artificial Sequence
  hemagglutinin__InfluenzaA__ABB02991
MKTIIALSYILCLVFAQKLPGNDNSTATLCLGHHAVPNGTLVKTITNDQIEVTNATELVQSSSTGRICDNPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSIISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 381 - protein, 566 aa, Artificial Sequence
  hemagglutinin__InfluenzaA__ABB03002
MKTIIALSYILCLVFAQKLPGNDNSTATLCLGHHAVPNGTLVKTITNDQIEVTNATELVQSSSTGRICNSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSGPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 382 - protein, 566 aa, Artificial Sequence
  hemagglutinin__InfluenzaA__ABB03013
MKTIIALSYILCLVFAQKLPGNDNSTATLCLGHHAVPNGTLVKTITSDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSFACKRRSIKSFFSRLNWLHQLKYKYPALNVTMPNNDKFDKLYIWGVHHPGTDSDQTSLYAQASGRVTVSTKRSQQTVIPNIGSGPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFTEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFATSCFLLCVVLLGFIMWACQKGNIRCNICI

SEQ ID NO: 383 - protein, 566 aa, Artificial Sequence
  hemagglutinin__InfluenzaA__ABB03024
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWIRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 384 - protein, 566 aa, Artificial Sequence
  hemagglutinin__InfluenzaA__ABB03035
MKTIIALSYILCLVFAQKLPGNDNSTATLCLGHHAVPNGTLVKTITSDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSFACKRRSIKSFFSRLNWLHQLKYKYPALNVAMPNNDKFDKLYIWGVHHPGTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFTEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFATSCFLLCVVLLGFIMWACQKGNIRCNICI

SEQ ID NO: 385 - protein, 566 aa, Artificial Sequence
  hemagglutinin__InfluenzaA__ABB03046
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSGISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 386 - protein, 566 aa, Artificial Sequence
  hemagglutinin__InfluenzaA__ABB03057
MKTIIALSYILCLVFAQELPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQTSLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKLGYKDWILWISFAISCFLLCVALLGFIMWACQKGNIRCNICI

SEQ ID NO: 387 - protein, 566 aa, Artificial Sequence; identical to SEQ ID NO: 286
  hemagglutinin__InfluenzaA__ABB03068

SEQ ID NO: 388 - protein, 566 aa, Artificial Sequence; identical to SEQ ID NO: 243
  hemagglutinin__InfluenzaA__ABB03079

SEQ ID NO: 389 - protein, 566 aa, Artificial Sequence; identical to SEQ ID NO: 243
  hemagglutinin__InfluenzaA__ABB03090

SEQ ID NO: 390 - protein, 565 aa, Artificial Sequence
  hemagglutinin__InfluenzaA__ABB03101
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGACYPGYFADYEELREQLSSVSSFERFEIFPKKSSWPNHTVTGVSASCSHNGKSSFYRNLLWLTGKNGLYPNLSKSYANNKEKEVLILWGVHHPPNIGDQRTLYHTENAYVSVVSSHYSRRFTPEITKRPKVRDQEGRINYYWTLLEPGDTIIFETNGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCSNGSLQCRICI

SEQ ID NO: 391 - protein, 566 aa, Artificial Sequence
  hemagglutinin__InfluenzaA__ABB03112
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNKITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNTCIESIRNGTYDHDVYRDEALNNRFQIKGVELKSGYKDWILWISFAISCFLLCVALLGFIMWACQKGNIRCNICI

SEQ ID NO: 392 - protein, 565 aa, Artificial Sequence
  hemagglutinin__InfluenzaA__ABB03123
MKVKLLVLLCTFTATYADTICIGYHANNSTDTVDTVLEKNVTVTHFVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 393 - protein, 565 aa, Artificial Sequence
  hemagglutinin__InfluenzaA__ABB03134
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTEKNGLYPTLSKSYANNKEKEVLILWGVHHPPNIGDQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 394 - protein, 565 aa, Artificial Sequence; identical to SEQ ID NO: 299
  hemagglutinin__InfluenzaA__ABB03145

SEQ ID NO: 395 - protein, 566 aa, Artificial Sequence
  hemagglutinin__InfluenzaA__ABB04283
MKTIIALSYIFCLVFAQNLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYACKRGSDKSFFSRLNWLYESESKYPALNVTMPNNGNFDKLYIWGVHHPSTDKEQTNLYVRASGRVTVSTKRSQQTIIPNIGPRPWVRGLSSRISIYWTIVKPGDILLINSSGNLIAPRGYFKIRTGKSSIMRSDAPIGTCSSECITPNGSIPNDKPFQNVNKITYGACPKYVKQNTLKLATGMRNIPEKQTRGIFGAIAGFIENGWEGMVDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 396 - protein, 566 aa, Artificial Sequence
  hemagglutinin__InfluenzaA__ABB04294
MKTIIALSYIFCLVLGQDLPGNDNSTATLCLGHHAVPNGTLVKTITNDQIEVTNATELVQSSSTGKICNNPHRILDGINCTLIDALLGDPHCDGFQNEKWDLFVERSKAFSNCYPYDVPDYASLRSLVASSGTLEFINEGFNWTGVTQNGGSNACKRGPDSGFFSRLNWLYKSGSTYPVLNVTMPNNDNFDKLYIWGVHHPSTDQEQTNLYVQASGRVTVSTKRSQQTIIPNIGSRPWVRGLSSRISIYWTIVKPGDILVINSNGNLIAPRGYFKMRTGKSSIMRSDAPIGTCISECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 397 - protein, 566 aa, Artificial Sequence
  hemagglutinin__InfluenzaA__ABB04305
MKTIIALSYIFCLVFAQKLPENDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYACKRGSVNSFFSRLNWLYKSESKYPVLNVTMPNNGKFDKLYIWGVHHPSTDKEQTNLYVRASGKVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 398 - protein, 566 aa, Artificial Sequence
  hemagglutinin__InfluenzaA__ABB04316
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAYSNCYPYDVPDYASLRSLVASSGTLEFINEDFNWTGVTQSGGSYACKRGSVKSFFSRLNWLHESEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKNWILWISFAISCFLLCVVLLGFIMWACQKGNIRCNICI

SEQ ID NO: 399 - protein, 566 aa, Artificial Sequence
  hemagglutinin__InfluenzaA__ABB04327
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYACKRGSVNSFFSRLNWLYKSEYKYPALNVTMPNNGKFDKLYIWGVHHPSTEKEQTNLYVRASGRVTVSTKRSQQTVIPNIGSIPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 400 - protein, 566 aa, Artificial Sequence
  hemagglutinin__InfluenzaA__ABB04338
MKTIIALSYIFCLVLGQDFPGNDNSTATLCLGHHAVPNGTLVKTITNDQIEVTNATELVQSSSTGKICNNPHRILDGIDCTLIDALLGDPHCDGFQNETWDLFVERSKAFSNCYPYDVPDYASLRSLVASSGTLEFINEGFTWTGVTQNGGSNACKRGPDSGFFSRLNWLYKSGSTYPVLNVTMPNNDNFDKLYIWGVHHPSTDQEQTSLYVQASGRVTVSTKRSQQTIIPNIGSRPWVRGLSSRISIYWTIVKPGDILVLNSNGNLIAPRGYFKMRTGKSSIMRSDAPIGTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 401 - protein, 566 aa, Artificial Sequence
  hemagglutinin__InfluenzaA__ABB04349
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYACKRGSVNSFFSRLNWLYKSESKYPVLNVTMPNNGKFDKLYIWGVHHPSTDKEQTNLYVRASGKVTVSTKRSQQTVIPNIGSRPWVRGLSSRISIYWTIVKPGDILLINSTGNLIAPRGYFKIRTGKSSIMRSDAPIGTCNSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 402 - protein, 566 aa, Artificial Sequence
  hemagglutinin__InfluenzaA__ABB04360
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAYSNCYPYDVPDYASLRSLVASSGTLEFINEDFNWTGVTQSGGSYACKRGSVNSFFSRLNWLHKSEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 403 - protein, 566 aa, Artificial Sequence
  hemagglutinin__InfluenzaA__ABB04371
MKTIIALSYIFYLALGQDLPGNDNSKATLCLGHHAVPNGTLVKTITDDQTEVTNATELVQSSSTGKICNNPHRILDGMDCTLIDALLGDPHCDVFQNETWDLFVERSKAFSNCYPYDVPDYASLRSLVASSGTMEFITEGFTWTEVTQNGGSNACKRGPDSGFFSRLNWLTKSGRTYPVLNVTMPNNDNFDKLYIWGVHHPSTDQEQTNLYVQTSGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRIIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 404 - protein, 566 aa, Artificial Sequence
  hemagglutinin__InfluenzaA__ABB04906
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQNGDSYACKRGSVKSFFSRLNWLHKSEYKYPALNVTMPNNDKFDKLYIWGVHHPSTDREQTSLYIRASGKVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 405 - protein, 566 aa, Artificial Sequence
  hemagglutinin__InfluenzaA__ABB04917
MKTIIALSYIFCLVFAQKLPGNDNSTATLCLGHHAVPNGTLVKTITNDQIEVTNATELVQISSTGRICDSPHRILDGKNCTLIDALLGDPHCDGFQNEKWDLFVERSKAFSNCYPYDVPDYASLRSLVASSGTLEFINEGFNWTGVTQSGGSYTCKRGSVNSFFSRLNWLYESESKYPVLNVTMPNNGKFDKLYIWGVHHPSTDKEQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 406 - protein, 566 aa, Artificial Sequence
  hemagglutinin__InfluenzaA__ABB04928
MKTIIALSYIFCLVFAQDLPGNDNSTATLCLGHHAVPNGTLVKTITNDQIEVTNATELVQSSSTGKICNNPHRILDGINCTLIDALLGDPHCDGFQNEKWDLFVERSKAFSNCYPYDVPDYASLRSLVASSGTLEFINEGFNWIGVTQNGGSNACKRGTDSGFFSRLNWLYKSGSTYPVQNVTMPNNDNSDKLYIWGVHHPSTDKEQTDLYVQASGKVTVSTKRSQQTIIPNVGSRPWVRGLSSRISIYWTIVKPGDILVINSNGNLIAPRGYFKMRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 407 - protein, 566 aa, Artificial Sequence
  hemagglutinin__InfluenzaA__ABB04939
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYTCKRGSVNSFFSRLNWLYESESKYPVLNVTMPNNGKFDKLYIWGVHHPSTDKEQTNLYVRASGRVTVSTKRSQQTVIPNIGSRPWVRGLSSRISIYWTIVKPGDILLINSIGNLIAPRGYFKIRTGKSSIMRSDAPIGICSSECITPNGSIPNDKPFQNVNKITYGACPRYVKQNTLKLATGMRNVPEKQTRGIFGAIAGFIENGWEGMVDGWYGFRHQNSEGTGQAADLKSTQAAVDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 408 - protein, 566 aa, Artificial Sequence
  hemagglutinin__InfluenzaA__ABB04950
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYTCKRGSVNSFFSRLNWLYESESKYPVLNVTMPNNGKFDKLYIWGVHHPSTDKEQTNLYVRASGKVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 409 - protein, 566 aa, Artificial Sequence
  hemagglutinin__InfluenzaA__ABB04983
MKTIIALSYILCLVFAQKLPGNDNSTATLCLGHHAVPNGTLVKTITNDQIEVTNATELVQSSSTDRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 410 - protein, 566 aa, Artificial Sequence; identical to SEQ ID NO: 172
  hemagglutinin__InfluenzaA__ABB04994

SEQ ID NO: 411 - protein, 566 aa, Artificial Sequence
  hemagglutinin__InfluenzaA__ABB05005
MKTIIALSHILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPDIGSRPWVRGVSSRISIYWTIVKPGDILLINSTGNLIAPRGYFKIRSGKSSIMRSNAPIGKCNSECITPNGSVPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 412 - protein, 566 aa, Artificial Sequence
  hemagglutinin__InfluenzaA__ABB05183
MKTIIALSYILCLVFAQKLPVNDNSTATLCLGHHAVPNGTLVKTITNEHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKVYHKCDNACIGSIRNGTYDHDVYRDEALNNRFQIKGVELKSGYKDWILWISFAISCFLLCVVLLGFIMWACQKGNIRCNICI

SEQ ID NO: 413 - protein, 566 aa, Artificial Sequence
  hemagglutinin__InfluenzaA__ABB05194
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVIMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSVMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQNLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 414 - protein, 566 aa, Artificial Sequence
  hemagglutinin__InfluenzaA__ABB05205
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSNAYSNCYPYDVPDYASLRSLVASSGTLEFNSESFNWTGVAQNGTSSACKRRSNKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNNKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 415 - protein, 566 aa, Artificial Sequence; identical to SEQ ID NO: 72
  hemagglutinin__InfluenzaA__ABB05216

SEQ ID NO: 416 - protein, 566 aa, Artificial Sequence
  hemagglutinin__InfluenzaA__ABB46392
MKTIIALSYIFCLAFAQDLPGNDNSTATLCLGHHAVPNGTLVKTITNDQIEVTNATELVQSSSTGKICDNPHRILDGINCTLIDALLGDPHCDGFQNEKWDLFVERSKAFSNCYPYDVPDYASLRSLVASSGTLEFINEGFNWTGVTQNGGSSACKRGPDNGFFSRLNWLYKSGSTYPVQNVTMPNNDNSDKLYIWGVHHPNTDKEQTDLYVQASGKVTVSTKRSQQTIIPNVGSRPWVRGLSSRVSIYWTIVKPGDILVINSNGNLIAPRGYFKMRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQTAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 417 - protein, 566 aa, Artificial Sequence
  hemagglutinin__InfluenzaA__ABB46414
MKTIIALSYILCLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLFCVVLLGFIMWACQKGNIRCNICI

SEQ ID NO: 418 - protein, 566 aa, Artificial Sequence
  hemagglutinin__InfluenzaA__ABB46425
MKTIIALSYILCLVFAQKLPGNDNSTATLCLGHHAVPNGTLVKTITSDQIEVTNATELVQSSSTGKICDSPHRILDGENCTLIDALLGDPHCDGFQNKEWDLFVERSKAYSNCYPYDVPDYASLRSLVASSGTLEFNNESFNWTGVAQNGTSFACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 419 - protein, 566 aa, Artificial Sequence
  hemagglutinin__InfluenzaA__ABB46436
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKYDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 420 - protein, 566 aa, Artificial Sequence; identical to SEQ ID NO: 353
  hemagglutinin__InfluenzaA__ABB46447

SEQ ID NO: 421 - protein, 566 aa, Artificial Sequence
  hemagglutinin__InfluenzaA__ABB46458
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRNQQTVIPNIGSRPRVRDIPSRISIYWTIVKPGDILLINSTGNLIAPRGYFKIRSGKSSIMRSDAPIGKCKSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWGCQKGNIRCNICI

SEQ ID NO: 422 - protein, 566 aa, Artificial Sequence
  hemagglutinin__InfluenzaA__ABB51961
MKTIIALSYILCLVFAQKLPGNDNSTATLCLGHHAVPNGTIVKTITNDQIEVTNATELVQSFSTGGICDSPHQILDGENCTLIDALLGDPQCDGFQNKKWDLFVERSKAYSNCYPYDVPDYACVRSLVASSGTLEFNNESFNWAGVTQNGTSSACKRRSNKSFFSRLNWLTHLKYKYPALNVTMPNNEKFDKLYIWGVHHPGTDSDQISLYAQASGRITVSTQRCKQLVIPNIGSRPRVRDVSSRISIYWTIVNPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIESIRNGTYDHDVYRDEALNNRFQIKGVELKSGYKDWILWISFAISCFLLCVALLGFIMWACQKGNIRCNICI

SEQ ID NO: 423 - protein, 565 aa, Artificial Sequence
  hemagglutinin__InfluenzaA__ABB51962
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGNQRALYHTENAYVSVVSSHYSRRFTPEIAKRPKVRDQEGRINYYWTLLEPGDTIIFEANGNLIAPWYAFAMSRGFGSGISTSNAPMGECDAKFQTPQGGINISLPFQNVHPVTIGECPNYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCSEFYHKCNNECMESVKNGTYDYPKYSEESKLNREKIDGVKLESMGVYQILAIYSTVASSLVLLVSLGAISFWMCSNGSLQCRICI

SEQ ID NO: 424 - protein, 566 aa, Artificial Sequence
  hemagglutinin__InfluenzaA__ABB51963
MKTIIALSYILCLVFAQKLPGNDNSTATLCLGHHAVPNGTIVKTITNDRIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRHIPSRISIYWTIVNPGDILLINSTGNLIAPRGYFKIRSGKSSIMRSDAPIGKCNSECITPNGSIPNDKPFQNVNRITYGACPRYVKQNTLKLATGMRNVPEKQNRGIFGAIAGFIENGWEGMVDGWYGFRHQNSEGIGQAADLKSTQAAINQINEKLNRLIGKTNEKFHQIEKEFSEVEGRIQDLEKYVEDTKIDLWSYNAELLVALENQHTIDLTDSEMNKLFERTKKQLRENAEDMGNGCFKVYHKCDNACIGSIRNGTYDHNVYRDEALNNRFQIKGVELKSGYKDWILWISFAISCFLLCVALLGFIMWACQKGNIRCNICI

SEQ ID NO: 425 - protein, 566 aa, Artificial Sequence; identical to SEQ ID NO: 282
  Hemagglutinin__InfluenzaA__ABB51964

SEQ ID NO: 426 - protein, 565 aa, Artificial Sequence
  hemagglutinin__InfluenzaA__ABB53603
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGACYPGYFADYEELREQLSSVSSFERFEIFPKESSWPNHTVTGVSASCSHNGKSSFYRNLLWLTGKNGLYPNLSKSYANNKKKEVLILWGVHHPPNIGNQRTLYYTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCSNGSLQCRICI

SEQ ID NO: 427 - protein, 566 aa, Artificial Sequence; identical to SEQ ID NO: 255
  hemagglutinin__InfluenzaA__ABB53614

SEQ ID NO: 428 - protein, 566 aa, Artificial Sequence; identical to SEQ ID NO: 255
  hemagglutinin__InfluenzaA__ABB53625

SEQ ID NO: 429 - protein, 566 aa, Artificial Sequence; identical to SEQ ID NO: 282
  hemagglutinin__InfluenzaA__ABB53652

SEQ ID NO: 430 - protein, 566 aa, Artificial Sequence
  hemagglutinin__InfluenzaA__ABB53663
MKTIFALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAHSNCYPYDVPDYASLRSLVASSGTLEFNNESFNWTGVTQNGTSSACKRRSNNSFFSRLNWLTHLKFKYPALNVTMPNNENFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 431 - protein, 566 aa, Artificial Sequence; identical to SEQ ID NO: 255
  hemagglutinin__InfluenzaA__ABB53685

SEQ ID NO: 432 - protein, 566 aa, Artificial Sequence
  hemagglutinin__InfluenzaA__ABB53696
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIALLGFIMWACQKGNIRCNVCI

SEQ ID NO: 433 - protein, 565 aa, Artificial Sequence; identical to SEQ ID NO: 296
  hemagglutinin__InfluenzaA__ABB53707

SEQ ID NO: 434 - protein, 566 aa, Artificial Sequence; identical to SEQ ID NO: 243
  hemagglutinin__InfluenzaA__ABB53718

SEQ ID NO: 435 - protein, 565 aa, Artificial Sequence
  hemagglutinin__InfluenzaA__ABB53740
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNMGDQRALYHTENAYVSVVSSHYSRRFTPEIAKRPKVRDQEGRINYYWTLLEPGETIIFEANGNLIAPRYAFALSRGFGSGIITSNAPMDECDAKCQTPQGAINSSLPFQNVHPVTIGECPKYVRSTKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 436 - protein, 566 aa, Artificial Sequence
  hemagglutinin__InfluenzaA__ABB53751
MKTIIALSYISCLVFAQNLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYACKRGSDNSFFSRLNWLYKSESKYPVLNVTMPNNGNFDKLYIWGVHHPSTDKEQTNLYVRASGRVTVSTKRSQQTIIPNIGSRPWVRGLSSGISIYWTIVKPGDILLINSNGNLIAPRGYFKIRTGKSSILRSDAPIGTCSSECITPNGSIPNDKPFQNVNKITYGACPKYVKQNTLKLATGMRNVPEKQTRGIFGAIAGFIENGWEGMVDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 437 - protein, 566 aa, Artificial Sequence
  hemagglutinin__InfluenzaA__ABB60007
MKTIIALSYILCLVFAQKLPGNDNSTATLCLGHHAVPNGTLVKTITNDQIEVTNATELVQSSSTDRICDSPHRILDGENCTLIDALLGDPHCDGFQNKEWDLFVERSKAYSNCYPYDVPDYASLRSLVASSGTLEFNNESFNWTGVAQNGTSYACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 438 - protein, 566 aa, Artificial Sequence
  hemagglutinin__InfluenzaA__ABB77853
MKTIIALSYISCLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSYACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPDGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 439 - protein, 566 aa, Artificial Sequence
  hemagglutinin__InfluenzaA__ABB79731
MKTIIALSYILCLVFAQELPGNDNSTATLCLGHHAVPNGTIVKTITNDQIEVTNATELVQNSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQTSLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 440 - protein, 566 aa, Artificial Sequence
  hemagglutinin__InfluenzaA__ABB79788
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYACKRGSVNSFFSRLNWLYESESKYPVLNVTMPNNGKFDKLYIWGVHHPITDKEQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 441 - protein, 566 aa, Artificial Sequence
  hemagglutinin__InfluenzaA__ABB79799
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYACKRGSVNSFFSRLNWLYESESKYPVLNVTMPNNGKFDKLYIWGVHHPSTDKEQTNLYVRASGKVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 442 - protein, 566 aa, Artificial Sequence
  hemagglutinin__InfluenzaA__ABB79810
MKTIIALSYILCLVFAQKLPGNDNSTATLCLGHHAVPNGTLVKTITNDQIEVTNATELVQSSSTGRLCDSPHRILDGKNCTLIDALLGDPHCDGFQNKEWDLFVERSKAYSNCYPYDVPDYASLRSLVASSGTLEFINEDFNWTGVAQDGGSYACRRGSVNSFFSRLNWLHKLEYKYPALNVTMPNNGKFDKLYIWGVHHPSTDSDQTSLYVRASGRVTVSTKRSQQTVIPNIGSRPWVRGQSSRISIYWTIVKPGDILLIDSTGNLIAPRGYFKIRNGKSSIMRSDAPIGNCSSECITPNGSIPNDKPFQNVNRITYGACPRYVKQHTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 443 - protein, 566 aa, Artificial Sequence
  hemagglutinin__InfluenzaA__ABB79957
MKTIIALSYILCLVFAQKLPGNDNSTATLCLGHHAVPNGTLVKTITNDQIEVTNATELVQSSSTGRLCDSPHRILDGKNCTLIDALLGDPHCDGFQNKEWDLFVERSKAYSNCYPYDVPDYASLRSLVASSGTLEFINEDFNWTGVAQDGGSYACRRGSVNSFFSRLNWLHKLEYKYPALNVTMPNNGKFDKLYIWGVHHPSTDSDQTSLYVRASGRVTVSTKRSQQTVIPNIGSRPWVRGQSSRIGIYWTIVKPGDILLINSTGNLIAPRGYFKIRNGKSSIMRSDAPIGNCSSECITPNGSIPNDKPFQNVNRITYGACPRYVKQHTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 444 - protein, 566 aa, Artificial Sequence
  hemagglutinin__InfluenzaA__ABB79968
MKTIIALSYILCLVFAQKLPGNDNSTATLCLGHHAVPNGTLVKTITNDQIEVTNATELVQSSSTGRLCDSPHRILDGKNCTLIDALLGDPHCDGFQNKEWDLFVERSKAYSNCYPYDVPDYASLRSLVASSGTLEFINEDFNWTGVAQDGGSYACRRGSVNSFFSRLNWLHKLEYKYPALNVTMPNNGKFDKLYIWGVHHPSTDSDQTSLYVRASGRVTVSTKRSQQTVIPNIGSRPWVRGQSSRISIYWTIVKPGDILLINSTGNLIAPRGYFKIRNGKSSIMRSDAPIGNCSSECITPNGSIPNDKPFQNVNRITYGACPRYVKQHTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 445 - protein, 565 aa, Artificial Sequence
  hemagglutinin__InfluenzaA__ABB79979
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGDQRALYHTENAYVSVVSSHYSRRFTPEIAKRPKVRDQEGRINYHWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 446 - protein, 565 aa, Artificial Sequence
  hemagglutinin__InfluenzaA__ABB79990
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGDQKALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 447 - protein, 566 aa, Artificial Sequence
  hemagglutinin__InfluenzaA__ABB80001
MKTIIALSYTLCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQSTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 448 - protein, 566 aa, Artificial Sequence; identical to SEQ ID NO: 243
  hemagglutinin__InfluenzaA__ABB80012

SEQ ID NO: 449 - protein, 566 aa, Artificial Sequence
  hemagglutinin__InfluenzaA__ABB80023
MKTIIALSYIFYLALGQDLPGNDNSKATLCLGHHAVPNGTLVKTITNDQTEVTNATELVQSSSTGKICNNPHRILDGMDCTLIDALLGDPHCDVFQNETWDLFVERSKAFSNCYPYDVPDYASLRSLVASSGTLEFITEGFTWTEVTQNGGSNACKRGPDSGFFSRLNWLTKSGRTYPVLNVTMPNNDNFDKLYIWGVHHPSTDQEQTNLYVQTSGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQDTLKLATGMRNVPEKQTRGLFGAIAGFIENGWEGMIDGWYGFRHQNSEGTGQAADLKSTQAAIDQINGKLNRIIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 450 - protein, 566 aa, Artificial Sequence
  hemagglutinin__InfluenzaA__ABB80034
MKTIIALSYIFCLVLGQDLPGNDNSTATLCLGHHAVPNGTLVKTITDDQIEVTNATELVQSSSTGKICNNPHRILDGLDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGRVTVSTRRSQQTIIPNIGSRPWVRGLSSRISIYWTIVKPGDVLVINSNGNLIAPRGYFKMRTGKSSIMRSDATIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 451 - protein, 565 aa, Artificial Sequence; identical to SEQ ID NO: 364
  hemagglutinin__InfluenzaA__ABB80045

SEQ ID NO: 452 - protein, 566 aa, Artificial Sequence
  hemagglutinin__InfluenzaA__ABB80081
MKTIIALSYISCLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSYACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 453 - protein, 566 aa, Artificial Sequence
  hemagglutinin__InfluenzaA__ABB80092
MKTIIALSYISCLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSYACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTLVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 454 - protein, 566 aa, Artificial Sequence; identical to SEQ ID NO: 255
  hemagglutinin__InfluenzaA__ABB80137

SEQ ID NO: 455 - protein, 566 aa, Artificial Sequence; identical to SEQ ID NO: 452
  hemagglutinin__InfluenzaA__ABB80159

SEQ ID NO: 456 - protein, 566 aa, Artificial Sequence; identical to SEQ ID NO: 23
  hemagglutinin__InfluenzaA__ABB80185

SEQ ID NO: 457 - protein, 566 aa, Artificial Sequence
  hemagglutinin__InfluenzaA__ABB80207
MKTIIALSYILCLVFAQKLPGNDNSTATLCLGHHAVPNGTLVKTITNDQIEVTNATELVQSSSTGRICDSPHRILDGENCTLIDALLGDPHCDDFQNKEWDLFVERSKAYSNCYPYDVPDYASLRSLVASSGTLEFNNESFNWTGVAQNGTSYACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAMSCFLLCVVLLGFIMWACQKGNIRCNICI

SEQ ID NO: 458 - protein, 566 aa, Artificial Sequence
  hemagglutinin__InfluenzaA__ABB80229
MKTIIALSYILCLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSYACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAMSCFLLCVVLLGFIMWACQKGNIRCNICI

SEQ ID NO: 459 - protein, 566 aa, Artificial Sequence; identical to SEQ ID NO: 452
  hemagglutinin__InfluenzaA__ABB80240

SEQ ID NO: 460 - protein, 566 aa, Artificial Sequence
  hemagglutinin__InfluenzaA__ABB80251
MKTIIALSYILCLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGLIMWACQKGNIRCNICI

SEQ ID NO: 461 - protein, 566 aa, Artificial Sequence
  hemagglutinin__InfluenzaA__ABB80492
MKTIIALSYILCLVFAQKLPGNDNSTATLCLGHHAVPNGTLVKTITNDQIEVTNATELVQNSSTGRICDSPHRILDGENCTLIDALLGDPHCDGFQNKEWDLFVERSKAYSNCYPYDVPDYASLRSLVASSGTLEFNNESFNWTGVAQNGTSYACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAMSCFLLCVVLLGFIMWACQKGNIRCNICI

SEQ ID NO: 462 - protein, 566 aa, Artificial Sequence
  hemagglutinin__InfluenzaA__ABB80503
MKTIIALSYISCLVFAQKLPGNDNNTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSYACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELRSGYKDWILWISFAISCFLLCVVLLGFIMWACQKGNIRCNICI

SEQ ID NO: 463 - protein, 566 aa, Artificial Sequence; identical to SEQ ID NO: 452
  hemagglutinin__InfluenzaA__ABB80514

SEQ ID NO: 464 - protein, 566 aa, Artificial Sequence
  hemagglutinin__InfluenzaA__ABB80529
MKTIIALSYISCLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSYACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPDKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 465 - protein, 566 aa, Artificial Sequence
  hemagglutinin__InfluenzaA__ABB80641
MKTIIALSYILCLVFAQKIPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVSDYASLRSLVASSGTLEFNNESFNWTGVAQNGTSYACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 466 - protein, 566 aa, Artificial Sequence
  hemagglutinin__InfluenzaA__ABB80661
MKTIIALSYILCLVFAQKIPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSYACKRRSIKSFFSRLNWLHQLKYKYPALNVTMPNNDKFDKLYIWGVHHPSTDSDQASLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 467 - protein, 566 aa, Artificial Sequence
  hemagglutinin__InfluenzaA__ABB80672
MKTIIALSYILCLVFAQKLPGNDNSTATLCLGHHAVPNGTLVKTITNDQIEVTNATELVQGSSTGRICDSPHQILDGKNCTLIDALLGDPHCDGFQNKEWDLFVERSTAYSNCYPYDVPDYASLRSLVASSGTLEFTKEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 468 - protein, 566 aa, Artificial Sequence
  hemagglutinin__InfluenzaA__ABB80682
MKTIIALSYISCLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSYACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLLERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 469 - protein, 566 aa, Artificial Sequence
  hemagglutinin__InfluenzaA__ABB80693
MKTIIALSYISCLVFAQKLPGNDNSTATLCLGHHAVPNGTLVKTITNDQIEVTNATELVQSSSTGRMCDSPHRILDGENCTLIDALLGDPHCDGFQNKEWDLFVERSKAYSNCYPYDVPDYASLRSLVASSGTLEFNNESFNWTGVAQNGTSYACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 470 - protein, 566 aa, Artificial Sequence
  hemagglutinin__InfluenzaA__ABB80704
MKTIIALSYILCLVFAQKIPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSYACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 471 - protein, 566 aa, Artificial Sequence; identical to SEQ ID NO: 452
  hemagglutinin__InfluenzaA__ABB80715

SEQ ID NO: 472 - protein, 566 aa, Artificial Sequence
  hemagglutinin__InfluenzaA__ABB80724
MKTIIALSYILCLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSYACKRRSIKSFFSRLNWLHQLKYKYPALNVTMPNNDKFDKLYIWGVHHPSTDSDQASLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAMSCFLLCVVLLGFIMWACQKGNIRCNICI

SEQ ID NO: 473 - protein, 566 aa, Artificial Sequence; identical to SEQ ID NO: 458
  hemagglutinin__InfluenzaA__ABB80737

SEQ ID NO: 474 - protein, 566 aa, Artificial Sequence
  hemagglutinin__InfluenzaA__ABB80748
MKTIIALSYISCLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSYACKRRSIKSFFSRLNWLHQLKYKYPALNVTMPNNDKFDKLYIWGVHHPSTDSDQTSLYAQASGRVTVSTQRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEEYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 475 - protein, 566 aa, Artificial Sequence
  hemagglutinin__InfluenzaA__ABB82183
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSVMRSDASIGRCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 476 - protein, 565 aa, Artificial Sequence; identical to SEQ ID NO: 296
  hemagglutinin__InfluenzaA__ABB82194

SEQ ID NO: 477 - protein, 565 aa, Artificial Sequence
  hemagglutinin__InfluenzaA__ABB82205
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYKNLLWLTGKNGLYPNLSKSYANSKEKEVLVLWGVHHPPNIGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 478 - protein, 565 aa, Artificial Sequence
  hemagglutinin__InfluenzaA__ABB82216
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSSSCSHNGKSSFYRNLLWLTGKNGLYPNLSKSYVNNKEKEVLVLWGVHHPPNIGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 479 - protein, 566 aa, Artificial Sequence
  hemagglutinin__InfluenzaA__ABB82227
MKTIIALSYIFCLTLGQDLPGNDNSKATLCLGHHAVPNGTLVKTITDDQTEVTNATELVQSSSTGKICNNPHRILDGMDCTLIDALLGDPHCDVFQNETWDLFVERSKAFSNCYPYDVPDYASLRSLAASSGTLEFITEGFTWTGVTQNGGSNACKRGPGSGFFSRLNWLTKSGNTYPVLNVTMPNNDNFDKLYIWGVHHPSTDQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNINKITYGACPKYVKQNTLKLATGMRNVPEKQTRGLFGAIAGFIENGWEGMIDGWYGFRHQNSEGTGQAADLKSTQAAIDQINGKLNRIIEKTNEKFHQIEKEFSEVEGRIQDLEKYVEDTKIDLWSYNAELLVAMENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 480 - protein, 565 aa, Artificial Sequence
  hemagglutinin__InfluenzaA__ABB83026
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTEKNGLYPNLSKSYANNKEKEVLILWGVHHPPNIGDQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 481 - protein, 565 aa, Artificial Sequence
  hemagglutinin__InfluenzaA__ABB83127
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGACYPGYFADYEELREQLSSVSSFERFEIFPKESSWPNHTVTGVSASCSHNGKSSFYRNLLWLTGKNGLYPNLSKSYANNKEKEVLILWGVHHPPNIGDQRTLYHTENAYVSVVSSHYSRRFTPEITKRPKVRDQEGRINYYWTLLEPGDTIIFEANGNLIAPWYAFALSRGFGSGIIISNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCSNGSLQCRICI

SEQ ID NO: 482 - protein, 565 aa, Artificial Sequence
  hemagglutinin__InfluenzaA__ABB83138
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGACYPGYFADYEELREQLSSISSFERFEIFPKESSWPNHTVTGVSASCSHNGKSSFYRNLLWLTGKNGLYPNLSKSYANNKEKEVLILWGVHHPPNIGDQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCSNGSLQCRICI

SEQ ID NO: 483 - protein, 566 aa, Artificial Sequence
  hemagglutinin__InfluenzaA__ABB86877
MKAILLILLYTFTATNADTLCIGYHANNSTDTVDTVLEKNVTVTHSVNLLEDRHNGKLCNLGGIAPLYLGNCNIAGWLLGNPECELLFTVSSWSYIVETSNSDNGTCYPGDFINYEELREQLSSMSSYERFEIFPKESSWPNHETNRGVTAACPYAGANSFYRNLIWLVKKGNSYPKINKSYVNNKEKEVLVLWGIHHPPTSADQQSLYQNADAYVSVESSKYNKKFKPEIATRPKVRGQAGRMNYYWTLVEPGDTITFEATGNLVVPRYAFAMNRGSGSGIIISDTPVHDCNTTCQTPKGAINTSLPFQNVHPVTIGECPKYVKSTKLRMATGLRNIPSIQSRGLFEAIAGFIEGGWTGMIDGWYGYHHQNEQGSGYAADRKSTQNAIDGITNKVNSVIEKMNTQFTAVGKEFNHLEKRIENLNKKVDDGFLDVWTYNAELLVLLENERTLDFHDSNVKNLYEKVRSQLRNNAKEIGNGCFEFYHKCDDTCMESVRNGTYDYLKYSEESKLNREKIEGVKLDSARIYQILAIYSTVASSLVLLVSLGAISFWMCSNGSLQCRICI

SEQ ID NO: 484 - protein, 566 aa, Artificial Sequence
  hemagglutinin__InfluenzaA__ABB86887
MKAILLILLYTFTATNADTLCIGYHANNSTDTVDTVLEKNVTVTHSVNLLEDRHNGKLCNLGGIAPLYLGNCNIAGWLLGNPECELLFTVSSWSYIVETSNSDNGTCYPGDFINYEELREQLSSMSSYERFEIFPKESSWPNHETNRGVTAACPYAGANSFYRNLIWLVKKGNSYPKINKSYVNNKEKEVLVLWGIHHPPTSADQQSLYQNADAYVSVESSKYNKKFKPEIATRPKVRGQAGRMNYYWTLVEPGDTITFEATGNLVVPRYAFAMKRGSGSGIIISDTPVHDCNTTCQTPKGAINTSLPFQNIHPVTIGECPKYVKSTKLRMATGLRNIPSIQSRGLFGAIAGFIEGGWTGMIDGWYGYHHQNEQGSGYAADRKSTQNAIDGITNKVNSVIEKMNTQFTAVGKEFNHLEKRIENLNKKVDDGFLDVWTYNAELLVLLENERTLDFHDSNVKNLYEKVRSQLRNNAKEIGNGCFEFYHKCDDTCMESVRNGTYDYLKYSEESKLNREKIEGVKLDSARIYQILAIYSTVASSLVLLVSLGAISFWMCSNGSLQCRICI

SEQ ID NO: 485 - protein, 565 aa, Artificial Sequence
  hemagglutinin__InfluenzaA__ABB86899
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGACYPGHFADYEELREQLSSVSSFERFEIFPKESSWPNHTITGVSASCSHNGKRSFYRNLLWLTGKNGLYPNLSKSYANNKEKEVLILWGVHHPPNIGDQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKGQLKNNAKEIGNGCFEFYHKCNNECMESVKNGTYDYPKYSEESKLNREKIDGVKLDSMGVYQILAIYSTVASSLILLVSLGAISFWMCSNGSLQCRICI

SEQ ID NO: 486 - protein, 566 aa, Artificial Sequence
  hemagglutinin__InfluenzaA__ABB86907
MKAILLVLLYTFTSTNADTLCIGYHANNSTDTVDTVLEKNVTVTHSVNLLEDKHNGKLCRLGGIAPLHLGKCNIAGWLLGNPECDLLLTVSSWSYIVETSNSYNGTCYPGDFTNYEELREQLSSVSSFERFEIFPKASSWPNHETNRGVTAACPHAGTNSFYRNLIWLVKKGNTYPKLSKSYVNNKGKEVLVLWGIHHPSTSTDQQSLYQNADTYVFVGTSKYNKKFKPEIAVRPKVKDQAGRMNYYWTLVEPGDTITFEATGNLVVPRYAFAMNRGHGSGIIISDTPVHDCNTTCQTPKGAINTSLPFQNVHPVTIGKCPKYVKSTRLRMATGLRNIPSIQSRGLFGAIAGFIEGGWTGMIDGWYGYHHQNGQGSGYAADQKSTQNAIDGITNKVNSVIEKMNTQFTAVGKEFNHLEKRIENLNKKVDDGFLDVWTYNAELLVLLENERTLDFHDSNVKNLYEKVRRQLKNNAKEIGNGCFEFYHNCDDACMESVKNGTYDYPKYSEESRLNREEINGIKLDSTRIYQILAIYSTVASSSVLLVSLGAISFWMCSNGSLQCRICI

SEQ ID NO: 487 - protein, 565 aa, Artificial Sequence
  hemagglutinin__InfluenzaA__ABB86917
MKVKLLILLCTFTATYADPICIGYHANNSTDTVDTVLEKNVAVTHSVNLLEDSHNGKLCLLKGIAPLQLGNCSVAGWILGNPECELLISKESWSYIVETPNPENGACYPGYFADYEELREQLSSVSSFERFEIFPKESSWPNHTVTGVSASCSHNGKSSFYRNLLWLTGKNGLYPNLSKSYANNKEKEVLILWGVHHPPNIGDQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCSNGSLQCRICI

SEQ ID NO: 488 - protein, 565 aa, Artificial Sequence
  hemagglutinin__InfluenzaA__ABB86929
MKVKLLILLYTFTATYADTICIGYHANNSTDTVDTVLEKNVTVTHSVNLLEDSHNGKLCLLKGIAPLQLGNCSVAGWILGNPECELLISKESWSYIVETPNPENGACYPGHFADYEELREQLSSVSSFERFEIFPKESSWPNHTITGVSASCSHNGKRSFYRNLLWLTGKNGLYPNLSKSYANNKEKEVLILWGVHHPPNIGDQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFSKLERRMENLNKKVDDGFLDIWTYNAELLVLLENERTLDFHDSNVKNLYEKVKGQLKNNAKEIGNGCFEFYHKCNNECMESVKNGTYDYPKYSEESKLNREKIDGVKLDSMGVYQILAIYSTVASSLILLVSLGAISFWMCSNGSLQCRICI

SEQ ID NO: 489 - protein, 566 aa, Artificial Sequence
  hemagglutinin__InfluenzaA__ABB86937
MKAILLVLLYTFTSTNADTLCIGYHANNSTDTVDTVLEKNVTVTHSVNLLEDKHNGRLCKLGGIAPLHLGKCNIAGWLLGNPECELLFTVSSWSYIVETSNSYNGTCYPGDFINYEELREQLSSVSSFERFEIFPKASSWPNHETNRGVTAACPHAGTNSFYRNLIWLVKKGNTYPKISKSYVNNKGKEVLVLWGIHHPSTSNDQQSLYQNADTYVFVGPSKYNKKFKPEIATRPKVRDQAGRMNYYWTLVEPGDTITFEATGNLVVPRYAFAMNRGSESGIIISDTPVHDCNTTCQTPKGAINTSLPFQNVHPVTIGECPKYVKSTRLRMATGLRNIPSIQSRGLFGAIAGFIEEGWTGMIDGWYGYHHQNGQGSGYAADQKSTQNAIDGITNKVNSVIEKMNTQFTAVGKEFNHLEKRIENLNKKVDDGFLDVWTYNAELLVLLENERTLDFHDSNVKNLYEKVRRQLKNNAKEIGNGCFEFYHKCDDACMESVKNGTYDYPKYSEESRLNREEINGIKLDSTRIYQILAIYSTVASSSVLLVSLGAISFWMCSNGSLQCRICI

SEQ ID NO: 490 - protein, 566 aa, Artificial Sequence
  hemagglutinin__InfluenzaA__ABB86946
MKAILLVLLYTFTAANADTLCIGYHANNSTDTVDTVLEKNVTVTHSVNLLEDRHNGKLCKLRGIAPLHLGKCNIAGWLLGNPECESLSTVSSWSYIVETSNSDNGTCYPGDFINYEELREQLSSVSSFERFEIFPKASSWPNHETNRGTTAACPYAGANSFYRNLIWLVKKGNSYPKLNKSYVNNKGKEVLVLWGIHHPSTSNEQQSLYQNADTYVFVGSSKYNKKFKPEIATRPKVRDQAGRMNYYWTLIEPGDTITFEATGNLVVPRYAFAMNRGSGSGIIISDTPVHDCNTTCQTPKGAINTSLPFQNVHPVTIGECPKYVKSTKLRMATGLRNIPSIQSRGLFGAIAGFIEGGWTGMIDGWYGYHHQNEQGSGYAADQKSTQNAIDGITNKVNSVIEKMNTQFTAVGKEFNHLEKRIENLNKKVDDGFLDVWTYNAELLVLLENERTLDFHDSNVKNLYEKVRSQLKNNAKEIGNGCFEFYHKCDDACMESVKNGTYDYPKYSEESRLNREEIDGIKLDSTRIYQILAIYSTVASSSVLLVSLGAISFWMCSNGSLQCRICI

SEQ ID NO: 491 - protein, 566 aa, Artificial Sequence
  hemagglutinin__InfluenzaA__ABB96319
MKTIIALSYIFCQVFAQNLPGNDNSTATLCLGHHAVPNGTLVKTITNDQIEVTNATELVQSSSTGRICDNPHRILDGKNCTLIDALLGDPHCDGFQNEKWDLFVERSKAFSNCYPYDVPDYASLRSLVASSGTLEFFNEGFNWTGVTQNGGSYACKRGPDNSFFSRLNWLYKSESTYPVLNVTMPNNDNFDKLYIWGVHHPSTDKEQTNLYVQASGRVTVSTKRSQQTIIPNVGPRPWVRGLSSRISIYWTIVKPGDVLLINSNGNLIAPRGYFKIRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 492 - protein, 566 aa, Artificial Sequence
  hemagglutinin__InfluenzaA__ABB96330
MKTIIALSYIFCQVFAQNLPGNDNSTATLCLGHHAVPNGTLVKTITNDQIEVTNATELVQSSSTGRICDNPHRILDGKNCTLIDALLGDPHCDGFQNEKWDLFVERSKAFSNCYPYDVPDYASLRSLVASSGTLEFFNEGFNWTGVTQNGGSYACKRGPDNSFFSRLNWLYKSESTYPVLNVTMPNNDNFDKLYIWGVHHPSTDKEQTNLYVQASGRVTVSTKRSQQTIIPNVGSRPWVRGLSSRISIYWTIVKPGDVLLINSNGNLIAPRGYFKIRTGKSSIMRSDAPIGTCSSECITPNGSIPNDRPFQNVNKITYGACPKYVKQNTLKLATGMRNVPEKQTRGIFGAIAGFIENGWEGMVDGWYGFRHQNSEGTGQAADLKSTQAAIDQINGKLNRVIEKTNEKFHQIEKEFSEVEGRIQNLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 493 - protein, 566 aa, Artificial Sequence
  hemagglutinin__InfluenzaA__ABB96341
MKTIIALSYIFCQVFAQNLPGNDNSTATLCLGHHAVPNGTLVKTITNDQIEVTNATELVQSSSTGRICDNPHRILDGKNCTLIDALLGDPHCDGFQNEKWDLFVERSKAFSNCYPYDVPDYASLRSLVASSGTLEFFNEGFNWTGVTQNGGSYACKKGPDNSFFSRLNWLYKSESTYPVLNVTMPNNDNFDKLYIWGVHHPSTDKEQTNLYVQASGRVTVSTKRSQQTIIPNVGSRPWVRGLSSRISIYWTIVKPGDVLLINSNGNLIAPRGYFKIRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 494 - protein, 566 aa, Artificial Sequence
  hemagglutinin__InfluenzaA__ABB96395
MKTIIALSYIFCQVFAQNLPGNDNSTATLCLGHHAVPNGTLVKTITNDQIEVTNATELVQSSSTGRICDSPHRILDGKNCTLMDALLGDPHCDGFQNEKWDLFVERSKAFSNCYPYDVPDYASLRSLVASSGTLEFINEGFNWTGVTQNGGSYACKRGPDNSFFSRLNWLYKSESTYPVLNVTMPNNDNFDKLYIWGVHHPSTDKEQTNLYVQASGRVTVSTKRSQQTIIPNVGSRPWVRGLSSRISIYWTIVKPGDILLINSNGNLIAPRGYFKIRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIERTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 495 - protein, 565 aa, Artificial Sequence
  hemagglutinin__InfluenzaA__ABB96487
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGACYPGYFADYEELREQLSSVSSFERFEIFPKKSSWPNHTVTGVSASCSHDGKSSFYRNLLWLTGKNGLYPNLSKSYANNKEKEVLILWGVHHPPNIGDQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCSNGSLQCRICI

SEQ ID NO: 496 - protein, 566 aa, Artificial Sequence
  hemagglutinin__InfluenzaA__ABB96520
MKTIIALSYIFCLALGQDLPGNGNSTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTDQEQTSLYVQASGRVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQKTLKLATGMRNIPEKKTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 497 - protein, 566 aa, Artificial Sequence
  hemagglutinin__InfluenzaA__ABB96531
MKTIIALSYILCLVSAQKIPGNDSSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSYACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 498 - protein, 566 aa, Artificial Sequence
  hemagglutinin__InfluenzaA__ABC02234
MKTIIALSYILCLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSYACKRRSIKSFFSRLNWLHQLKYKYPALNVTMPNNDKFDKLYIWGVHHPSTDSDQTSLYAQASGRVTVSTKISQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAMSCFLFCVVLLGFIMWACQKGNIRCNICI

SEQ ID NO: 499 - protein, 566 aa, Artificial Sequence
  hemagglutinin__InfluenzaA__ABC02255
MKTIIALSYIFCLVLAQDLPGNDNSTATLCLGHHAVPNGTLVKTITNDQIEVTNATELVQSSSTGKICNNPHRILDGINCTLIDALLGDPHCDGFQNEKWDLFVERSKAFSNCYPYDVPDYASLRSLVASSGTLEFINEGFNWTGVTQNGGSNACKRGPDSGFFSRLNWLYKSGSTYPVLNVTMPNNDNFDKLYIWGVHHPSTDQEQTNLYVQASGRVTVSTKRSQQTIIPNVGSRPWVRGLSSRISIYWTIVKPGDILVINSNGNLIAPRGHFKMRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 500 - protein, 566 aa, Artificial Sequence
  hemagglutinin__InfluenzaA__ABC02266
MKTIIALSYIFCLVFAQDLPGNDNSTATLCLGHHAVPNGTLVKTITNDQIEVTNATELVQSSSTGKICDNPHRILDGINCTLIDALLGDPHCDGFQNEKWDLFVERSKAFSNCYPYDVPDYASLRSLVASSGTLEFINEGFNWTGVTQNGGSRACKRGPDNGFFSRLNWLYKSGSTYPVQNVTMPNNDNSDKLYIWGVHHPSTDKEQTDLYVQASGKVTVSTKRSQQTVIPNVGSRPWVRGLSSRVSIYWTIVKPGDILVINSNGNLIAPRGYFKMRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 501 - protein, 566 aa, Artificial Sequence
  hemagglutinin__InfluenzaA__ABC02288
MKTIIALSYILCLVFAQKIPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSYACKRRSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGHKDWILWISFAISCFLLCVVLLGFIMWACQKGNIRCNICI

SEQ ID NO: 502 - protein, 566 aa, Artificial Sequence; identical to SEQ ID NO: 470
  hemagglutinin__InfluenzaA__ABC02299

SEQ ID NO: 503 - protein, 566 aa, Artificial Sequence; identical to SEQ ID NO: 494
  hemagglutinin__InfluenzaA__ABC02310

SEQ ID NO: 504 - protein, 566 aa, Artificial Sequence; identical to SEQ ID NO: 499
  hemagglutinin__InfluenzaA__ABC02321

SEQ ID NO: 505 - protein, 566 aa, Artificial Sequence; identical to SEQ ID NO: 305
  hemagglutinin__InfluenzaA__ABC02332

SEQ ID NO: 506 - protein, 566 aa, Artificial Sequence
  hemagglutinin__InfluenzaA__ABC39805
MKTIIALSYILCLVFAQNLPGNDNSTATLCLGHHAVPNGTLVKTITNDQIEVTNATELVQSSSAGRICDSPHRILDGKNCTLIDALLGDPHCDGFQNEKWDLFVERSKAFSNCYPYDVQDYASLRSLVASSGTLEFINEGFNWTGVTQSGGSYACKRGSGNSFFSRLNWLYKSESKYPALNVTMPNNGNFDKLYIWGVHHPSTDKEQTNLYVRASGRVTVSTKRSQQTVIPNIGPRPWVRGLSSRISIYWTIVKPGDILLINSSGNLIAPRGYFKIRTGKSSIMRSDAPIGTCSSECITPNGSIPNDKPFQNVNKITYGACPKYVKQNTLKLATGMRNIPEKQTRGIFGAIAGFIENGWEGMVDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 507 - protein, 565 aa, Artificial Sequence
  hemagglutinin__InfluenzaA__ABC40522
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGACYPGYFADYEELREQLSSVSSFERFEIFPKESSWPNHTVTGVSASCSHNGKSSFYKNLLWLTGKNGLYPNLSKSYANNKEKEVLILWGVHHPPNIGDQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCSNGSLQCRICI

SEQ ID NO: 508 - protein, 565 aa, Artificial Sequence; identical to SEQ ID NO: 296
  hemagglutinin__InfluenzaA__ABC40533

SEQ ID NO: 509 - protein, 566 aa, Artificial Sequence [sequence omitted]

SEQ ID NO: 510 - protein, 566 aa, Artificial Sequence
  hemagglutinin__InfluenzaA__ABC40608
MKTIIALSYILCLVFAQKLPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSSACKRRSIKSFFSRLNWLHQLKYKYPALNVTMPNNDKFDKLYIWGVHHPSTDSDQTSLYAQASGRVTVSTRRSQQTVIPNIGSRPWVRGVSSRISIYWTIVKPGDILLINSTGNLIAPRGYFKIRSGKSSIMRSDAPIGKCNSECITPNGSIPNDKPFQSVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 511 - protein, 566 aa, Artificial Sequence
  hemagglutinin__InfluenzaA__ABC40619
MKTIIALSYIFCLVLGQDFSGNDNSTATLCLGHHAVPNGTLVKTITNDQIEVTNATELVQSSSTGKICNNPHRILDGIDCTLIDALLGDPHCDGFQNETWDLFVERSKAFSNCYPYDVPDYASLRSLVASSGTLEFINEGFNWTGVTQNGGSNACKRGPDSGFFSRLNWLYKSGSTYPVLNVSMPNNDNFDKLYIWGVHHPSTDQEQTNLYVQASGRVTVSTKRSQQTIIPNIGSRPWVRGLSSRISIYWTIVKPGDILVINSNGNLIAPRGYFKMRTGKSSIMRSDAPIGTCISECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRIIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 512 - protein, 565 aa, Artificial Sequence
  hemagglutinin__InfluenzaA__ABC40631
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLILWGVHHPPNIGDQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 513 - protein, 566 aa, Artificial Sequence
  hemagglutinin__InfluenzaA__ABC41692
MKTIIALSYILCLVFAQKPPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 514 - protein, 565 aa, Artificial Sequence; identical to SEQ ID NO: 299
  hemagglutinin__InfluenzaA__ABC41714

SEQ ID NO: 515 - protein, 566 aa, Artificial Sequence
  hemagglutinin__InfluenzaA__ABC41725
MKTTIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 516 - protein, 566 aa, Artificial Sequence
  hemagglutinin__InfluenzaA__ABC41736
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 517 - protein, 566 aa, Artificial Sequence; identical to SEQ ID NO: 516
  hemagglutinin__InfluenzaA__ABC41952

SEQ ID NO: 518 - protein, 566 aa, Artificial Sequence; identical to SEQ ID NO: 516
  hemagglutinin__InfluenzaA__ABC41953

SEQ ID NO: 519 - protein, 566 aa, Artificial Sequence; identical to SEQ ID NO: 516
  hemagglutinin__InfluenzaA__ABC41964

SEQ ID NO: 520 - protein, 566 aa, Artificial Sequence; identical to SEQ ID NO: 516
  hemagglutinin__InfluenzaA__ABC42014

SEQ ID NO: 521 - protein, 566 aa, Artificial Sequence; identical to SEQ ID NO: 516
  hemagglutinin__InfluenzaA__ABC42114

SEQ ID NO: 522 - protein, 566 aa, Artificial Sequence; identical to SEQ ID NO: 516
  hemagglutinin__InfluenzaA__ABC42125

SEQ ID NO: 523 - protein, 566 aa, Artificial Sequence; identical to SEQ ID NO: 516
  hemagglutinin__InfluenzaA__ABC42136

SEQ ID NO: 524 - protein, 566 aa, Artificial Sequence
  hemagglutinin__InfluenzaA__ABC42147
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDVPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 525 - protein, 566 aa, Artificial Sequence; identical to SEQ ID NO: 516
  hemagglutinin__InfluenzaA__ABC42158

SEQ ID NO: 526 - protein, 566 aa, Artificial Sequence; identical to SEQ ID NO: 516
  hemagglutinin__InfluenzaA__ABC42169

SEQ ID NO: 527 - protein, 566 aa, Artificial Sequence; identical to SEQ ID NO: 516
  hemagglutinin__InfluenzaA__ABC42180

SEQ ID NO: 528 - protein, 566 aa, Artificial Sequence; identical to SEQ ID NO: 516
  hemagglutinin__InfluenzaA__ABC42192

SEQ ID NO: 529 - protein, 566 aa, Artificial Sequence; identical to SEQ ID NO: 516
  hemagglutinin__InfluenzaA__ABC42307

SEQ ID NO: 530 - protein, 566 aa, Artificial Sequence
  hemagglutinin__InfluenzaA__ABC42318
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAEFLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 531 - protein, 566 aa, Artificial Sequence; identical to SEQ ID NO: 516
  hemagglutinin__InfluenzaA__ABC42346

SEQ ID NO: 532 - protein, 566 aa, Artificial Sequence; identical to SEQ ID NO: 516
  hemagglutinin__InfluenzaA__ABC42461

SEQ ID NO: 533 - protein, 566 aa, Artificial Sequence; identical to SEQ ID NO: 516
  hemagglutinin__InfluenzaA__ABC42494

SEQ ID NO: 534 - protein, 566 aa, Artificial Sequence; identical to SEQ ID NO: 516
  hemagglutinin__InfluenzaA__ABC42505

SEQ ID NO: 535 - protein, 566 aa, Artificial Sequence
  hemagglutinin__InfluenzaA__ABC42516
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNKLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 536 - protein, 566 aa, Artificial Sequence; identical to SEQ ID NO: 516
  hemagglutinin__InfluenzaA__ABC42527

SEQ ID NO: 537 - protein, 566 aa, Artificial Sequence; identical to SEQ ID NO: 516
  hemagglutinin__InfluenzaA__ABC42574

SEQ ID NO: 538 - protein, 566 aa, Artificial Sequence; identical to SEQ ID NO: 516
  hemagglutinin__InfluenzaA__ABC42585

SEQ ID NO: 539 - protein, 566 aa, Artificial Sequence; identical to SEQ ID NO: 243
  hemagglutinin__InfluenzaA__ABC42596

SEQ ID NO: 540 - protein, 566 aa, Artificial Sequence; identical to SEQ ID NO: 282
  hemagglutinin__InfluenzaA__ABC42607

SEQ ID NO: 541 - protein, 566 aa, Artificial Sequence; identical to SEQ ID NO: 282
  hemagglutinin__InfluenzaA__ABC42618

SEQ ID NO: 542 - protein, 566 aa, Artificial Sequence
  hemagglutinin__InfluenzaA__ABC42629
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 543 - protein, 566 aa, Artificial Sequence
  hemagglutinin__InfluenzaA__ABC42640
MKTIIALSYILCLVFAQKIPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 544 - protein, 566 aa, Artificial Sequence; identical to SEQ ID NO: 243
  hemagglutinin__InfluenzaA__ABC42651

SEQ ID NO: 545 - protein, 566 aa, Artificial Sequence
  hemagglutinin__InfluenzaA__ABC42662
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAEFLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 546 - protein, 566 aa, Artificial Sequence
  hemagglutinin__InfluenzaA__ABC42673
MKTIIALSYILCLIFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 547 - protein, 566 aa, Artificial Sequence; identical to SEQ ID NO: 243
  hemagglutinin__InfluenzaA__ABC42684

SEQ ID NO: 548 - protein, 566 aa, Artificial Sequence; identical to SEQ ID NO: 243
  hemagglutinin__InfluenzaA__ABC42695

SEQ ID NO: 549 - protein, 566 aa, Artificial Sequence
  hemagglutinin__InfluenzaA__ABC42706
MKTIIALSYILCLVFAQKLPGNDNSTATLCLGHHAVPNGTTVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 550 - protein, 566 aa, Artificial Sequence; identical to SEQ ID NO: 243
  hemagglutinin__InfluenzaA__ABC42717

SEQ ID NO: 551 - protein, 566 aa, Artificial Sequence
  hemagglutinin__InfluenzaA__ABC42728
MKTIIALSYILCLVFAQKLPGNDNSTATLCLGHHAVPNGTVVKTITNDQIEVTNATELVQSSSTGGICDSPHQILDGENCTLMDALLGDPQCDGFQNKKWDLFVERSRAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 552 - protein, 566 aa, Artificial Sequence; identical to SEQ ID NO: 243
  hemagglutinin__InfluenzaA__ABC42739

SEQ ID NO: 553 - protein, 565 aa, Artificial Sequence
  hemagglutinin__InfluenzaA__ABC42750
MKVKLLVLLCTFTATYADTICIGYHANNSTDTVDTVLEKNVTVTHSVNLLEDSHNGKLCLLKGIAPLQLGNCSVAGWILGNPECELLISKESWSYIVEKPNPENGTCYPGHFADYEELREQLSSVSSFERFEIFPKESSWPNHTVTGVSASCSHNGKSSFYKNLLWLTGKNGLYPNLSKSYANNKEKEVLVLWGVHHPPNIGDQKALYHTENAYVSVVSSHYSRKFTPEIAKRPKVRDQEGRINYYWTLLEPGDTIIFEANGNLIAPRYAFALSRGFGSGIINSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFIDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 554 - protein, 566 aa, Artificial Sequence; identical to SEQ ID NO: 243
  hemagglutinin__InfluenzaA__ABC42761

SEQ ID NO: 555 - protein, 566 aa, Artificial Sequence
  hemagglutinin__InfluenzaA__ABC42772
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKSVELKSGYKDWILWISFAISCFLLCVALLGFIMWACQKGNIRCNICI

SEQ ID NO: 556 - protein, 566 aa, Artificial Sequence; identical to SEQ ID NO: 243
  hemagglutinin__InfluenzaA__ABC42783

SEQ ID NO: 557 - protein, 566 aa, Artificial Sequence; identical to SEQ ID NO: 243
  hemagglutinin__InfluenzaA__ABC42794

SEQ ID NO: 558 - protein, 566 aa, Artificial Sequence; identical to SEQ ID NO: 243
  hemagglutinin__InfluenzaA__ABC42805

SEQ ID NO: 559 - protein, 566 aa, Artificial Sequence; identical to SEQ ID NO: 282
  hemagglutinin__InfluenzaA__ABC42816

SEQ ID NO: 560 - protein, 566 aa, Artificial Sequence
  hemagglutinin__InfluenzaA__ABC42827
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRMSIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 561 - protein, 566 aa, Artificial Sequence; identical to SEQ ID NO: 243
  hemagglutinin__InfluenzaA__ABC42849

SEQ ID NO: 562 - protein, 566 aa, Artificial Sequence
  hemagglutinin__InfluenzaA__ABC42882
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWVLWISFAISCFLLCIVLLGFIMWACQKGNIRCNICI

SEQ ID NO: 563 - protein, 566 aa, Artificial Sequence; identical to SEQ ID NO: 562
  hemagglutinin__InfluenzaA__ABC42893

SEQ ID NO: 564 - protein, 566 aa, Artificial Sequence; identical to SEQ ID NO: 516
  hemagglutinin__InfluenzaA__ABC42929

SEQ ID NO: 565 - protein, 566 aa, Artificial Sequence; identical to SEQ ID NO: 516
  hemagglutinin__InfluenzaA__ABC42940

SEQ ID NO: 566 - protein, 566 aa, Artificial Sequence; identical to SEQ ID NO: 516
  hemagglutinin__InfluenzaA__ABC42951

SEQ ID NO: 567 - protein, 566 aa, Artificial Sequence; identical to SEQ ID NO: 516
  hemagglutinin__InfluenzaA__ABC42962

SEQ ID NO: 568 - protein, 566 aa, Artificial Sequence; identical to SEQ ID NO: 516
  hemagglutinin__InfluenzaA__ABC42973

SEQ ID NO: 569 - protein, 566 aa, Artificial Sequence; identical to SEQ ID NO: 516
  hemagglutinin__InfluenzaA__ABC42995

SEQ ID NO: 570 - protein, 566 aa, Artificial Sequence; identical to SEQ ID NO: 516
  hemagglutinin__InfluenzaA__ABC43006

SEQ ID NO: 571 - protein, 566 aa, Artificial Sequence; identical to SEQ ID NO: 516
  hemagglutinin__InfluenzaA__ABC43028

SEQ ID NO: 572 - protein, 566 aa, Artificial Sequence; identical to SEQ ID NO: 516
  hemagglutinin__InfluenzaA__ABC43039

SEQ ID NO: 573 - protein, 566 aa, Artificial Sequence; identical to SEQ ID NO: 516
  hemagglutinin__InfluenzaA__ABC43050

SEQ ID NO: 574 - protein, 566 aa, Artificial Sequence; identical to SEQ ID NO: 516
  hemagglutinin__InfluenzaA__ABC43061

SEQ ID NO: 575 - protein, 566 aa, Artificial Sequence
  hemagglutinin__InfluenzaA__ABC43072
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFTISCFLLCVALLGFIMWACQKGNIRCNICI

SEQ ID NO: 576 - protein, 566 aa, Artificial Sequence; identical to SEQ ID NO: 516
  hemagglutinin__InfluenzaA__ABC43083

SEQ ID NO: 577 - protein, 566 aa, Artificial Sequence; identical to SEQ ID NO: 516
  hemagglutinin__InfluenzaA__ABC43094

SEQ ID NO: 578 - protein, 566 aa, Artificial Sequence; identical to SEQ ID NO: 516
  hemagglutinin__InfluenzaA__ABC43116

SEQ ID NO: 579 - protein, 566 aa, Artificial Sequence; identical to SEQ ID NO: 243
  hemagglutinin__InfluenzaA__ABC43127

SEQ ID NO: 580 - protein, 566 aa, Artificial Sequence; identical to SEQ ID NO: 282
  hemagglutinin__InfluenzaA__ABC43138

SEQ ID NO: 581 - protein, 566 aa, Artificial Sequence; identical to SEQ ID NO: 243
  hemagglutinin__InfluenzaA__ABC43149

SEQ ID NO: 582 - protein, 566 aa, Artificial Sequence; identical to SEQ ID NO: 243
  hemagglutinin__InfluenzaA__ABC43160

SEQ ID NO: 583 - protein, 566 aa, Artificial Sequence; identical to SEQ ID NO: 243
  hemagglutinin__InfluenzaA__ABC43171

SEQ ID NO: 584 - protein, 566 aa, Artificial Sequence; identical to SEQ ID NO: 243
  hemagglutinin__InfluenzaA__ABC43182

SEQ ID NO: 585 - protein, 566 aa, Artificial Sequence
  hemagglutinin__InfluenzaA__ABC43475
MKTIIALSYILCLVFAQKLPGNDNSTATLCLGHHAVPNGTTVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 586 - protein, 566 aa, Artificial Sequence; identical to SEQ ID NO: 243
  hemagglutinin__InfluenzaA__ABC43486

SEQ ID NO: 587 - protein, 566 aa, Artificial Sequence; identical to SEQ ID NO: 243
  hemagglutinin__InfluenzaA__ABC43497

SEQ ID NO: 588 - protein, 566 aa, Artificial Sequence; identical to SEQ ID NO: 282
  hemagglutinin__InfluenzaA__ABC43508

SEQ ID NO: 589 - protein, 566 aa, Artificial Sequence; identical to SEQ ID NO: 282
  hemagglutinin__InfluenzaA__ABC43519

SEQ ID NO: 590 - protein, 566 aa, Artificial Sequence; identical to SEQ ID NO: 282
  hemagglutinin__InfluenzaA__ABC43530

SEQ ID NO: 591 - protein, 566 aa, Artificial Sequence
  hemagglutinin__InfluenzaA__ABC43552
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQAPGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 592 - protein, 566 aa, Artificial Sequence
  hemagglutinin__InfluenzaA__ABC46554
MKTIIALSYIFCQVFAQNLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQDGGSYACKRGPDNSFFSRLNWLYKSESTYPVLNVTMPNNDNFDKLYIWGVHHPSTDKEQTNLYVQASGRVTVSTKRSQQTIIPNVGSRPWVRGLSSRISIYWTIVKPGDILLINSNGNLIAPRGYFKIRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 593 - protein, 566 aa, Artificial Sequence
  hemagglutinin__InfluenzaA__ABC46576
MKTIIALSYIFCLVFAQNLPGNDKSTATLCLGHHAVPNGTLVKTITNDQIEVTNATELVQSSSTGRICDSPHRILDGKNCTLVDALLGDPHCDGFQNEKWDLFVERSKAFSNCYPYDVPDYASLRSLVASSGTLEFINESFNWTGVTQSGGSYACKRGSDNSFFSRLNWLYESESKYPVLNVTMPNNGNFDKLYIWGVHHPSTDKEQTNLYVRASGRVTVSTKRSQQTIIPNIGSRPWVRGLSSRISIYWTIVKPGDILLINSNGNLIAPRGYFKIRTGKSSIMRSDAPIGTCSSECITPNGSIPNDKPFQNVNKITYGACPKYVKQNTLKLATGMRNVPEKQTRGIFGAIAGFIENGWEGMVDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 594 - protein, 566 aa, Artificial Sequence; identical to SEQ ID NO: 452
  hemagglutinin__InfluenzaA__ABC50167

SEQ ID NO: 595 - protein, 566 aa, Artificial Sequence; identical to SEQ ID NO: 452
  hemagglutinin__InfluenzaA__ABC50178

SEQ ID NO: 596 - protein, 566 aa, Artificial Sequence; identical to SEQ ID NO: 452
  hemagglutinin__InfluenzaA__ABC50189

SEQ ID NO: 597 - protein, 566 aa, Artificial Sequence; identical to SEQ ID NO: 562
  hemagglutinin__InfluenzaA__ABC50200

SEQ ID NO: 598 - protein, 566 aa, Artificial Sequence; identical to SEQ ID NO: 562
  hemagglutinin__InfluenzaA__ABC50211

SEQ ID NO: 599 - protein, 566 aa, Artificial Sequence; identical to SEQ ID NO: 562
  hemagglutinin__InfluenzaA__ABC50222

SEQ ID NO: 600 - protein, 566 aa, Artificial Sequence; identical to SEQ ID NO: 562
  hemagglutinin__InfluenzaA__ABC50233

SEQ ID NO: 601 - protein, 566 aa, Artificial Sequence; identical to SEQ ID NO: 562
  hemagglutinin__InfluenzaA__ABC50244

SEQ ID NO: 602 - protein, 566 aa, Artificial Sequence; identical to SEQ ID NO: 562
  hemagglutinin__InfluenzaA__ABC50266

SEQ ID NO: 603 - protein, 566 aa, Artificial Sequence; identical to SEQ ID NO: 562
  hemagglutinin__InfluenzaA__ABC50277

SEQ ID NO: 604 - protein, 566 aa, Artificial Sequence
  hemagglutinin__InfluenzaA__ABC50299
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWVLWISFATSCFLLCIVLLGFIMWACQKGNIRCNICI

SEQ ID NO: 605 - protein, 566 aa, Artificial Sequence; identical to SEQ ID NO: 562
  hemagglutinin__InfluenzaA__ABC50310

SEQ ID NO: 606 - protein, 566 aa, Artificial Sequence
  hemagglutinin__InfluenzaA__ABC50321
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPGKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWVLWISFAISCFLLCIVLLGFIMWACQKGNIRCNICI

SEQ ID NO: 607 - protein, 566 aa, Artificial Sequence
  hemagglutinin__InfluenzaA__ABC50332
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNGKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCIVLLGFIMWACQKGNIRCNICI

SEQ ID NO: 608 - protein, 566 aa, Artificial Sequence; identical to SEQ ID NO: 562
  hemagglutinin__InfluenzaA__ABC50343

SEQ ID NO: 609 - protein, 566 aa, Artificial Sequence
  hemagglutinin__InfluenzaA__ABC50354
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSSCKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWVLWISFAISCFLLCIVLLGFIMWACQKGNIRCNICI

SEQ ID NO: 610 - protein, 566 aa, Artificial Sequence
  hemagglutinin__InfluenzaA__ABC50376
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNTGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWVLWISFAISCFLLCIVLLGFIMWACQKGNIRCNICI

SEQ ID NO: 611 - protein, 566 aa, Artificial Sequence
  hemagglutinin__InfluenzaA__ABC50387
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYVWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWVLWISFAISCFLLCIVLLGFIMWACQKGNIRCNICI

SEQ ID NO: 612 - protein, 566 aa, Artificial Sequence
  hemagglutinin__InfluenzaA__ABC50409
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYVSLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 613 - protein, 566 aa, Artificial Sequence; identical to SEQ ID NO: 612
  hemagglutinin__InfluenzaA__ABC50420

SEQ ID NO: 614 - protein, 566 aa, Artificial Sequence
  hemagglutinin__InfluenzaA__ABC54668
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQASGRVTVSTKRSQQTVIPNIGSGPWVRGVSSRISIYWTIVKPGDILLINSTGNLIAPRGYFKIRSGKSSIMRSDAPIGKCNSECITPNGSLPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 615 - protein, 566 aa, Artificial Sequence
  hemagglutinin__InfluenzaA__ABC54679
MKTIIALSYILCLVFAQKLPGNDNSTATLCLGHHAVPNGTIVKTITNDQIEVTNATELVQSSPTGGICDSPHQILDGENCTLIDALLGDPQCDGFQNKKWDLFIERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNVGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 616 - protein, 566 aa, Artificial Sequence; identical to SEQ ID NO: 516
  hemagglutinin__InfluenzaA__ABC67319

SEQ ID NO: 617 - protein, 566 aa, Artificial Sequence
  hemagglutinin__InfluenzaA__ABC67454
MKTIIALSYILCLVFAQELPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWVLWISFAISCFLLCIVLLGFIMWACQKGNIRCNICI

SEQ ID NO: 618 - protein, 566 aa, Artificial Sequence; identical to SEQ ID NO: 562
  hemagglutinin__InfluenzaA__ABC67471

SEQ ID NO: 619 - protein, 566 aa, Artificial Sequence
  hemagglutinin__InfluenzaA__ABC67554
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIVKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 620 - protein, 566 aa, Artificial Sequence
  hemagglutinin__InfluenzaA__ABC67565
MKTIIALSYIFCLVLGQDFPGNDNSTATLCLGHHAVPNGTLVKTITNDQIEVTNATELVQSSSTGKICNNPHRILDGIDCTLIDALLGDPHCDGFQNETWDLFVERSKAFSNCYPYDVPDYASLRSLVASSGTLEFINEGFTWTGVTQNGGSNACKRGPDIGFFSRLNWLYKSGSTYPVLNVTMPNNDNFDKLYIWGVHHPSTDQEQTSLYVQASGRVTVSTKRSQQTIIPNIGSRPWVRGLSSRISIYWTIVKPGDILVINSNGNLIAPRGYFKMRTGKSSIMRSDAPIGTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 621 - protein, 566 aa, Artificial Sequence
  hemagglutinin__InfluenzaA__ABC67576
MKTIIALSYILCLVFAQKLPGNDNSMATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSYACKRRSIKSFFSRLNWLHQLKYKYPALNVTMPNNDEFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 622 - protein, 566 aa, Artificial Sequence
  hemagglutinin__InfluenzaA__ABC67587
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGPCPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 623 - protein, 566 aa, Artificial Sequence; identical to SEQ ID NO: 243
  hemagglutinin__InfluenzaA__ABC67598

SEQ ID NO: 624 - protein, 566 aa, Artificial Sequence; identical to SEQ ID NO: 562
  hemagglutinin__InfluenzaA__ABC67609

SEQ ID NO: 625 - protein, 566 aa, Artificial Sequence; identical to SEQ ID NO: 562
  hemagglutinin__InfluenzaA__ABC67620

SEQ ID NO: 626 - protein, 566 aa, Artificial Sequence; identical to SEQ ID NO: 562
  hemagglutinin__InfluenzaA__ABC67631

SEQ ID NO: 627 - protein, 566 aa, Artificial Sequence; identical to SEQ ID NO: 562
  hemagglutinin__InfluenzaA__ABC67642

SEQ ID NO: 628 - protein, 566 aa, Artificial Sequence
  hemagglutinin__InfluenzaA__ABC67653
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWVLWISFAISCFLLCVVLLGFIMWACQKGNIRCNICI

SEQ ID NO: 629 - protein, 566 aa, Artificial Sequence
  hemagglutinin__InfluenzaA__ABC67697
MKTIIALSYILCLVFAQKLPGNDNSTATLCLGHHAVPNGTIVKTITNDQIEVTNATELVQSSSTGEICDSPHQILDGENCTLIDALLGDPQCDGFQNKEWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 630 - protein, 566 aa, Artificial Sequence
  hemagglutinin__InfluenzaA__ABC67708
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 631 - protein, 566 aa, Artificial Sequence; identical to SEQ ID NO: 630
  hemagglutinin__InfluenzaA__ABC67719

SEQ ID NO: 632 - protein, 566 aa, Artificial Sequence; identical to SEQ ID NO: 630
  hemagglutinin__InfluenzaA__ABC67733

SEQ ID NO: 633 - protein, 566 aa, Artificial Sequence
  hemagglutinin__InfluenzaA__ABC67806
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTYNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 634 - protein, 566 aa, Artificial Sequence; identical to SEQ ID NO: 516
  hemagglutinin__InfluenzaA__ABC67817

SEQ ID NO: 635 - protein, 566 aa, Artificial Sequence; identical to SEQ ID NO: 630
  hemagglutinin__InfluenzaA__ABC67828

SEQ ID NO: 636 - protein, 566 aa, Artificial Sequence; identical to SEQ ID NO: 494
  hemagglutinin__InfluenzaA__ABC67839

SEQ ID NO: 637 - protein, 566 aa, Artificial Sequence
  hemagglutinin__InfluenzaA__ABC67850
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWARGVSSRISIHWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWVLWISFAISCFLLCIVLLGFIMWACQKGNIRCNICI

SEQ ID NO: 638 - protein, 566 aa, Artificial Sequence; identical to SEQ ID NO: 494
  hemagglutinin__InfluenzaA__ABC67861

SEQ ID NO: 639 - protein, 566 aa, Artificial Sequence; identical to SEQ ID NO: 562
  hemagglutinin__InfluenzaA__ABC67883

SEQ ID NO: 640 - protein, 566 aa, Artificial Sequence
  hemagglutinin__InfluenzaA__ABC67894
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSKLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWVLWISFAISCFLLCIVLLGFIMWACQKGNIRCNICI

SEQ ID NO: 641 - protein, 566 aa, Artificial Sequence; identical to SEQ ID NO: 562
  hemagglutinin__InfluenzaA__ABC67967

SEQ ID NO: 642 - protein, 566 aa, Artificial Sequence; identical to SEQ ID NO: 562
  hemagglutinin__InfluenzaA__ABC67978

SEQ ID NO: 643 - protein, 566 aa, Artificial Sequence
  hemagglutinin__InfluenzaA__ABC67989
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALKVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNVCIGSIRNGTYDHDVYRDEALNNRFQIKGVELKSGYKDWVLWISFAISCFLLCIVLLGFIMWACQKGNIRCNICI

SEQ ID NO: 644 - protein, 566 aa, Artificial Sequence; identical to SEQ ID NO: 617
  hemagglutinin__InfluenzaA__ABC68000

SEQ ID NO: 645 - protein, 566 aa, Artificial Sequence
  hemagglutinin__InfluenzaA__ABC68049
MKTIIALSYILCLVFAQKLPGNDNSTATLCLGHHAVPNGTLVKTITDDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYVWGVHHPGTDSDQISLYAQASGRVTVSTKRSQQTVIPNIGSRPWVRGVSSKISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWVLWISFAISCFLLCIVLLGFIMWACQKGNIRCNICI

SEQ ID NO: 646 - protein, 566 aa, Artificial Sequence; identical to SEQ ID NO: 562
  hemagglutinin__InfluenzaA__ABC68060

SEQ ID NO: 647 - protein, 566 aa, Artificial Sequence
  hemagglutinin__InfluenzaA__ABC68071
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHNVYRDEALNNRFQIKGVELKSGYKDWVLWISFAISCFLLCIVLLGFIMWACQKGNIRCNICI

SEQ ID NO: 648 - protein, 566 aa, Artificial Sequence; identical to SEQ ID NO: 630
  hemagglutinin__InfluenzaA__ABC68082

SEQ ID NO: 649 - protein, 566 aa, Artificial Sequence
  hemagglutinin__InfluenzaA__ABC68093
MKTIIALSYILCLVFAQKLPGNDNSTATLCLGHHAVPNGTLVKTITNDQIEVTNATELVQSSSTSRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSIISIYWTIVKPGDILLINSTGNLIAPRGYFKIRSGKSSIMRSDAPIGKCNSECITPNGSIPNGKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFATSCFLLCIVLLGFIMWACQKGNIRCNICI

SEQ ID NO: 650 - protein, 566 aa, Artificial Sequence
  hemagglutinin__InfluenzaA__ABC68222
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 651 - protein, 566 aa, Artificial Sequence; identical to SEQ ID NO: 442
  hemagglutinin__InfluenzaA__ABC68233

SEQ ID NO: 652 - protein, 568 aa, Artificial Sequence
  hemagglutinin__InfluenzaA__ABC72655
MEKIVLLFAIVSLVKSDQICIGYHANNSTEQVDTIMEKNVTVTHAQDILEKTHNGKLCDLDGVKPLILRDCSVAGWLLGNPMCDEFINVPEWSYIVEKPNPANDLCYPGDFNDYEELKHLLSRINHFEKIQIIPKSSWSSHEASVGVSSVCPYQGKSSFFRNVVWLIKKNSTYPTIKRSYNNTNQEDLLVLWGIHHPNDAAEQTKLYQNPTTYISVGTSTLNQRLVPRIATRSKVNGQSGRMEFFWTILKPNDAINFESNGNFIAPEYAYKIVKKGDSTIMKSELEYGNCNTKCQTPMGAINSSMPFHNIHPLTIGECPKYVKSNRLVLATGLRNSPQREKRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHKCDNECMESVRNGTYDYPQYSEEARLKREEISGVKLESIGIYQILSIYSTVASSLALAIMVAGLSLWMCSNGSLQCRICI

SEQ ID NO: 653 - protein, 566 aa, Artificial Sequence; identical to SEQ ID NO: 243
  hemagglutinin__InfluenzaA__ABC84400

SEQ ID NO: 654 - protein, 566 aa, Artificial Sequence; identical to SEQ ID NO: 452
  hemagglutinin__InfluenzaA__ABC84411

SEQ ID NO: 655 - protein, 566 aa, Artificial Sequence
  hemagglutinin__InfluenzaA__ABC84433
MKTIIALSYILCLVFAQKLPGNDNRTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTNNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 656 - protein, 566 aa, Artificial Sequence; identical to SEQ ID NO: 562
  hemagglutinin__InfluenzaA__ABC84444

SEQ ID NO: 657 - protein, 566 aa, Artificial Sequence; identical to SEQ ID NO: 633
  hemagglutinin__InfluenzaA__ABC84498

SEQ ID NO: 658 - protein, 566 aa, Artificial Sequence; identical to SEQ ID NO: 633
  hemagglutinin__InfluenzaA__ABC84509

SEQ ID NO: 659 - protein, 566 aa, Artificial Sequence
  hemagglutinin__InfluenzaA__ABC84520
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 660 - protein, 566 aa, Artificial Sequence
  hemagglutinin__InfluenzaA__ABC84531
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYACKRGSVNSFFSRLNWLYESESKYPALNVTMPNNGRFDKLYIWGVHHPSTDKEQTNLYVRAAGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 661 - protein, 566 aa, Artificial Sequence; identical to SEQ ID NO: 650
  hemagglutinin__InfluenzaA__ABC84560

SEQ ID NO: 662 - protein, 566 aa, Artificial Sequence
  hemagglutinin__InfluenzaA__ABC84571
MKTIIALSYILCLVFAQKLPGNDNSTATLCLGHHAVPNGTLVKTITNDQIEVTNATELVQSSSTGGICDSPHQIIDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 663 - protein, 566 aa, Artificial Sequence; identical to SEQ ID NO: 650
  hemagglutinin__InfluenzaA__ABC85754

SEQ ID NO: 664 - protein, 566 aa, Artificial Sequence; identical to SEQ ID NO: 630
  hemagglutinin__InfluenzaA__ABC85765

SEQ ID NO: 665 - protein, 566 aa, Artificial Sequence
  hemagglutinin__InfluenzaA__ABC85776
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINFTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 666 - protein, 566 aa, Artificial Sequence; identical to SEQ ID NO: 650
  hemagglutinin__InfluenzaA__ABC85787

SEQ ID NO: 667 - protein, 566 aa, Artificial Sequence; identical to SEQ ID NO: 633
  hemagglutinin__InfluenzaA__ABC85798

SEQ ID NO: 668 - protein, 566 aa, Artificial Sequence; identical to SEQ ID NO: 630
  hemagglutinin__InfluenzaA__ABC85820

SEQ ID NO: 669 - protein, 566 aa, Artificial Sequence; identical to SEQ ID NO: 630
  hemagglutinin__InfluenzaA__ABC85831

SEQ ID NO: 670 - protein, 566 aa, Artificial Sequence; identical to SEQ ID NO: 633
  hemagglutinin__InfluenzaA__ABC85842

SEQ ID NO: 671 - protein, 566 aa, Artificial Sequence; identical to SEQ ID NO: 630
  hemagglutinin__InfluenzaA__ABC85853

SEQ ID NO: 672 - protein, 566 aa, Artificial Sequence; identical to SEQ ID NO: 630
  hemagglutinin__InfluenzaA__ABC85864

SEQ ID NO: 673 - protein, 566 aa, Artificial Sequence; identical to SEQ ID NO: 633
  hemagglutinin__InfluenzaA__ABC85886

SEQ ID NO: 674 - protein, 566 aa, Artificial Sequence; identical to SEQ ID NO: 562
  hemagglutinin__InfluenzaA__ABC85908

SEQ ID NO: 675 - protein, 566 aa, Artificial Sequence
  hemagglutinin__InfluenzaA__ABC85919
MKTIIALSYILCLVFAQKLPGNDNSTATLCLGHHAVPNGTLVKTITNDQIEVTNATELVQSSSTGRICDSPHQILDGENCTLIDALLGDPHCDGFQNKEWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWVLWISFAISCFLLCIVLMGFIMWACQKGNIRCNICI

SEQ ID NO: 676 - protein, 566 aa, Artificial Sequence; identical to SEQ ID NO: 562
  hemagglutinin__InfluenzaA__ABC85930

SEQ ID NO: 677 - protein, 566 aa, Artificial Sequence; identical to SEQ ID NO: 611
  hemagglutinin__InfluenzaA__ABC85941

SEQ ID NO: 678 - protein, 566 aa, Artificial Sequence
  hemagglutinin__InfluenzaA__ABC85952
MKTIIALSYILCLVFAQKLPGNDNSTATLCLGHHAVPNGTLVKTITNDQIEVTNATELVQSSSTGRICDSPHQILDGENCTLIDALLGDPHCDGFQNKKWDLFVERSKAYSNCYPYDVPDYVSLRSLVASSGTLEFNNESFNWTGVAQNGTSSACKRRSDKSFFSRLNWLHQLKYKYPALNVTMPNNEKFDKLYIWGVHHPGTDSDQISLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHHNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWVLWISFAISCFLLCIVLLGFIMWACQKGNIRCNICI

SEQ ID NO: 679 - protein, 566 aa, Artificial Sequence; identical to SEQ ID NO: 562
  hemagglutinin__InfluenzaA__ABC85974

SEQ ID NO: 680 - protein, 566 aa, Artificial Sequence; identical to SEQ ID NO: 562
  hemagglutinin__InfluenzaA__ABC85985

SEQ ID NO: 681 - protein, 566 aa, Artificial Sequence
  hemagglutinin__InfluenzaA__ABC85996
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMMDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 682 - protein, 566 aa, Artificial Sequence; identical to SEQ ID NO: 243
  hemagglutinin__InfluenzaA__ABC86007

SEQ ID NO: 683 - protein, 566 aa, Artificial Sequence
  hemagglutinin__InfluenzaA__ABC86018
MKTIIALSYILCLVFAQKLPGNDNSTATLCLGHHAVPNGTIVKTITNDQIEVTNATELVQSSSTGGICDSPHQILDGENCTIIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 684 - protein, 566 aa, Artificial Sequence; identical to SEQ ID NO: 243
  hemagglutinin__InfluenzaA__ABC86029

SEQ ID NO: 685 - protein, 566 aa, Artificial Sequence; identical to SEQ ID NO: 282
  hemagglutinin__InfluenzaA__ABC86040

SEQ ID NO: 686 - protein, 566 aa, Artificial Sequence; identical to SEQ ID NO: 516
  hemagglutinin__InfluenzaA__ABC86124

SEQ ID NO: 687 - protein, 566 aa, Artificial Sequence; identical to SEQ ID NO: 593
  hemagglutinin__InfluenzaA__ABC86137

SEQ ID NO: 688 - protein, 566 aa, Artificial Sequence
  hemagglutinin__InfluenzaA__ABC97374
MKTIIALSYIFCLVLGQDFPGNDNSTATLCLGHHAVPNGTLVKTITNDQIEVTNATELVQSSSTGKICNNPHRILDGIDCTLIDALLGDPHCDGFQNETWDLFVERSKAFSNCYPYDVPDYASLRSLVASSGTLEFINEGFTWTGVTQNGGSNACKRGPDSGFFSRLNWLYKSGSTYPVLNVTMPNNDNFDKLYIWGVHHPSTDQEQTSLYVQASGRVTVSTKRSQQTIIPNIGSRPWVRGLSSRISIYWTIVKPGDILVINSNGNLIAPRGYFKMRTGKSSIMRSDAPIGTCISECITPNGSIPNDKPFQNVNKITYGACPKYVKQNTLKLATGMRNVPEKQTRGLFGAIAGFIENGWEGMVDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFRIYHKCDNACIGSIRNGTYDHDVYRDEALNNRFQIKGVELKSGYKDWILWISFAISCFLLCVVLLGFIMWACQKGNIRCNICI

SEQ ID NO: 689 - protein, 566 aa, Artificial Sequence; identical to SEQ ID NO: 32
  hemagglutinin__InfluenzaA__ABD15449

SEQ ID NO: 690 - protein, 566 aa, Artificial Sequence
  hemagglutinin__InfluenzaA__ABD15460
MKTIIALSYILCLVFAQKLPGNDNSTATLCLGHHAVPNGTIVKTITNDQIEVTNATELVQISSTGGICDSPYQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 691 - protein, 566 aa, Artificial Sequence; identical to SEQ ID NO: 32
  hemagglutinin__InfluenzaA__ABD15471

SEQ ID NO: 692 - protein, 566 aa, Artificial Sequence; identical to SEQ ID NO: 32
  hemagglutinin__InfluenzaA__ABD15482

SEQ ID NO: 693 - protein, 566 aa, Artificial Sequence; identical to SEQ ID NO: 690
  hemagglutinin__InfluenzaA__ABD15493

SEQ ID NO: 694 - protein, 566 aa, Artificial Sequence; identical to SEQ ID NO: 243
  hemagglutinin__InfluenzaA__ABD15526

SEQ ID NO: 695 - protein, 566 aa, Artificial Sequence; identical to SEQ ID NO: 452
  hemagglutinin__InfluenzaA__ABD15537

SEQ ID NO: 696 - protein, 566 aa, Artificial Sequence; identical to SEQ ID NO: 452
  hemagglutinin__InfluenzaA__ABD15548

SEQ ID NO: 697 - protein, 566 aa, Artificial Sequence; identical to SEQ ID NO: 470
  hemagglutinin__InfluenzaA__ABD15559

SEQ ID NO: 698 - protein, 566 aa, Artificial Sequence; identical to SEQ ID NO: 452
  hemagglutinin__InfluenzaA__ABD15570

SEQ ID NO: 699 - protein, 566 aa, Artificial Sequence; identical to SEQ ID NO: 470
  hemagglutinin__InfluenzaA__ABD15581

SEQ ID NO: 700 - protein, 566 aa, Artificial Sequence; identical to SEQ ID NO: 452
  hemagglutinin__InfluenzaA__ABD15592

SEQ ID NO: 701 - protein, 566 aa, Artificial Sequence; identical to SEQ ID NO: 452
  hemagglutinin__InfluenzaA__ABD15603

SEQ ID NO: 702 - protein, 566 aa, Artificial Sequence; identical to SEQ ID NO: 452
  hemagglutinin__InfluenzaA__ABD15614

SEQ ID NO: 703 - protein, 566 aa, Artificial Sequence
  hemagglutinin__InfluenzaA__ABD15625
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSQISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLVKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 704 - protein, 566 aa, Artificial Sequence; identical to SEQ ID NO: 470
  hemagglutinin__InfluenzaA__ABD15636

SEQ ID NO: 705 - protein, 566 aa, Artificial Sequence; identical to SEQ ID NO: 650
  hemagglutinin__InfluenzaA__ABD15680

SEQ ID NO: 706 - protein, 566 aa, Artificial Sequence
  hemagglutinin__InfluenzaA__ABD15691
MKTIIALSYILCLVFAQKLPVNDKSTATLCLGHHAVPNGTLVKTITNDHIEVTNATELVQSSPTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 707 - protein, 566 aa, Artificial Sequence
  hemagglutinin__InfluenzaA__ABD15702
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQTSLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 708 - protein, 566 aa, Artificial Sequence
  hemagglutinin__InfluenzaA__ABD15724
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVAMPNNEKFDKLYIWGVHHPSTDSDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 709 - protein, 566 aa, Artificial Sequence
  hemagglutinin__InfluenzaA__ABD15746
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGISSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEEMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 710 - protein, 566 aa, Artificial Sequence
  hemagglutinin__InfluenzaA__ABD15757
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEEMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 711 - protein, 566 aa, Artificial Sequence; identical to SEQ ID NO: 650
  hemagglutinin__InfluenzaA__ABD15779

SEQ ID NO: 712 - protein, 566 aa, Artificial Sequence; identical to SEQ ID NO: 650
  hemagglutinin__InfluenzaA__ABD15790

SEQ ID NO: 713 - protein, 566 aa, Artificial Sequence; identical to SEQ ID NO: 650
  hemagglutinin__InfluenzaA__ABD16292

SEQ ID NO: 714 - protein, 566 aa, Artificial Sequence; identical to SEQ ID NO: 633
  hemagglutinin__InfluenzaA__ABD16303

SEQ ID NO: 715 - protein, 566 aa, Artificial Sequence; identical to SEQ ID NO: 633
  hemagglutinin__InfluenzaA__ABD16325

SEQ ID NO: 716 - protein, 566 aa, Artificial Sequence
  hemagglutinin__InfluenzaA__ABD16336
MKTIIALSYTLCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTYNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 717 - protein, 566 aa, Artificial Sequence; identical to SEQ ID NO: 633
  hemagglutinin__InfluenzaA__ABD16347

SEQ ID NO: 718 - protein, 566 aa, Artificial Sequence
  hemagglutinin__InfluenzaA__ABD16358
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTYNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDLEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 719 - protein, 566 aa, Artificial Sequence; identical to SEQ ID NO: 633
  hemagglutinin__InfluenzaA__ABD16472

SEQ ID NO: 720 - protein, 566 aa, Artificial Sequence; identical to SEQ ID NO: 633
  hemagglutinin__InfluenzaA__ABD16483

SEQ ID NO: 721 - protein, 566 aa, Artificial Sequence; identical to SEQ ID NO: 630
  hemagglutinin__InfluenzaA__ABD16494

SEQ ID NO: 722 - protein, 566 aa, Artificial Sequence; identical to SEQ ID NO: 633
  hemagglutinin__InfluenzaA__ABD16505

SEQ ID NO: 723 - protein, 566 aa, Artificial Sequence
  hemagglutinin__InfluenzaA__ABD16516
MKTIIALSYILCMVFAQKLPGNDNSTATLCLGHHAVPNGTIVKTITNDQIEVTNATELVQSSSTGGICDSPHQILDGENCTLIDALLGDPQCDGFQNKKWDLFIERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQISLYAQASGRITVSTKRSQQTVIPNIGSRPRVRDIPSRISIYWTIVKPGDILLINSTGNLIAPRGYFKIRSGKSSIMRSDAPIDKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKVDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 724 - protein, 566 aa, Artificial Sequence
  hemagglutinin__InfluenzaA__ABD16527
MKTIIALSYILCLVFAQKLPENDNSTATLCLGHHAVPNGTIVKTITNDQIEVTNATELVQSSSTGGICDSPHQILDGENCTLIDALLGDPQCDGFQNKKWDLFVERSKAYSNCYPYDVPDHASLRSLVASSGTLEFNNESFDWTGVTQNGTSSACKRRSNKSFFSRLNWLTHLKYKYPALNVTMPNNEKFDKLYIWGVHHPGTDSDQISLYAQASGRITVSTKRSQQTVIPNIGSRPRVRDVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCDICI

SEQ ID NO: 725 - protein, 566 aa, Artificial Sequence; identical to SEQ ID NO: 516
  hemagglutinin__InfluenzaA__ABD16538

SEQ ID NO: 726 - protein, 566 aa, Artificial Sequence
  hemagglutinin__InfluenzaA__ABD16549
MKTIIALSYILCLVFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLIASSGTLEFNNESFNWTGVTQNGTSSACKRRSNSSFFSRLNWLTHLKFKYPALNVTMPNNEEFDKLYIWGVHHPGTYNDQISLYAQASGRITVSTKRSQQTVIPNIGSRPRVRDIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAIDQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIVWACQKGNIRCNICI

SEQ ID NO: 727 - protein, 566 aa, Artificial Sequence; identical to SEQ ID NO: 630
  hemagglutinin__InfluenzaA__ABD16560

SEQ ID NO: 728 - protein, 566 aa, Artificial Sequence
  hemagglutinin__InfluenzaA__ABD16571
MKTIIALSYIFCLVVAQKLPGNDNSTATLCLGHHAVPNGTIVKTITNDQIEVTNATELVQSSSTGRICNSPHRILDGKNCTLIDALLGDPHCDSFQNKEWDLFVERSKAYSNCYPYDVPDYASLRSLVASSGTLEFINEDFNWTGVAQSGGSYACKRGSVNSFFSRLNWLHESEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 729 - protein, 566 aa, Artificial Sequence
  hemagglutinin__InfluenzaA__ABD16718
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFIERSKAFSNCYPYDVPDYASLRSLVASSGTLEFINEGFNWTGVTQSGGSYACKRGSVNSFFSRLNWLYESEYKYPALNVTMPNNGKFDKLYIWGVHHPITEKEQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 730 - protein, 566 aa, Artificial Sequence
  hemagglutinin__InfluenzaA__ABD16729
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQNGGSYTCKRGSVNSFFSRLNWLYESESKYPVLNVTMPNNGKFDKLYIWGVHHPSTDKEQTNLYVRASGKVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 731 - protein, 566 aa, Artificial Sequence
  hemagglutinin__InfluenzaA__ABD16751
MKTIIALSYIFCLVFAQDLPGNDNSTATLCLGHHAVPNGTLVKTITNDQIEVTNATELVHSSSTGKICDNPHRILDGINCTLIDALLGDPHCDGFQNEKWDLFVERSKAFSNCYPYDVPDYASLRSLVASSGTLEFINEGFNWTGVTQNGGSSACKRGPDNGFFSRLNWLYKSGSTYPVQNVTMPNNDNSDKLYIWGVHHPSTDKEQTDLYVQASGKVTVSTKRSQQTVIPNVGSRPWVRGLSSRVSIYWTIVKPGDILVINSNGNLIAPRGYFKMRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 732 - protein, 566 aa, Artificial Sequence; identical to SEQ ID NO: 593
  hemagglutinin__InfluenzaA__ABD16762

SEQ ID NO: 733 - protein, 566 aa, Artificial Sequence; identical to SEQ ID NO: 305
  hemagglutinin__InfluenzaA__ABD17323

SEQ ID NO: 734 - protein, 566 aa, Artificial Sequence; identical to SEQ ID NO: 562
  hemagglutinin__InfluenzaA__ABD38134

SEQ ID NO: 735 - protein, 565 aa, Artificial Sequence; identical to SEQ ID NO: 301
  hemagglutinin__InfluenzaA__ABD60779

SEQ ID NO: 736 - protein, 566 aa, Artificial Sequence
  hemagglutinin__InfluenzaA__ABD60790
MKTIIALSYIFCLVLGQDFPGNDNSTATLCLGHHAVPNGTLVKTITNDQIEVTNATELVQSSSTGKICNNPHRILDGIDCTLIDALLGDPHCDGFQNETWDLFVERSKAFSNCYPYDVPDYASLRSLVASSGTLEFINEGFTWTGVTQNGGSNACKRGPDSGFFSRLNWLYKSGSTYPVLNVTMPNNDNFDKLYIWGVHHPSTDQEQTSLYVQASGRVTVSTKRSQQTIIPNIGSRPWVRGLSSRISIYWTIVKPGDILIINSNGNLIAPRGYFKMRTGKSSIMRSDAPIGTCISECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRIIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 737 - protein, 566 aa, Artificial Sequence
  hemagglutinin__InfluenzaA__ABD60801
MKTIIALSYILCLVFAQKLPGNDNSTATLCLGHHAVPNGTLVKTITNDQIEVTNATELVQSSSTGRLCDSPHRILDGKNCTLIDALLGDPHCDGFQNKEWDLFVERSKAYSNCYPYDVPDYASLRSLVASSGTLEFINEDFNWTGVAQDGGSYACRRGSVNSFFSRLNWLHKLEYKYPALNVTMPNNGKFDKLYIWGVHHPSTDSDQTSLYVRASGRVTVSTKRSQQTVIPNIGSRPWVRGQSSRMSIYWTIVKPGDILLINSTGNLIAPRGYFKIRNGKSSIMRSDAPIGNCSSECITPNGSIPNDKPFQNVNRITYGACPRYVKQHTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 738 - protein, 566 aa, Artificial Sequence
  hemagglutinin__InfluenzaA__ABD60812
MKTIIALSYILCLIFAQKLPGNDNSTATLCLGHHAVPNGTIVKTITNDQIEVTNATELVQSSSTGGICDSPHQILDGENCTLIDALLGDPQCDGFQNKKWDLFVERSKAYSNCYPYDVPDYASLRSLVASSGTLEFNNESFNWTGVTQNGTSSACKRRSNNSFFSRLNWLTHLKFKYPALNVTMPNNEKFDKLYIWGVHHPGTDNDQIFLYAQASGRITVSTKRSQQTVIPSIGSRPRVRNIPSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGIGQAADLKSTQAAINQINGKLNRLIGKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVALLGFIMWACQKGNIRCNICI

SEQ ID NO: 739 - protein, 566 aa, Artificial Sequence; identical to SEQ ID NO: 633
  hemagglutinin__InfluenzaA__ABD60823

SEQ ID NO: 740 - protein, 566 aa, Artificial Sequence
  hemagglutinin__InfluenzaA__ABD60845
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVDQNGTSSACKRRSTKSFFSRLNWLHQLKYKYPALNVTMPNNEKFDKLYIWGVHHPSTDSDQISLYAQASGRVTVSTKRSQQTVTPNIGSRPWVRGVSSRISIYWTIVKPGDILLINSTGNLIAPRGYFKIRSGKSSIMRSNALIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 741 - protein, 565 aa, Artificial Sequence
  hemagglutinin__InfluenzaA__ABD60878
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQKALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 742 - protein, 565 aa, Artificial Sequence
  hemagglutinin__InfluenzaA__ABD60889
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 743 - protein, 565 aa, Artificial Sequence
  hemagglutinin__InfluenzaA__ABD60900
MKVKRLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQKALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 744 - protein, 565 aa, Artificial Sequence
  hemagglutinin__InfluenzaA__ABD60911
MKAKLMVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAIDGITNKVNSIIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 745 - protein, 566 aa, Artificial Sequence; identical to SEQ ID NO: 32
  hemagglutinin__InfluenzaA__ABD60922

SEQ ID NO: 746 - protein, 566 aa, Artificial Sequence
  hemagglutinin__InfluenzaA__ABD60933
MKAKLLVLLCALSATDADTICIGYHANNSTDTVDTVLEKNVTVTHSVNLLEDSHNGKLCRLKGIAPLQLGKCSIAGWILGNPECESLVSKKSWSYIAETPNSENGTCYPGYFADYEELREQLSSVSSFERFEIFPKERSWPKHNVTRGVTASCSHKGKSSFYRNLLWLTEKNGSYPNLSKSYVNNKEKEVLVLWGVHHPSNIEDQKTIYRKENAYVSVVSSNYNRRFTPEIAERPKVRGQAGRINYYWTLLEPGDTIIFEANGNLIAPWHAFALNRGFGSGIITSNASMDECDTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 747 - protein, 566 aa, Artificial Sequence
  hemagglutinin__InfluenzaA__ABD60944
MKAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKERSWPKHNVTRGVTASCSHKGKSSFYRNLLWLTEKNGSYPNLSKSYVNNKEKEVLVLWGVHHPSNIEDQKTIYRKENAYVSVVSSNYNRRFTPEIAERPKVRGQAGRINYYWTLLEPGDTIIFEANGNLIAPWYAFALSRGFGSGIITSNASMDECDTKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 748 - protein, 566 aa, Artificial Sequence
  hemagglutinin__InfluenzaA__ABD60955
MKAKLLVLLCAFTATYADTICIGYHANNSTDTVDTVLEKNVTVTHSVNLLEDSHNGKLCRLKGIAPLQLGNCSVAGWILGNPKCESLFSKESWSYIAETPNPENGTCYPGYFADYEELREQLSSVSSFERFEIFPKESSWPNHTVTKGVTTSCSHNGKSSFYRNLLWLTEKNGLYPNLSKSYVNNKEKEVLVLWGVHHPSNIRDQRAIYHTENAYVSVVSSHYSRRFTPEIAKRPKVRDQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENGRTLDFHDSNVKNLYEKVKSQLKNNAKEIGNGCFEFYHKCNNECMESVKNGTYDYPKYSEESKLNRGKIDGVKLESMGVYQILAIYSTVASSLVLLVSLGAISFWMCSNGSLQCRICI

SEQ ID NO: 749 - protein, 566 aa, Artificial Sequence; identical to SEQ ID NO: 32
  hemagglutinin__InfluenzaA__ABD61260

SEQ ID NO: 750 - protein, 566 aa, Artificial Sequence; identical to SEQ ID NO: 32
  hemagglutinin__InfluenzaA__ABD61271

SEQ ID NO: 751 - protein, 566 aa, Artificial Sequence; identical to SEQ ID NO: 286
  hemagglutinin__InfluenzaA__ABD61282

SEQ ID NO: 752 - protein, 566 aa, Artificial Sequence; identical to SEQ ID NO: 516
  hemagglutinin__InfluenzaA__ABD61293

SEQ ID NO: 753 - protein, 566 aa, Artificial Sequence; identical to SEQ ID NO: 738
  hemagglutinin__InfluenzaA__ABD61304

SEQ ID NO: 754 - protein, 566 aa, Artificial Sequence; identical to SEQ ID NO: 650
  hemagglutinin__InfluenzaA__ABD61315

SEQ ID NO: 755 - protein, 566 aa, Artificial Sequence; identical to SEQ ID NO: 72
  hemagglutinin__InfluenzaA__ABD61337

SEQ ID NO: 756 - protein, 566 aa, Artificial Sequence
  hemagglutinin__InfluenzaA__ABD61348
MKTIIALSYILCLVFAQKLPVNDNSTATLCLGHHAVPNGTLVKTITNDHIEVTNATELVQSSSTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNNKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 757 - protein, 566 aa, Artificial Sequence; identical to SEQ ID NO: 72
  hemagglutinin__InfluenzaA__ABD61359

SEQ ID NO: 758 - protein, 566 aa, Artificial Sequence; identical to SEQ ID NO: 710
  hemagglutinin__InfluenzaA__ABD61370

SEQ ID NO: 759 - protein, 566 aa, Artificial Sequence; identical to SEQ ID NO: 650
  hemagglutinin__InfluenzaA__ABD61381

SEQ ID NO: 760 - protein, 566 aa, Artificial Sequence
  hemagglutinin__InfluenzaA__ABD61392
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRGSNKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 761 - protein, 566 aa, Artificial Sequence; identical to SEQ ID NO: 740
  hemagglutinin__InfluenzaA__ABD61403

SEQ ID NO: 762 - protein, 566 aa, Artificial Sequence
  hemagglutinin__InfluenzaA__ABD61529
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYACKRGSVNSFFSRLNWLYESESKYPVLNVTMPNNGKFDKLYIWGVHHPSTDKEQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGRLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 763 - protein, 565 aa, Artificial Sequence; identical to SEQ ID NO: 741
  hemagglutinin__InfluenzaA__ABD61540

SEQ ID NO: 764 - protein, 566 aa, Artificial Sequence
  hemagglutinin__InfluenzaA__ABD61757
MKTIIALSYIFCLVFAQDLPGNDNSTATLCLGHHAVPNGTLVKTITNDQIEVTNATELVQSSSTGKICDNPHRILDGINCTLIDALLGDPHCDGFQNEKWDLFVERSKAFSNCYPYDVPDYASLRSLVASSGTLEFINEGFNWTGVTQNGGSSACKRGPDNGFFSRLNWLYKSGSTYPVQNVTMPNNDNSDKLYIWGVHHPSTDKEQTDLYVQASGKVTVSTKRSQQTVIPNVGSRPWVRGLSSRVSIYWTIVKPGDILVINSNGNLIAPRGYFKMRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 765 - protein, 566 aa, Artificial Sequence
  hemagglutinin__InfluenzaA__ABD61777
MKTIIALSYIFCLGFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYACKRGSVNSFFSRLNWLYESESKYPALNVTMPNNGKFDKLYIWGVHHPSTDKEQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 766 - protein, 566 aa, Artificial Sequence
  hemagglutinin__InfluenzaA__ABD77598
MKTIIALSYILCLVFAQKLPVNDNSTATLCLGHHAVPNGTLVKTITNDHIEVTNATELVQSSPTGRICDSPHQILDGENCTLIDALLGDPHCDGFQNKEWDLFVERSTAYSNCYPYDVPDYASLRSLVASSGTLEFNNESFNWTGVAQNGTSSACKRRSIKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 767 - protein, 566 aa, Artificial Sequence; identical to SEQ ID NO: 650
  hemagglutinin__InfluenzaA__ABD77609

SEQ ID NO: 768 - protein, 566 aa, Artificial Sequence; identical to SEQ ID NO: 650
  hemagglutinin__InfluenzaA__ABD77620

SEQ ID NO: 769 - protein, 566 aa, Artificial Sequence; identical to SEQ ID NO: 650
  hemagglutinin__InfluenzaA__ABD77631

SEQ ID NO: 770 - protein, 566 aa, Artificial Sequence; identical to SEQ ID NO: 650
  hemagglutinin__InfluenzaA__ABD77642

SEQ ID NO: 771 - protein, 566 aa, Artificial Sequence; identical to SEQ ID NO: 650
  hemagglutinin__InfluenzaA__ABD77653

SEQ ID NO: 772 - protein, 565 aa, Artificial Sequence; identical to SEQ ID NO: 741
  hemagglutinin__InfluenzaA__ABD77708

SEQ ID NO: 773 - protein, 565 aa, Artificial Sequence
  hemagglutinin__InfluenzaA__ABD77719
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGDQRALYHTENAYVSVVSSHYSRRFTPEIAKRPKVRNQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 774 - protein, 565 aa, Artificial Sequence; identical to SEQ ID NO: 741
  hemagglutinin__InfluenzaA__ABD77730

SEQ ID NO: 775 - protein, 566 aa, Artificial Sequence; identical to SEQ ID NO: 650
  hemagglutinin__InfluenzaA__ABD77752

SEQ ID NO: 776 - protein, 566 aa, Artificial Sequence; identical to SEQ ID NO: 650
  hemagglutinin__InfluenzaA__ABD77763

SEQ ID NO: 777 - protein, 566 aa, Artificial Sequence
  hemagglutinin__InfluenzaA__ABD77774
MKTIIALSYILCLVFAQKLPVNDNSTATLCLGHHAVPNGTLVKTITNDNIEVTNATELVQSSSTGRICDSPHQILDGENCTLIDALLGDPHCDGFQNKEWDLFVERSTAYSNCYPYDVPDYASLRSLVASSGTLEFNNESFNWTGVDQNGTSSACKRRSNKSFFSRLNWLHQLKYKYPALNVTMPNNEKFDKLYIWGVHHPSTDSDQISLYAQASGRVTVSTKRSQQTVIPNIGSRPWVRGVSSRISIYWTIVKPGDILLINSTGNLIAPRGYFKIRSGKSSIMRSNAPIGKCNSECITQNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 778 - protein, 566 aa, Artificial Sequence; identical to SEQ ID NO: 777
  hemagglutinin__InfluenzaA__ABD77785

SEQ ID NO: 779 - protein, 566 aa, Artificial Sequence
  hemagglutinin__InfluenzaA__ABD77807
MKAKLLILLCALSATDADTICIGYHANNSTDTVDTVLEKNVTVTHSVNLLEDSHNGKLCRLKGIAPLQLGKCNIAGWILGNPECESLLSKRSWSYIAETPNSENGTCYPGDFADYEELREQLSSVSSFERFEIFPKERSWPKHNITRGVTAACSHAGKSSFYKNLLWLTETNGSYPKLSKSYVNNKEKEVLVLWGVHHPSNIEDQKTLYRKENAYVSVVSSNYNRRFTPEIAERPKVRGQAGRMNYYWTLLEPGDTIIFEANGNLIAPWYAFALSRGFGSGIITSNASMDECDTKCQTPQGAINSSLPFQNIHPVTIGECPKYVKSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKNQLRNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 780 - protein, 566 aa, Artificial Sequence
  hemagglutinin__InfluenzaA__ABD77818
MKAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKESSWPKHTVTRGVTASCSHKGKSSFYRNLLWLTEKNGSYPNLSKSYVNNKEKEVLVLWGVHHPSNIEDQKTIYRKENAYVSVVSSHYNRRFTPEIAKRPKVRDQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKSNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 781 - protein, 566 aa, Artificial Sequence
  hemagglutinin__InfluenzaA__ABD77829
MKTIIALSYILYLVFAQKLPGNDNSTATLCLGHHAVPNGTLVKTITNDQIEVTNATELVQSSSTGRLCDSPHRILDGKNCTLIDALLGDPHCDGFQNKEWDLFVERSKAYSDCYPYDVPDYASLRSLVASSGTLEFTNEGFNWTGVAQNGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 782 - protein, 566 aa, Artificial Sequence
  hemagglutinin__InfluenzaA__ABD77862
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSDCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSIYVQASGRVTVSTKRSQQTVIPNIGSRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 783 - protein, 566 aa, Artificial Sequence
  hemagglutinin__InfluenzaA__ABD77884
MKTIIALSYILCLVFAQKLPGNDNSTATLCLGHHAVPNGTLVKTITNDQIEVTNATELVQGSSTGRICDSPHRILDGKNCTLIDALLGDPHCDGFQNKEWDLFVERSKAYSNCYPYDVPDYASLRSLVASSGTLEFNNESFNWTGVAQNGTSYACKRRSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 784 - protein, 566 aa, Artificial Sequence
  hemagglutinin__InfluenzaA__ABD77895
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFNNESFNWTGVAQNGTSYACKRRSVKSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRSGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQISGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 785 - protein, 566 aa, Artificial Sequence; identical to SEQ ID NO: 783
  hemagglutinin__InfluenzaA__ABD77906

SEQ ID NO: 786 - protein, 565 aa, Artificial Sequence
  hemagglutinin__InfluenzaA__ABD77917
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKEVLVLWGVHHPPNIGNQKALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 787 - protein, 565 aa, Artificial Sequence
  hemagglutinin__InfluenzaA__ABD77928
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYANNKEKKVLVLWGVHHPPNIGDQKALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 788 - protein, 565 aa, Artificial Sequence; identical to SEQ ID NO: 742
  hemagglutinin__InfluenzaA__ABD77939

SEQ ID NO: 789 - protein, 565 aa, Artificial Sequence; identical to SEQ ID NO: 742
  hemagglutinin__InfluenzaA__ABD77950

SEQ ID NO: 790 - protein, 565 aa, Artificial Sequence; identical to SEQ ID NO: 741
  hemagglutinin__InfluenzaA__ABD77961

SEQ ID NO: 791 - protein, 565 aa, Artificial Sequence; identical to SEQ ID NO: 742
  hemagglutinin__InfluenzaA__ABD77983

SEQ ID NO: 792 - protein, 565 aa, Artificial Sequence; identical to SEQ ID NO: 742
  hemagglutinin__InfluenzaA__ABD77994

SEQ ID NO: 793 - protein, 565 aa, Artificial Sequence; identical to SEQ ID NO: 741
  hemagglutinin__InfluenzaA__ABD78005

SEQ ID NO: 794 - protein, 565 aa, Artificial Sequence; identical to SEQ ID NO: 741
  hemagglutinin__InfluenzaA__ABD78016

SEQ ID NO: 795 - protein, 565 aa, Artificial Sequence; identical to SEQ ID NO: 742
  hemagglutinin__InfluenzaA__ABD78027

SEQ ID NO: 796 - protein, 565 aa, Artificial Sequence; identical to SEQ ID NO: 742
  hemagglutinin__InfluenzaA__ABD78038

SEQ ID NO: 797 - protein, 566 aa, Artificial Sequence; identical to SEQ ID NO: 777
  hemagglutinin__InfluenzaA__ABD78049

SEQ ID NO: 798 - protein, 565 aa, Artificial Sequence; identical to SEQ ID NO: 296
  hemagglutinin__InfluenzaA__ABD78060

SEQ ID NO: 799 - protein, 565 aa, Artificial Sequence
  hemagglutinin__InfluenzaA__ABD78071
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSGGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 800 - protein, 565 aa, Artificial Sequence
  hemagglutinin__InfluenzaA__ABD78093
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 801 - protein, 566 aa, Artificial Sequence
  hemagglutinin__InfluenzaA__ABD78115
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSDCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRNEALNNRFQIKGVELKSGYKDWILWISFAISCFLLCVVLLGFIMWACQKGNIRCNICI

SEQ ID NO: 802 - protein, 566 aa, Artificial Sequence
  hemagglutinin__InfluenzaA__ABD78126
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSDCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSIISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 803 - protein, 566 aa, Artificial Sequence
  hemagglutinin__InfluenzaA__ABD79032
MKTIIALSYIFCLVLGQDFPGNDNSTATLCLGHHAVPNGTLVKTITNDQIEVTNATELVQSSSTGKICNNPHRILDGIDCTLIDALLGDPHCDGFQNETWDLFVERSKAFSNCYPYDVPDYASLRSLVASSGTLEFISEGFTWTGVTQNGGSNACKRGPDIGFFSRLNWLYKSGSTYPVLNVTMPNNDNFDKLYIWGVHHPSTDQEQTSLYVQASGRVTVSTKRSQQTIIPNIGSRPWVRGLSSRISIYWTIVKPGDILVINSNGNLIAPRGYFKMRTGKSSIMRSDAPIGTCISECITPNGSIPNDKPFQNVNKITYGACPKYVKQNTLKLATGMRNVPEKQTRGLFSAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 804 - protein, 566 aa, Artificial Sequence
  hemagglutinin__InfluenzaA__ABD79112
MKAKLLILLCALSATDADTICIGYHANNSTDTVDTVLEKNVTVTHSVNLLEDSHNGKLCRLKGIAPLQLGKCNIAGWILGNPECESLLSKRSWSYIAETPNSENGACYPGDFADYEELREQLSSVSSFERFEIFPKGRSWPEHNIDIGVTAACSHAGKSSFYKNLLWLTEKDGSYPNLNKSYVNKKEKEVLILWGVHHPPNIENQKTLYRKENAYVSVVSSNYNRRFTPEIAERPKVRGQAGRINYYWTLLEPGDTIIFEANGNLIAPWYAFALNRGIGSGIITSNASMDECDTKCQTPQGAINSSLPFQNIHPFTIGECPKYVRSTKLRMVTGLRNIPSIQSRGLFGAIAGFIEGGWDGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKNQLRNNAKEIGNGCFEFYHKCNNECMESVKNGTYDYPKFSEESKLNREKIDGVKLESMGVYQILAIYSTVASSLVLLVSLGAISFWMCSNGSLQCRICI

SEQ ID NO: 805 - protein, 566 aa, Artificial Sequence
  hemagglutinin__InfluenzaA__ABD79123
MKTIIALSYILCLVFAQKLPGNDNSTATLCLGHHAVPNGTLVKTITNDQIEVTNATELVQSSSTGRICDSPHQILDGKNCTLIDALLGDPHCDGFQNKEWDLFVERSTAYSNCYPYDVPDYASLRSLVASSGTLEFTKEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIDNCNSECITPNGSISNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFRIYHKCDNACIGSIRNGTYDHDVYRDEALNNRFQIKGVELKSGYKDWILWISFAISCFLLCVVLLGFIMWACQKGNIRCNICI

SEQ ID NO: 806 - protein, 566 aa, Artificial Sequence
  hemagglutinin__InfluenzaA__ABD79134
MKTIIALSYILCLVFAQKLPGNDNSTATLCLGHHAVPNGTLVKTITNDQIEVTNATELVQSSSTGRICDSPHQILDGKNCTLIDALLGDPHCDGFQNKKWDLFVERSTAYSNCYPYDVPDYASLRSLVASSGTLEFTKEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIDNCNSECITPNGSISNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 807 - protein, 566 aa, Artificial Sequence
  hemagglutinin__InfluenzaA__ABD79145
MKTIIALSYILCLVFAQKLPGNDNSTATLCLGHHAVPNGTLVKTITNDQIEVTNATELVQSSSTGRICDSPHQILDGKNCTLIDALLGDPHCDGFQNKEWDLFVERSTAYSNCYPYDVPDYASLRSLVASSGTLEFTKEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIDNCNSECITPNGSISNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 808 - protein, 566 aa, Artificial Sequence; identical to SEQ ID NO: 807
  hemagglutinin__InfluenzaA__ABD79156

SEQ ID NO: 809 - protein, 566 aa, Artificial Sequence; identical to SEQ ID NO: 23
  hemagglutinin__InfluenzaA__ABD79167

SEQ ID NO: 810 - protein, 566 aa, Artificial Sequence; identical to SEQ ID NO: 807
  hemagglutinin__InfluenzaA__ABD79178

SEQ ID NO: 811 - protein, 566 aa, Artificial Sequence
  hemagglutinin__InfluenzaA__ABD79189
MKTIIALSYILCLVFAQKLPGNDNSTATLCLGHHAVPNGTLVKTITNDQIEVTNATELVQSSSTGRICDSPHQILDGKNCTLIDALLGDPHCDGFQNKEWDLFVERSTAYSNCYPYDVPDYASLRSLVASSGTLEFTKEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTVVKPGDILLINSTGNLIAPRGYFKIRSGKSSIMRSDAPIDSCNSECITPNGSISNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 812 - protein, 566 aa, Artificial Sequence; identical to SEQ ID NO: 807
  hemagglutinin__InfluenzaA__ABD79200

SEQ ID NO: 813 - protein, 566 aa, Artificial Sequence
  hemagglutinin__InfluenzaA__ABD79211
MKTIIALSYILCLVFAQKLPGNDNSTATLCLGHHAVPNGTLVKTITNDQIEVTNATELVQSSSTGRICDSPHQILDGKNCTLIDALLGDPHCDGFQNKEWDLFVERSTAYSNCYPYDVPDYASLRSLVASSGTLEFTKEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWIRGVSSRISIYWTIVKPGDILLINSTGNLIAPRGYFKIRSGKSSIMRSDAPIDNCNSECITPNGSISNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 814 - protein, 566 aa, Artificial Sequence; identical to SEQ ID NO: 23
  hemagglutinin__InfluenzaA__ABD79222

SEQ ID NO: 815 - protein, 566 aa, Artificial Sequence; identical to SEQ ID NO: 23
  hemagglutinin__InfluenzaA__ABD79233

SEQ ID NO: 816 - protein, 566 aa, Artificial Sequence
  hemagglutinin__InfluenzaA__ABD79244
MKTIIALSYILCLVFAQKLPGNDNSTATLCLGHHAVPNGTLVKTITNDQIEVTNATELVQSSSTGRICDSPHQILDGKNCTLIDALLGDPHCDGFKNKEWDLFVERSTAYSNCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 817 - protein, 566 aa, Artificial Sequence; identical to SEQ ID NO: 243
  hemagglutinin__InfluenzaA__ABD94734

SEQ ID NO: 818 - protein, 566 aa, Artificial Sequence; identical to SEQ ID NO: 630
  hemagglutinin__InfluenzaA__ABD94745

SEQ ID NO: 819 - protein, 566 aa, Artificial Sequence
  hemagglutinin__InfluenzaA__ABD94767
MKTIIALSYILCLVFAQKLPVNDNSTATLCLGHHAVPNGTLVKTITNDNIEVTNATELVQSSSTGRICDSPHQILDGENCTLIDALLGDPHCDGFQNKEWDLFVERSTAYSNCYPYDVPDYASLRSLVASSGTLEFNNESFNWTGVDQNGTSSACKRRSNKSFFSRLNWLHQLKYKYPALNVTMPNNEKFDKLYIWGVHHPSTDSDQISLYAQASGRVTVSTKRSQQNVIPNIGSRPWVRGVSSRISIYWTIVKPGDILLINSTGNLIAPRGYFKIRSGKSSIMRSNAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 820 - protein, 565 aa, Artificial Sequence; identical to SEQ ID NO: 800
  hemagglutinin__InfluenzaA__ABD94778

SEQ ID NO: 821 - protein, 565 aa, Artificial Sequence; identical to SEQ ID NO: 800
  hemagglutinin__InfluenzaA__ABD94789

SEQ ID NO: 822 - protein, 566 aa, Artificial Sequence
  hemagglutinin__InfluenzaA__ABD94822
MKTIIALSYILCLVFAQKIPGNDNSTATLCLGHHAVPNGTLVKTITNDQIEVTNATELVQSSSTGRICDSPHRILDGENCTLIDALLGDPHCDGFQNKEWDLFVERSKAYSNCYPYDVPDYASLRSLVASSGTLEFNNESFNWTGVAQNGTSYACKRSSIKSFFSRLNWLHQLKYKYPALNVTMPNNDKFDKLYIWGVHHPSTDSDQTSLYAQASGRVTVSTKRSQQTVIPNIGSRPWVRGVSSRISIYWTIVKPGDILLINSTGNLIAPRGYFKIRSGKSSIMRSDAPIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 823 - protein, 566 aa, Artificial Sequence
  hemagglutinin__InfluenzaA__ABD94833
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSDCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 824 - protein, 566 aa, Artificial Sequence
  hemagglutinin__InfluenzaA__ABD94844
MKTIIALSYILCMVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFNNESFNWTGVAQNGTSYACKRRSVKSFFSRLNWLHKLEYKYPALNVTMPNNDKFDKLYIWGVHHPSTDSDQTSLYVQASGRVTVSTKRSQQTVIPNIGSRPWVRGVSSIISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 825 - protein, 566 aa, Artificial Sequence
  hemagglutinin__InfluenzaA__ABD94855
MKTIIALSYILCLVFAQKLPGNDNSTATLCLGHHAVPNGTLVKTITNDQIEVTNATELVQGSSTGRICDSPHRILDGKNCTLIDALLGDPHCDGFQNKEWDLFVERSKAYSNCYPYDVPDYASLRSLVASSGTLEFNNESFNWTGVAQNGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 826 - protein, 566 aa, Artificial Sequence
  hemagglutinin__InfluenzaA__ABD94866
MKTIIALSYISCLVFAQKLPGNDNSTATLCLGHHAVPNGTLVKTITNDQIEVTNATELVQSSSTGRICDGPHQILDGKNCTLIDALLGDPHCDGFQNKEWDLFVERSKAYSNCYPYDVPDYASLRSLVASSGTLEFTNESFNWTGVAQNGTSYACKRGSVKSFFSRLNWLHKLEYKYPALNVTMPNNDKFDKLYIWGVHHPSTDSDQTSLYVQSSGRITVSTKRSQQTVTPNIGSRPWVRGVSSRISIYWTIVKPGDILLITSTGNLIAPRGYFKIRRGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 827 - protein, 566 aa, Artificial Sequence
  hemagglutinin__InfluenzaA__ABD94877
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFNNESFNWTGVAQNGTSYACKRRSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 828 - protein, 566 aa, Artificial Sequence
  hemagglutinin__InfluenzaA__ABD94888
MKTIIALSYILCLVFAQKLPGNDNSTATLCLGHHAVPNGTLVKTITNDQIEVTNATELVQSSSTGRICDSPHRILDGKNCTLIDALLGDPHCDGFKNKEWDLFVERSTAYSNCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 829 - protein, 566 aa, Artificial Sequence; identical to SEQ ID NO: 807
  hemagglutinin__InfluenzaA__ABD94899

SEQ ID NO: 830 - protein, 566 aa, Artificial Sequence
  hemagglutinin__InfluenzaA__ABD94910
MKTIIALSYILCLVFAQKLPGNDNSTATLCLGHHAVPNGTLVKTITNDQIEVTNATELVQNSSTGRICDSPHRILDGKNCTLIDALLGDPHCDGFQNKEWDLFVERSKAYSNCYPYDVPDYASLRSLVASSGTLEFNNESFNWTGVAQNGTSYACKRRSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFRIYHKCDNACIGSIRNGTYDHDVYRDEALNNRFQIKGVELKSGYKDWILWISFAISCFLLCVVLLGFIMWACQKGNIRCNICI

SEQ ID NO: 831 - protein, 566 aa, Artificial Sequence
  hemagglutinin__InfluenzaA__ABD94921
MKTIIALSYILCLVFAQKLPGNDNSTATLCLGHHAVPNGTLVKTITNDQIEVTNATELVQSSSTGRICDGPHQILDGKNCTLIDALLGDPHCDGFQNKEWDLFVERSKAYSNCYPYDVPDYASLRSLVASSGTLEFTNESFNWTGVAQNGTSYACKRGSVKSFFSRLNWLHKLEYKYPALNVTMPNNDKFDKLYIWGVHHPSTDSDQTSLYVQSSGRVTVSTKRSQQTVTPNIGSRPWVRGVSSRISIYWTIVKPGDILLINSTGNLIAPRGYFKIRRGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 832 - protein, 566 aa, Artificial Sequence; identical to SEQ ID NO: 807
  hemagglutinin__InfluenzaA__ABD94932

SEQ ID NO: 833 - protein, 565 aa, Artificial Sequence
  hemagglutinin__InfluenzaA__ABD94943
MKVKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGACYPGYFADYEELREQLSSVSSFERFEIFPKESSWPNHTVTGVSASCSHNGKSSFYRNLLWLTGKNGLYPNLSKSYANNKKKEVLILWGVHHPPNIGDQRTLYHTENAYVSVVSSHYSRRFTPEITKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLDSMGVYQILAIYSTVASSLVLLVSLGAISFWMCSNGSLQCRICI

SEQ ID NO: 834 - protein, 566 aa, Artificial Sequence; identical to SEQ ID NO: 633
  hemagglutinin__InfluenzaA__ABD94954

SEQ ID NO: 835 - protein, 565 aa, Artificial Sequence; identical to SEQ ID NO: 742
  hemagglutinin__InfluenzaA__ABD94965

SEQ ID NO: 836 - protein, 565 aa, Artificial Sequence; identical to SEQ ID NO: 741
  hemagglutinin__InfluenzaA__ABD94987

SEQ ID NO: 837 - protein, 565 aa, Artificial Sequence; identical to SEQ ID NO: 741
  hemagglutinin__InfluenzaA__ABD94998

SEQ ID NO: 838 - protein, 565 aa, Artificial Sequence; identical to SEQ ID NO: 741
  hemagglutinin__InfluenzaA__ABD95009

SEQ ID NO: 839 - protein, 565 aa, Artificial Sequence; identical to SEQ ID NO: 742
  hemagglutinin__InfluenzaA__ABD95020

SEQ ID NO: 840 - protein, 565 aa, Artificial Sequence
  hemagglutinin__InfluenzaA__ABD95031
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFTDYEELREQLSSVSSFERFEIFPKESSWPNHTVTGVSASCSHNGKSSFYRNLLWLTGKNGLYPNLRRSYANNKEKEVLVLWGVHHPPNIGDQKALYHTENAYVSVVSSHYSRRFTPEIAKRPKVRGQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSIIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 841 - protein, 565 aa, Artificial Sequence
  hemagglutinin__InfluenzaA__ABD95042
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKGKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 842 - protein, 565 aa, Artificial Sequence; identical to SEQ ID NO: 841
  hemagglutinin__InfluenzaA__ABD95053

SEQ ID NO: 843 - protein, 565 aa, Artificial Sequence; identical to SEQ ID NO: 800
  hemagglutinin__InfluenzaA__ABD95064

SEQ ID NO: 844 - protein, 565 aa, Artificial Sequence
  hemagglutinin__InfluenzaA__ABD95075
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSKGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 845 - protein, 565 aa, Artificial Sequence; identical to SEQ ID NO: 841
  hemagglutinin__InfluenzaA__ABD95086

SEQ ID NO: 846 - protein, 565 aa, Artificial Sequence; identical to SEQ ID NO: 800
  hemagglutinin__InfluenzaA__ABD95097

SEQ ID NO: 847 - protein, 565 aa, Artificial Sequence
  hemagglutinin__InfluenzaA__ABD95119
MKAKLLILLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 848 - protein, 565 aa, Artificial Sequence
  hemagglutinin__InfluenzaA__ABD95130
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGSYPNLSMSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 849 - protein, 565 aa, Artificial Sequence; identical to SEQ ID NO: 800
  hemagglutinin__InfluenzaA__ABD95141

SEQ ID NO: 850 - protein, 565 aa, Artificial Sequence; identical to SEQ ID NO: 800
  hemagglutinin__InfluenzaA__ABD95152

SEQ ID NO: 851 - protein, 565 aa, Artificial Sequence; identical to SEQ ID NO: 847
  hemagglutinin__InfluenzaA__ABD95163

SEQ ID NO: 852 - protein, 565 aa, Artificial Sequence; identical to SEQ ID NO: 841
  hemagglutinin__InfluenzaA__ABD95174

SEQ ID NO: 853 - protein, 565 aa, Artificial Sequence
  hemagglutinin__InfluenzaA__ABD95185
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGESSFYRNLLWLTGKNGLYPNLSMSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 854 - protein, 565 aa, Artificial Sequence; identical to SEQ ID NO: 841
  hemagglutinin__InfluenzaA__ABD95196

SEQ ID NO: 855 - protein, 565 aa, Artificial Sequence; identical to SEQ ID NO: 299
  hemagglutinin__InfluenzaA__ABD95207

SEQ ID NO: 856 - protein, 565 aa, Artificial Sequence; identical to SEQ ID NO: 800
  hemagglutinin__InfluenzaA__ABD95218

SEQ ID NO: 857 - protein, 565 aa, Artificial Sequence; identical to SEQ ID NO: 847
  hemagglutinin__InfluenzaA__ABD95229

SEQ ID NO: 858 - protein, 565 aa, Artificial Sequence; identical to SEQ ID NO: 800
  hemagglutinin__InfluenzaA__ABD95240

SEQ ID NO: 859 - protein, 565 aa, Artificial Sequence; identical to SEQ ID NO: 841
  hemagglutinin__InfluenzaA__ABD95251

SEQ ID NO: 860 - protein, 565 aa, Artificial Sequence; identical to SEQ ID NO: 299
  hemagglutinin__InfluenzaA__ABD95262

SEQ ID NO: 861 - protein, 565 aa, Artificial Sequence; identical to SEQ ID NO: 800
  hemagglutinin__InfluenzaA__ABD95273

SEQ ID NO: 862 - protein, 565 aa, Artificial Sequence; identical to SEQ ID NO: 296
  hemagglutinin__InfluenzaA__ABD95284

SEQ ID NO: 863 - protein, 565 aa, Artificial Sequence; identical to SEQ ID NO: 800
  hemagglutinin__InfluenzaA__ABD95295

SEQ ID NO: 864 - protein, 565 aa, Artificial Sequence
  hemagglutinin__InfluenzaA__ABD95306
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEILVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 865 - protein, 565 aa, Artificial Sequence; identical to SEQ ID NO: 841
  hemagglutinin__InfluenzaA__ABD95328

SEQ ID NO: 866 - protein, 566 aa, Artificial Sequence
  hemagglutinin__InfluenzaA__ABD95339
MKAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKESSWPKHSVTRGVTASCSHKGKSSFYRNLLWLTEKNGSYPNLSKSYVNDKEKEVLVLWGVHHPSNIEDQKTIYRKENAYVSVVSSHYNRRFTPEIAKRPKVRDQEGRINYYWTLLEPGDTIIFEANGNLIAPWYAFALSRGFGSGIITSNVSMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 867 - protein, 565 aa, Artificial Sequence; identical to SEQ ID NO: 742
  hemagglutinin__InfluenzaA__ABE11657

SEQ ID NO: 868 - protein, 565 aa, Artificial Sequence
  hemagglutinin__InfluenzaA__ABE11668
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSMSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 869 - protein, 565 aa, Artificial Sequence
  hemagglutinin__InfluenzaA__ABE11679
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGRNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNDECMESVKNGTYDYPKYSEESKLNREKIDGVKLESMGVYQILAIYSTVASSLVLLVSLGAISFWMCSNGSLQCRICI

SEQ ID NO: 870 - protein, 565 aa, Artificial Sequence
  hemagglutinin__InfluenzaA__ABE11690
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 871 - protein, 565 aa, Artificial Sequence
  hemagglutinin__InfluenzaA__ABE11701
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGDQKALYHTENAYVSVVSSHYSRRFTPEIAKRPKVRDQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSIIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 872 - protein, 565 aa, Artificial Sequence; identical to SEQ ID NO: 800
  hemagglutinin__InfluenzaA__ABE11712

SEQ ID NO: 873 - protein, 565 aa, Artificial Sequence; identical to SEQ ID NO: 841
  hemagglutinin__InfluenzaA__ABE11723

SEQ ID NO: 874 - protein, 565 aa, Artificial Sequence; identical to SEQ ID NO: 847
  hemagglutinin__InfluenzaA__ABE11734

SEQ ID NO: 875 - protein, 565 aa, Artificial Sequence; identical to SEQ ID NO: 800
  hemagglutinin__InfluenzaA__ABE11812

SEQ ID NO: 876 - protein, 565 aa, Artificial Sequence; identical to SEQ ID NO: 841
  hemagglutinin__InfluenzaA__ABE11823

SEQ ID NO: 877 - protein, 565 aa, Artificial Sequence; identical to SEQ ID NO: 841
  hemagglutinin__InfluenzaA__ABE11834

SEQ ID NO: 878 - protein, 565 aa, Artificial Sequence; identical to SEQ ID NO: 841
  hemagglutinin__InfluenzaA__ABE11845

SEQ ID NO: 879 - protein, 565 aa, Artificial Sequence; identical to SEQ ID NO: 847
  hemagglutinin__InfluenzaA__ABE11856

SEQ ID NO: 880 - protein, 566 aa, Artificial Sequence
  hemagglutinin__InfluenzaA__ABE11900
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPNLSKSYVNNKEKEVLVLWGVHHPSNIGDQRAIYHTENAYVSVVSSHYSRRFTPEIAKRPKVRDQEGRINYYWTLLEPGDTIIFEANGNLIAPWYAFALSRGFGSGIITSNASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKTQLKNNAKEIGNGCFEFYHKCNNECMESVKNGTYDYPKYSEESKLNREKIDGVKLESMGVYQILAIYSTVASSLVLLISLGAISFWMCSNGSLQCRICI

SEQ ID NO: 881 - protein, 566 aa, Artificial Sequence
  hemagglutinin__InfluenzaA__ABE11942
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPSLSKSYVNNKEKEVLVLWGVHHPSNIGDQRAIYHTENAYVSVVSSHYSRRFTPEIAKRPKVRDQEGRINYYWTLLEPGDTIIFEANGNLIAPWYAFALSRGFGSGIITSNASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKTQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 882 - protein, 566 aa, Artificial Sequence
  hemagglutinin__InfluenzaA__ABE12078
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKPGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFEKTKKQLRENAEDMGNGCFKIYHKCDNACIGSIRNGTYDHDVYRDEALNNRFQIKGVELKSGYKDWILWISFAISCFLLCVVLLGFIMWACQKGNIRCSICI

SEQ ID NO: 883 - protein, 566 aa, Artificial Sequence; identical to SEQ ID NO: 777
  hemagglutinin__InfluenzaA__ABE12123

SEQ ID NO: 884 - protein, 565 aa, Artificial Sequence; identical to SEQ ID NO: 800
  hemagglutinin__InfluenzaA__ABE12248

SEQ ID NO: 885 - protein, 566 aa, Artificial Sequence
  hemagglutinin__InfluenzaA__ABE12623
MKTIIALSYIFCLVLGQDLPGNDNSTATLCLGHHAVPNGTLVKTITNDQIEVTNATELVQSSSTGKICNNPHRILDGIDCTLIDALLGDPHCDGFQNETWDLFVERSKAFSNCYPYDVPDYASLRSLVASSGTLEFINEGFTWTGVTQNGGSNACKRGPDSGFFSRLNWLYKSGSTYPVLNVTMPNNDNFDKLYIWGVHHPSTNQEQTSLYVQASGRVTVSTKRSQQTIIPNIGSRPWVRGLSSRISIYWTIVKPGDILVINSNGNLIAPRGYFKMRTGKSSIMRSDAPIGTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFRIYHKCDNACIGSIRNGTYDHDVYRDEALNNRFQIKGVELKSGYKDWILWISFAISCFLLCVVLLGFIMWACQKGNIRCNICI

SEQ ID NO: 886 - protein, 566 aa, Artificial Sequence; identical to SEQ ID NO: 830
  hemagglutinin__InfluenzaA__ABE12645

SEQ ID NO: 887 - protein, 566 aa, Artificial Sequence; identical to SEQ ID NO: 807
  hemagglutinin__InfluenzaA__ABE13076

SEQ ID NO: 888 - protein, 566 aa, Artificial Sequence; identical to SEQ ID NO: 783
  hemagglutinin__InfluenzaA__ABE13323

SEQ ID NO: 889 - protein, 566 aa, Artificial Sequence
  hemagglutinin__InfluenzaA__ABE13471
MKTIIALSYILCLVFAQKLPGNDNSTATLCLGHHAVPNGTLVKTITNDQIEVTNATELVQNSSTGRICDSPHRILDGKNCTLIDALLGDPHCDGFQNKEWDLFVERSKAYSNCYPYDVPDYASLRSLVASSGTLEFYNESFNWTGVAQNGTSYACKRRSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFRIYHKCDNACIGSIRNGTYDHDVYRDEALNNRFQIKGVELKSGYKDWILWISFAISCFLLCVVLLGFIMWACQKGNIRCNICI

SEQ ID NO: 890 - protein, 566 aa, Artificial Sequence
  hemagglutinin__InfluenzaA__ABE13555
MKTIIALSYILCLVFAQKLPGNDNSTATLCLGHHAVPNGTLVKTITNDQIEVTNATELVQGSSTGRICDSPHRILDGKNCTLIDALLGDPHCDGFQNKEWDLFVERSKAYSNCYPYDVPDYASLRSLVASSGTLEFNNESFNWTGVAQNGTSYACKRRSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLISSTGNLIAPRGYFKIRSGKSSIMRSDAPIDNCNSECITPNGSIPNDKPFQNVNRITYGACPRYVKQNTLKLATGMRNVPEKQTKGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAMSCFLLCVVLLGFIMWACQKGNIRCNICI

SEQ ID NO: 891 - protein, 566 aa, Artificial Sequence
  hemagglutinin__InfluenzaA__ABE13606
MKTIIALSYILCLVFAQKLPGNDNSTATLCLGHHAVPNGTLVKTITNDQIEVTNATEMVQSSSTGRICDSPHRILDGKNCTLIDALLGDPHCDGFQNKEWDLFVERSKAYSNCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLIALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 892 - protein, 566 aa, Artificial Sequence
  hemagglutinin__InfluenzaA__ABE13628
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGKSYACKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 893 - protein, 566 aa, Artificial Sequence
  hemagglutinin__InfluenzaA__ABE13824
MKTIIALSYILCQVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGKSYACKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 894 - protein, 566 aa, Artificial Sequence; identical to SEQ ID NO: 893
  hemagglutinin__InfluenzaA__ABE14019

SEQ ID NO: 895 - protein, 566 aa, Artificial Sequence
  hemagglutinin__InfluenzaA__ABE14030
MKTIIALSYILCLVFAQKLPGNDNSTATLCLGHHAVPNGTLVKTITNDQIEVTNATELVQSSSIGRICDSPHRILDGKNCTLIDALLGDPHCDGFQNKEWDLFVERSKAYSNCYPYDVPDYASLRSLVASSGTLEFTNEGFNWTGVAQDGKSYACKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 896 - protein, 566 aa, Artificial Sequence; identical to SEQ ID NO: 892
  hemagglutinin__InfluenzaA__ABE14041

SEQ ID NO: 897 - protein, 566 aa, Artificial Sequence; identical to SEQ ID NO: 893
  hemagglutinin__InfluenzaA__ABE14063

SEQ ID NO: 898 - protein, 566 aa, Artificial Sequence
  hemagglutinin__InfluenzaA__ABE14124
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGTSYACKRGSVKSFFSRLNWLHKLEYKYPALNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLIALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 899 - protein, 566 aa, Artificial Sequence
  hemagglutinin__InfluenzaA__ABE14464
MKTIIALSYILCQVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGKSYACKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIDNCNSECITPNGSIPNDKPFQNVNRITYGACPRYVKQNTLKLATGMRNVPEKQTRGIFGAIAGFIENGWEGMIDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 900 - protein, 566 aa, Artificial Sequence
  hemagglutinin__InfluenzaA__ABE14840
MKTIIALSYILCLVFAQKLPRNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGKSYACKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLISSTGNLIAPRGYFKIRNGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCSICI

SEQ ID NO: 901 - protein, 566 aa, Artificial Sequence
  hemagglutinin__InfluenzaA__ABE15578
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTNEGFNWTGVAQDGKSYACKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPIDNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCSICI

SEQ ID NO: 902 - protein, 566 aa, Artificial Sequence
  hemagglutinin__InfluenzaA__ABE26991
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPNLSKSYVNNKEKEVLVLWGVHHPSNIGDQRAIYHTENAYVSVVSSHYSRRFTPEIAKRPKVRDQEGRINYYWTLLEPGDTIIFEANGNLIAPWYAFALSRGFGSGIITSNASMGDCDAKCQTPQGAINSSLPFQNVHPVTIGECPKYVRSTKLRMVTGLRNIPSIQSRGLFGAIAGFIEGGWTGMIDGWYGYHHQNEQGSGYAADKKSTQNAIDGITNKVNSVIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSEESTLKREKIDGVKLESMGVYQILAIYSTVASSLVLLVSLGAISFWMCSNGSLQCRICI

SEQ ID NO: 903 - protein, 566 aa, Artificial Sequence
  hemagglutinin__InfluenzaA__ABF47550
MKTIIALSYIFCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAYSNCYPYDVPDYASLRSLVASSGTLEFINEDFNWTGVTQSGGSYACKRGSVNSFFSRLNWLHESEYKYPALNVTMPNNGKFDKLYIWGVHHPSTDREQTNLYVRASGRVTVSTKRSQQTVIPNIGSRPWVRGLSSRISIYWTIVKPGDILLINSTGNLIAPRGYFKIRTGKSSIMRSDAPIGTCSSECITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 904 - protein, 565 aa, Artificial Sequence
  hemagglutinin__InfluenzaA__ABF47561
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPKLSMSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 905 - protein, 565 aa, Artificial Sequence
  hemagglutinin__InfluenzaA__ABF47572
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKDKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 906 - protein, 565 aa, Artificial Sequence; identical to SEQ ID NO: 800
  hemagglutinin__InfluenzaA__ABF47583

SEQ ID NO: 907 - protein, 566 aa, Artificial Sequence
  hemagglutinin__InfluenzaA__ABF47594
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFNNESFNWTGVAQNGTSYACKRRSVKSFFSRLNWLHKLEYKYPAQNVTMPNNDKFDKLYIWGVHHPSTDSDQTSLYVQASGRVTVSTKRSQQTVIPNIGSRPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 908 - protein, 566 aa, Artificial Sequence
  hemagglutinin__InfluenzaA__ABF47605
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPNLSKSYVNNKEKEVLVLWGVHHPSNIGDQRAIYHTENAYVSVVSSHYSRRFTPEIAKRPKVRDQEGRINYYWTLLEPGDTIIFEASGNLIAPWYAFALSRGFGSGIITSNASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADKKSTQNAIDGITNKVNSVIEKMNTQFTAVGKEFNKLERRIENLNKKVDDGFLDIWTYNAELLVLLENERTLDFHDSNVKNLYEKVKNQLKNNAKEIGNGCFEFYHKCNNECMESVKNGTYDYPKYSEESKLKREKIDGVKLESMGVYQILAIYSTVASSLVLLVSLGAISFWMCSNGSLQCRICI

SEQ ID NO: 909 - protein, 566 aa, Artificial Sequence; identical to SEQ ID NO: 893
  hemagglutinin__InfluenzaA__ABF47616

SEQ ID NO: 910 - protein, 566 aa, Artificial Sequence
  hemagglutinin__InfluenzaA__ABF47627
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPNLSKSYVNNKEKEVLVLWGVHHPSNIGDQRAIYHTENAYVSVVSSHYSRRFTPEIAKRPKVRDQEGRINYYWTLLEPGDTIIFEANGNLIAPWYAFALSRGFGSGIITSNASMGDCDAKCQTPQGAINSSLPFQNVHPVTIGECPKYVRSTKLRMVTGLRNIPSIQSRGLFGAIAGFIEGGWTGMIDGWYGYHHQNEQGSGYAADKKSTQNAIDGITNKVNSVIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSEESKLKREKIDGVKLESMGVYQILAIYSTVASSLVLLVSLGAISFWMCSNGSLQCRICI

SEQ ID NO: 911 - protein, 566 aa, Artificial Sequence
  hemagglutinin__InfluenzaA__ABF47638
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPNLSKSYVNNKEKEVLVLWGVHHPSNIGDQRAIYHTENAYVSVVSSHYSRRFTPEITKRPKVRDQEGRINYYWTLLEPGDTIIFEANGNLIAPWYAFALSRGFGSGIITSNASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAIDGITNKVNSVIEKMNTQFTAVGKEFNKLERRMENLNKKVDDGFLDIWTYNAELLVLLENERTLDFHDSNVKNLYEKVKTQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 912 - protein, 566 aa, Artificial Sequence; identical to SEQ ID NO: 911
  hemagglutinin__InfluenzaA__ABF47649

SEQ ID NO: 913 - protein, 566 aa, Artificial Sequence
  hemagglutinin__InfluenzaA__ABF47660
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELREQLSSVSSFERFEIFPKESSWPNHTVTKGVTASCSHNGKSSFYKNLLWLTEKNGLYPNLSKSYVNNKEKEVLVLWGIHHPSNIGDQRAIYHTENAYVSVVSSHYSRRFTPEIAKRPKVRDQEGRINYYWTLLEPGDTIIFEANGNLIAPWYAFALSRGFGSGIITSNASMGDCDAKCQTPQGAINSSLPFQNVHPVTIGECPKYVRSTKLRMVTGLRNIPSIQSRGLFGAIAGFIEGGWTGMIDGWYGYHHQNEQGSGYAADKKSTQNAIDGITNKVNSVIEKMNTQFTAVGKEFNKLERRMENLNKKVDDGFLDIWTYNAELLVLLENERTLDFHDSNVKNLYEKVKTQLKNNAKEIGNGCFEFYHKCNNECMESVKNGTYDYPKYSEESKLKREKIDGVKLESMGVYQILAIYSTVASSLVLLVSLGAISFWMCSNGSLQCRICI

SEQ ID NO: 914 - protein, 565 aa, Artificial Sequence
  hemagglutinin__InfluenzaA__ABF47671
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGDQRALYHTENAFVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 915 - protein, 566 aa, Artificial Sequence
  hemagglutinin__InfluenzaA__ABF47693
MKAKLLVLLCALSATDADTICIGYHANNSTDTVDTVLEKNVTVTHSVNLLEDSHNGKLCRLKGIAPLQLGKCNIAGWILGNPECESLFSKKSWSYIAETPNSENGTCYPGYFADYEELREQLSSVSSFERFEIFPKERSWPKHNVTRGVTASCSHKGKSSFYRNLLWLTEKNGSYPNLSKSYVNNKEKEVLVLWGVHHPSNIEDQKTIYRKENAYVSVVSSNYNRRFTPEIAERPKVRGQAGRINYYWTLLEPGDTIIFEANGNLIAPWHAFALNRGFGSGIITSNASMDECDTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 916 - protein, 566 aa, Artificial Sequence; identical to SEQ ID NO: 915
  hemagglutinin__InfluenzaA__ABF47704

SEQ ID NO: 917 - protein, 566 aa, Artificial Sequence
  hemagglutinin__InfluenzaA__ABF47715
MKAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKERSWPKHNVTRGVTASCSHKGKSSFYRNLLWLTEKNGSYPNLSKSYVNNKEKEVLVLWGVHHPSNIEDQKTIYRKENAYVSVVSSNYNRRFTPEIAERPKVRGQAGRINYYWTLLEPGDTIIFEANGNLIAPWHAFALNRGFGSGIITSNASMDECDTKCQTPQGAINSSLPFQNIHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 918 - protein, 566 aa, Artificial Sequence; identical to SEQ ID NO: 915
  hemagglutinin__InfluenzaA__ABF47726

SEQ ID NO: 919 - protein, 566 aa, Artificial Sequence; identical to SEQ ID NO: 915
  hemagglutinin__InfluenzaA__ABF47737

SEQ ID NO: 920 - protein, 566 aa, Artificial Sequence
  hemagglutinin__InfluenzaA__ABF47748
MKAKLLVLLCALSATDADTICIGYHANNSTDTVDTVLEKNVTVTHSVNLLEDSHNGKLCRLKGIAPLQLGKCSIAGWILGNPECESLFSKKSWSYIAETPNSENGTCYPGYFADYEELREQLSSVSSFERFEIFPKESSWPKHNVTRGVTASCSHKGKSSFYRNLLWLTEKNGSYPNLSKSYVNNKEKEVLVLWGVHHPSNIEDQKTIYRKENAYVSVVSSHYNRRFTPEIAKRPKVRDQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSVIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 921 - protein, 566 aa, Artificial Sequence
  hemagglutinin__InfluenzaA__ABF47770
MKAKLLVLLCALSATDADTICIGYHANNSTDTVDTVLEKNVTVTHSVNLLEDNHNGKLCKLKGIAPLQLGKCSIAGWILGNPECESLFSKKSWSYIAETPNSENGTCYPGYFADYEELREQLSSVSSFERFEIFPKESSWPKHNVTKGVTASCSHKGKSSFYRNLLWLTEKNGSYPNLSKSYVNNKEKEVLVLWGVHHPSNIEDQKTIYRKENAYVSVVSSHYNRRFTPEIAKRPKVRNQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSIIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 922 - protein, 566 aa, Artificial Sequence; identical to SEQ ID NO: 921
  hemagglutinin__InfluenzaA__ABF47781

SEQ ID NO: 923 - protein, 566 aa, Artificial Sequence; identical to SEQ ID NO: 921
  hemagglutinin__InfluenzaA__ABF47792

SEQ ID NO: 924 - protein, 566 aa, Artificial Sequence; identical to SEQ ID NO: 921
  hemagglutinin__InfluenzaA__ABF47803

SEQ ID NO: 925 - protein, 566 aa, Artificial Sequence; identical to SEQ ID NO: 921
  hemagglutinin__InfluenzaA__ABF47814

SEQ ID NO: 926 - protein, 566 aa, Artificial Sequence; identical to SEQ ID NO: 921
  hemagglutinin__InfluenzaA__ABF47825

SEQ ID NO: 927 - protein, 566 aa, Artificial Sequence; identical to SEQ ID NO: 921
  hemagglutinin__InfluenzaA__ABF47836

SEQ ID NO: 928 - protein, 566 aa, Artificial Sequence; identical to SEQ ID NO: 921
  hemagglutinin__InfluenzaA__ABF47847

SEQ ID NO: 929 - protein, 566 aa, Artificial Sequence
  hemagglutinin__InfluenzaA__ABF47858
MKTIIALSYILCLVFAQKLPGNDNGTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFINEDFNWTGVAQDGKSYACKRGSVNSFFSRLNWLHKLEYKYPALNVTMPNNGKFDKLYIWGVHHPSTDSDQTSLYVRASGRVTVSTKRSQQTVIPNIGFRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAGLLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 930 - protein, 565 aa, Artificial Sequence; identical to SEQ ID NO: 742
  hemagglutinin__InfluenzaA__ABF47869

SEQ ID NO: 931 - protein, 565 aa, Artificial Sequence; identical to SEQ ID NO: 742
  hemagglutinin__InfluenzaA__ABF47880

SEQ ID NO: 932 - protein, 565 aa, Artificial Sequence
  hemagglutinin__InfluenzaA__ABF47891
MKVKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTRKNGLYPNLSKSYANNKEKEVLVLWGVHHPPNIGDQRALYHTENAYVSVVSSHYSRRFTPEIAKRPKVRDQEGRINYYWTLLEPGDTIIFEANGNLIAPRYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 933 - protein, 566 aa, Artificial Sequence
  hemagglutinin__InfluenzaA__ABF47902
MKTIIALSYILCLVFAQKLPGNDNSTATLCLGHHAVPNGTLVKTITNDQIEVTNATELVQSSSTGGICDSPHQILDGENCTLIDALLGDPHCDGFQNKEWDLFVERSKAYSNCYPYDVPDYASLRSLVASSGTLEFNNESFNWTGVAQNGTSSACKRRSNKSFFSRLNWLHQLKYKYPALNVTMPNNEKFDKLYIWGVHHPSTDSDQISLYAQAPGRVTVSTKRSQQTVIPNIGSRPWVRGVSSRISIYWTIVKSGDILLINCTGNLIAPRGYFKIRSGKSSIMRSDASIGKCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTKKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 934 - protein, 565 aa, Artificial Sequence
  hemagglutinin__InfluenzaA__ABF47955
MKAKLLVLLYAFVATDADTICIGYHANNSTDTVDTIFEKNVAVTHSVNLLEDRHNGKLCKLKGIAPLQLGKCNITGWLLGNPECDSLLPARSWSYIVETPNSENGACYPGDFIDYEELREQLSSVSSLERFEIFPKESSWPNHTFNGVTVSCSHRGKSSFYRNLLWLTKKGDSYPKLTNSYVNNKGKEVLVLWGVHHPSSSDEQQSLYSNGNAYVSVASSNYNRRFTPEIAARPKVKDQHGRMNYYWTLLEPGDTIIFEATGNLIAPWYAFALSRGFESGIITSNASMHECNTKCQTPQGSINSNLPFQNIHPVTIGECPKYVRSTKLRMVTGLRNIPSIQYRGLFGAIAGFIEGGWTGMIDGWYGYHHQNEQGSGYAADQKSTQNAINRITNKVNSVIEKMNTQFTAVGKEFNNLEKRMENLNKKVDDGFLDIWTYNAELLVLLENERTLDFHDLNVKNLYEKVKSQLKNNAKEIGNGCFEFYHKCDNECMESVRNGTYDYPKYSEESKLNREKIDGVKLESMGVYQILAIYSTVASSLVLLVSLGAISFWMCSNGSLQCRICI

SEQ ID NO: 935 - protein, 565 aa, Artificial Sequence
  hemagglutinin__InfluenzaA__ABF60576
MKTTIILILLTHAVDSQNPISGNNTATLCLGHHAVANGTLVKTITDDQIEVTNATELVQSTSIGKICNNPYRVLDGRNCTLIDAMLGDPHCDVFQYENWDLFIERSSAFSNCYPYDIPDYASLRSIVASSGTLEFTAEGFTWTGVTQNGGSGACRRGSADSFFSRLNWLTKSGNSYPTLNVTMPNNDNFDKLYIWGIHHPSTNNEQTKLYVQELGRVTVSTKRSQQTIIPNIGSRPGVRGQAGRISIYWTIVKPGDILMINSNGNLVAPRGYFKMRTGKSSIMRSDAPIDTCWSECITPNGSIPNDKPFQNVNKVTYGKCPKYIKQNTLKLATGMRNVPEKQIRGIFGAIAGFIENGWEGMVDGWYGFRYQNSEGTGQAADLKSTQAAIDQINGKLNRVIERTNEKFHQIEKEFSEVEGRIQDLEKYVEDTKIDLWSYNAELLVALENQHTIDLTDAEMNKLFEKTRRQLRENAEDMGGGCFKIYHKCDNACIGSIRNGTYDHYIYRDEALNNRFQIKGVELKSGYKDWILWISFAISCFLICVVLLGFIMWACEKGNIRCNICI

SEQ ID NO: 936 - protein, 566 aa, Artificial Sequence
  hemagglutinin__InfluenzaA__ABF60577
MKTIIVLSYFFCLALSQDYSESNNSTATLCLGHHAVPNGTIVKTITDDQIEVTNATELVQSSSTGKICNNPHRILDGRDCTLIDALLGDPHCDVFQDETWDLYVERSSAFSNCYPYDVPDYASLRSLVASSGTLEFITEGFTWTGVTQNGGSNACKRGPASGFFSRLNWLTKSGSTYPVLNVTMPNDDNFDKLYVWGVHHPSTNQEQTDLYVQASGRVTVSTRRSQQTIIPNIGSRPWVRGQSGRISIYWTIVKPGDVLVINSNGNLIAPRGYFKIRTGKSSIMRSDAPIDTCISECITPNGSIPNDKPFQNVNKITYGACPKYVKQSTLKLATGMRNVPEKKTRGLFVAIAGFIENGWEGMIDCWYGFRHQNSEGTGQAADLKSTQAAIDQINGKLNRVIEKTNEKFHQIEKEFSEVEGRIQDLENYVEDTKIDLWSYNAELLVALENQHTIDLTDSEMNKLFERTRRQLRENAEDMGSGCFKIYHKCDNACIESIRNGTYDHDIYRDEALNNRFQIKGVELKSGYKDWILWISFATSCFLLCVVLGGFIMWACQRGNIRCNICI

SEQ ID NO: 937 - protein, 566 aa, Artificial Sequence
  hemagglutinin__InfluenzaA__ABF60578
MKTIIVLSCFFCLAFSQDLSENNNNTATLCLGHHAVPNGTIVKTITDDQIEVTNATELVQSSSTGKICNNPHRILDGRDCTLIDALLGDPHCDVFQDETWDLYVERSKSFSNCYPYDVPDYASLRSLVASSGTLEFITEAFTWTGVTQNGGSGACKRGPGNGFFSRLNWLTKSGSAYPVLNVTMPNNDNFDKLYVWGVHHPSTNQEQTNLYVQASGRVTVSTRRSQQTIIPNIGSRPWVRGQSRRISIYWTIVKPGDILVINSNGNLIAPRGYFKMRTGKSSIMRSDAPIDTCISECITPNGSIPNDKPFQNVNKITYGACPKYIKQSTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNADVLVALENQHTIDLTDSEMNKLFEKTRRQLRENAEDMGNGCFKIYHKCDNACIESIRNGTYDHDIYRDEALNNRFQIKGCGVKSGYKDWILWISFAISCFLLCVVLLGFIMWACQRGNIRCNICI

SEQ ID NO: 938 - protein, 566 aa, Artificial Sequence
  hemagglutinin__InfluenzaA__ABF60579
MKTLIALSYIFCLVLGQDLPGNGNSTATLCLGHHAVPNGTLVKTITDDQIEVTNATELVQNFSMDKICNNPHRILDGANCTLIDALLGDPHCDDFQNEKWDLFVERSKAFSNCYPYDVPDYTSLRSLIASSGTLEFINEDFNWTGVTQNGGSNACKRGPDSSFFSRLNWLYKSGNTYPMLNVTMPNSDNFDKLYIWGVHHPSTAREQTNLYVQASGKVTVSTKRSQQTIIPNIGSRPWVRGLSSRISIYWTIVKPGDILVINSNGNLIAPRGYFKMHTGRSSIMRSDAPIDTCSSECITPNGSIPNDKPFQNVNKITYGACPKYVKQNTLKLATGMRNIPEKQTRGIFGAIAGFIENGWEGMVDGWYGFRHQNSEGTGQAADLKSTQAAIDQINGKLNRVIEKTNEKFHQIEKEFSGVEGRIQDLEKYVEDTKIDLWSYNAELLVALENQHTIDLTDSEMNKLFEKTRRQLRENAEDMGNGCFKIYHKCDNACIESIRNGTYDHNEYRDEALNNRFQIKGVELKSGYKDWILWISFAISCFLLCVVLLGFIMWACQKGNIRCNICI

SEQ ID NO: 939 - protein, 566 aa, Artificial Sequence
  hemagglutinin__InfluenzaA__ABF60580
MKTIIALSYIFCLAFAQDLPGNDNSTATLCLGHHAVPNGTLVKTITNDQIEVTNATELVQSSSTGKICDNPHRILDGINCTLIDALLGDPHCDGFQNEKWDLFVERSKAFSNCYPYDVPDYASLRSLVASSGTLEFINEGFNWTGVTQNGGSSACKRGPDNGFFSRLNWLYKSGSTYPVQNVTMPNNDNSDKLYIWGVHHPSTDKEQTDLYVQASGKVTVSTKRIQQTVIPNVGSRPWVRGLSSRVSIYWTIVKPGDVLVINSNGNLIAPRGYYKMRTGKSSIMRSDAPIGTCSSECITPNGSIPNDKPFQNVNKITYGACPKYVKQNTLKLATGMRNVPEKQTRGIFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAEVLVALENQHTIDLTDSEMNKLFEKTRRQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 940 - protein, 566 aa, Artificial Sequence
  hemagglutinin__InfluenzaA__ABF60581
MKTIIVLSYFFCLALSQDYSESNNSTATLCLGHHAVPNGTIVKTITDDQIEVTNATELVQSSSTGKICNNPHRILDGRDCTLIDALLGDPHCDVFQDETWDLYVERSSAFSNCYPYDVPDYDSLRSLVASSGTLEFITEGFTWTGVTQNGGSNACKRGPASGFFSRLNWLTKSGSTYPVLNVTMPNNDNFDKLYVWGVHHPSTNQEQTNLYVQASGRVTVSTRRSQQTIIPNIGSRPWVRGQSGRISIYWTIVKPGDVLVINSNGNLIAPRGYFKMRTGKSSIMRSDAPIDTCISECITPNGSIPNDMPFQNVNKITYGACPKYVKQGTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSDNAELLVALENQHTIDLTDSEMNKLFEKTRRQLRENAEVMGNGCFKIYHKCDNACIESIRNGTYDHDIYRDEALNNRFQIKGVELKSGYKDWILWISFAISCFLLCVVLLGFIMWACQRGNIRCNICI

SEQ ID NO: 941 - protein, 566 aa, Artificial Sequence; identical to SEQ ID NO: 740
  hemagglutinin__InfluenzaA__ABF82651

SEQ ID NO: 942 - protein, 565 aa, Artificial Sequence; identical to SEQ ID NO: 800
  hemagglutinin__InfluenzaA__ABF82662

SEQ ID NO: 943 - protein, 565 aa, Artificial Sequence
  hemagglutinin__InfluenzaA__ABF82673
MKAKLLVLLCTFTATYADTICIGYHANNSTDTVDTVLEKNVTVTHSVNLLEDSHNGKLCLLKGIAPLQLGNCSVAGWILGNPECELLISKGSWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 944 - protein, 565 aa, Artificial Sequence; identical to SEQ ID NO: 841
  hemagglutinin__InfluenzaA__ABF82684

SEQ ID NO: 945 - protein, 566 aa, Artificial Sequence; identical to SEQ ID NO: 807
  hemagglutinin__InfluenzaA__ABF82695

SEQ ID NO: 946 - protein, 566 aa, Artificial Sequence; identical to SEQ ID NO: 783
  hemagglutinin__InfluenzaA__ABF82706

SEQ ID NO: 947 - protein, 565 aa, Artificial Sequence; identical to SEQ ID NO: 299
  hemagglutinin__InfluenzaA__ABF82819

SEQ ID NO: 948 - protein, 565 aa, Artificial Sequence; identical to SEQ ID NO: 800
  hemagglutinin__InfluenzaA__ABF82830

SEQ ID NO: 949 - protein, 565 aa, Artificial Sequence; identical to SEQ ID NO: 800
  hemagglutinin__InfluenzaA__ABF82841

SEQ ID NO: 950 - protein, 565 aa, Artificial Sequence; identical to SEQ ID NO: 800
  hemagglutinin__InfluenzaA__ABF82852

SEQ ID NO: 951 - protein, 565 aa, Artificial Sequence
  hemagglutinin__InfluenzaA__ABF82863
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMFYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 952 - protein, 565 aa, Artificial Sequence
  hemagglutinin__InfluenzaA__ABF82874
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKGSSWPNHTVTGVSASCSHNGKSSFYRNLLWLTGKNGLYPNLSMSYVNNKEKEVLVLWGVHHPPNIGDQRALYHTENAYVSVVSSHYSRRFTPEIAKRPKVRDQEGRINYYWTLLEPGDTIIFEANGNLIAPWYAFALSRGFGSGIITSNAPMGECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLIKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 953 - protein, 565 aa, Artificial Sequence; identical to SEQ ID NO: 800
  hemagglutinin__InfluenzaA__ABF82885

SEQ ID NO: 954 - protein, 565 aa, Artificial Sequence; identical to SEQ ID NO: 800
  hemagglutinin__InfluenzaA__ABF82896

SEQ ID NO: 955 - protein, 565 aa, Artificial Sequence; identical to SEQ ID NO: 800
  hemagglutinin__InfluenzaA__ABF82907

SEQ ID NO: 956 - protein, 565 aa, Artificial Sequence; identical to SEQ ID NO: 844
  hemagglutinin__InfluenzaA__ABF82929

SEQ ID NO: 957 - protein, 565 aa, Artificial Sequence; identical to SEQ ID NO: 800
  hemagglutinin__InfluenzaA__ABF82940

SEQ ID NO: 958 - protein, 566 aa, Artificial Sequence
  hemagglutinin__InfluenzaA__ABF83447
MKTIIALSYIFCLALGQDLPGNDNNTATLCLGHHAVPNGTLVKTITDDQIEVTNATELVQSSSTGKICNNPHRILDGIDCTLIDALLGDPHCDVFQNETWDLFVERSKAFSNCYPYDVPDYASLRSLVASSGTLEFITEGFTWTGVTQNGGSNACKRGPGSGFFSRLNWLTKSGSTYPVLNVTMPNNDNFDKLYIWGVHHPSTNQEQTSLYVQASGGVTVSTRRSQQTIIPNIGSRPWVRGLSSRISIYWTIVKPGDVLVINSNGNLIAPRGYFKMRTGKSSIMRSDAPIDTCISECITPNGSIPNDKPFQNVNKITYGACPKYVKQNTLKLATGMRNVPEKQTRGLFGAIAGFIENGWEGMIDGWYGFRHQNSEGTGQAADLKSTQAAIDQINGKLNRVIEKTNEKFHQIEKEFSEVEGRIQDLEKYVEDTKIDLWSYNAELLVALENQHTIDLTDSEMNKLFEKTRRQLRENAEDMGNGCFKIYHKCDNACIESIRNGTYDHDVYRDEALNNRFQIKGVELKSGYKDWILWISFAISCFLLCVVLLGFIMWACQRGNIRCNICI

SEQ ID NO: 959 - protein, 547 aa, Artificial Sequence
  hemagglutinin__InfluenzaA__ABG20468
MEKIVLLLAIVSLVKSDQICIGYHANNSTEQVDTIMEKNVTVTHAQDILEKTHNGKLCDLDGVKPLILRDCSVAGEKINPANDLCYPGNFNDYEELKHLLSRINHFEKIQIIPKSSWSDHEASSGVSSACPYQGRSSFFRNVVWLIKKNNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCETPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 960 - protein, 568 aa, Artificial Sequence
  hemagglutinin__InfluenzaA__ABG20472
MEKIVLLLAIVSLVKSDQICIGYHANNSTEQVDTIMEKNVTVTHAQDILEKAHNGKLCDLDGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKDNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 961 - protein, 568 aa, Artificial Sequence
  hemagglutinin__InfluenzaA__ABG20478
MEKIVLLFAIVSLVKSDQICIGYHANNSTEQVDTIMEKNVTVTHAQDILEKTHNGKLCDLDGVKPLILRDCSVAGWLLGNPMCDEFLNVPEWSYIVEKINPANDLCYPGNFNDYEELKHLLSRINHFEKIQIIPKSSWSDHEASSGVSSACPYQGRSSFFRNVVWLIKKDNAYPTIKRSYNNTNQEDLLVLWGIHHPNDAAEQTRLYQNPTTYISVGTSTLNQRLVPKIATRSKVNGQSGRMEFFWTILKPNDAINFESNGNFIAPENAYKIVKKGDSTIMKSELEYGNCNTKCQTPIGAINSSMPFHNIHPLTIGECPKYVKSNRLVLATGLRNSPQGERRRKKRGLFGAIAGFIEGGWQGMVDGWYGYHHSNEQGSGYAADKESTQKAIDGVTNKVNSIIDKMNTQFEAVGREFNNLERRIENLNKKMEDGFLDVWTYNAELLVLMENERTLDFHDSNVKNLYDKVRLQLRDNAKELGNGCFEFYHRCDNECMESVRNGTYDYPQYSEEARLKREEISGVKLESIGTYQILSIYSTVASSLALAIMVAGLSLWMCSNGSLQCRICI

SEQ ID NO: 962 - protein, 566 aa, Artificial Sequence; identical to SEQ ID NO: 783
  hemagglutinin__InfluenzaA__ABG26758

SEQ ID NO: 963 - protein, 566 aa, Artificial Sequence
  hemagglutinin__InfluenzaA__ABG26769
MKTIIALSYILCLVFAQKLPGNDNSTATLCLGHHAVPNGTLVKTITNDQIEVTNATELVQNSSTGRICDSPHRILDGKNCTLIDALLGDPHCDGFQNKEWDLFVERSKAYSNCYPYDVPDYASLRSLVASSGTLEFNNESFNWTGVAQNGTSYACKRRSVKSFFSRLNWLHKLEYKYPALNVTMPNNDKFDKLYIWGVHHPSTDSDQTSLYVQASGRVTVSTKRSQQTVIPNIGSGPWVRGVSSRISIYWTIVKPGDILLINSTGNLIAPRGYFKIRSGKSSIMRSDAPIGNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAINQINGKLNRLIEKTNEKFHQIEKEFSEVEGRIQDLEKYVEDTKIDLWSYNAELLVALENQHTIDLTDSEMNKLFERTRKQLRENAEDMGNGCFRIYHKCDNACIGSIRNGTYDHDVYRDEALNNRFQIKGVELKSGYKDWILWISFAISCFLLCVVLLGFIMWACQKGNIRCNICI

SEQ ID NO: 964 - protein, 566 aa, Artificial Sequence; identical to SEQ ID NO: 911
  hemagglutinin__InfluenzaA__ABG26780

SEQ ID NO: 965 - protein, 566 aa, Artificial Sequence
  hemagglutinin__InfluenzaA__ABG26791
MKAKLLVLLCAFTATYADTICIGYHANNSTDTVDTVLEKNVTVTHSVNLLEDSHNGKLCRLKGTAPLQLGNCSVAGWILGNPECESLFSKESWSYIAETPNPENGTCYPGYFADYEELKEQLSSVSSFERFEIFPKESSWPNHTVTKGVTASCSHNGKSSFYKNLLWLTEKNGLYPNLSKSYVNNKEKEVLVLWGVHHPSNIGDQRAIYHTENAYVSVVSSHYSRRFTPEIAKRPKVRDQEGRINYYWTLLEPGDTIIFEANGNLIAPWYAFALSRGFGSGIITSNASMGECDAKCQTPQGAINSSLPFQNVHPVTIGECPKYVRSTKLRMVTGLRNIPSIQSRGLFGAIAGFIEGGWTGMIDGWYGYHHQNEQGSGYAADKKSTQNAIDGITNKVNSVIEKMNTQFTAVGKEFNKLERRMENLNKKVDDGFLDIWTYNAELLVLLENERTLDFHDSNVKNLYEKVKNQLKNNAKEIGNGCFEFYHKCNNECMESVKNGTYDYPKYSEESKLKREKIDGVKLESMGVYQILAIYSTVASSLVLLVSLGAISFWMCSNGSLQCRICI

SEQ ID NO: 966 - protein, 566 aa, Artificial Sequence
  hemagglutinin__InfluenzaA__ABG26802
MKTIIALSYISCLVFAQKLPGNDNSTATLCLGHHAVPNGTLVKTITNDQIEVTNATELVQSSSTGRICDSPHRILDGKNCTLIDALLGDPHCDGFQNEKWDLFVERSKAFSNCYPYDVPDYASLRSLVASSGTLEFINEGFNWTGVTQSGGSYACKRGSVNSFFSRLNWLYESESKYPALNVTMPNNGKFDKLYIWGVHHPSTDKEQTNLYVRASGRVTVSTKRSQQTVIPNIGPRPWVRGLSSRISIYWTIVKPGDILLINSTGNLIAPRGYFKIRTGKSSIMRSDAPIGTCSSGCITPNGSIPNDKPFQNVNKITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDMTDSEMNKLFEKTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 967 - protein, 566 aa, Artificial Sequence; identical to SEQ ID NO: 915
  hemagglutinin__InfluenzaA__ABG26813

SEQ ID NO: 968 - protein, 566 aa, Artificial Sequence
  hemagglutinin__InfluenzaA__ABG26824
MKAKLLVLLCALSATDADTICIGYHANNSTDTVDTVLEKNVTVTHSVNLLEDNHNGKLCKLKGIAPLQLGKCSIAGWILGNPECESLFSKKSWSYIAETPNSENGTCYPGYFADYEELREQLSSVSSFERFEIFPKESSWPKHNVTKGVTASCSHKGKSSFYRNLLWLTEKNGSYPNLSKSYVNNKEKEVLVLWGVHHPSNIEDQKTIYRKENAYVSVVSSHYNRRFTPEIAKRPKVRNQEGRINYYWTLLEPGDTIIFEANGNLIAPWYAFALSRGFGSGIITSNASMDECDAKCQTPQGAINSSLPFQNVHPVTIGECPKYVRSTKLRMVTGLRNIPSIQSRGLFGAIAGFIEGGWTGMIDGWYGYHHQNEQGSGYAADQKSTQNAINGITNKVNSIIEKMNTQFTAVGKEFNKLEKRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCKICI

SEQ ID NO: 969 - protein, 566 aa, Artificial Sequence; identical to SEQ ID NO: 921
  hemagglutinin__InfluenzaA__ABG26835

SEQ ID NO: 970 - protein, 566 aa, Artificial Sequence
  hemagglutinin__InfluenzaA__ABG26890
MKTIIALSYILCLVFAQKLPGNDNSTATLCLGHHAVPNGTLVKTITNDQIEVTNATELVQNSPTGRICDSPHRILDGKNCTLIDALLGDPHCDGFQNKEWDLFVERSKAYSNCYPYDVPDYASLRSLVASSGTLEFTNENFNWTGVAQDGKSYACKRGSVNSFFSRLNWLHKLEYKYPALNVTMPNNGKFDKLYIWGVHHPSTDSDQTSLYVRASGKVTVSTKRSQQTVIPDIGYRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLVEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 971 - protein, 566 aa, Artificial Sequence
  hemagglutinin__InfluenzaA__ABG26901
MKTIIALSYILCLVFAQKLPGNDNSTATLCLGHHAVPNGTLVKTITNDQIEVTNATELVQNSPTGRICDSPHRILDGKNCTLIDALLGDPHCDGFQNKEWDLFVERSKAYSNCYPYDVPDYASLRSLVASSGTLEFTNENFNWTGVAQDGKSYSCKRGSVNSFFSRLNWLHKSEYKYPALNVTMPNNGKFDKLYIWGVHHPSTDSDQTSLYVRASGKVTVSTKRSQQTVIPDIGYRPWVRGLSSRISIYWTIVKPGDILLINSTGNLIAPRGYFKIRNGKSSIMRSDAPIGNCSSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLVEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

SEQ ID NO: 972 - protein, 566 aa, Artificial Sequence
  hemagglutinin__InfluenzaA__ABG26912
MKTIIALSYILCLVFAQKLPGNDNSTATLCLGHHAVPNGTLVKTITNDQIEVTNATELVQSSSTGRICDSPHRILDGKNCTLIDALLGDPHCDGFQNKEWDLFVERSKAYSNCYPYDVPDYASLRSLVASSGTLEFTKEGFNWTGVAQDGKSYACKRGSVNSFFSRLNWLHKLEYKYPALNVTMPNNDKFDKLYIWGVHHPSTDSDQTSLYVQASGRVTVSTKRSQQTVIPNIGSRPWVRGISSRISIYWTIVKPGDILLINSTGNLIAPRGYFKIRNGKSSIMRSDAPISNCNSECITPNGSIPNDKPFQNVNRITYGACPRYVKQNTLKLATGMRNVPEKQTRGIFGAIAGFIENGWEGMVDGWYGFRHQNSEGTGQAADLKSTQAAIDQINGKLNRLIEKTNEKFHQIEKEFSEVEGRIQDLEKYVEDTKIDLWSYNAELLVALENQHTIDLTDSEMNKLFERTRKQLRENAEDMGNGCFKIYHKCDNACIGSIRNGTYDHDVYRDEALNNRFQIKGVELKSGYKDWILWISFAISCFLLCVVLLGFIMWACQKGNIRCNICI

(The sequence listing continues in the following parts.)

The invention claimed is:

1. A method for stimulating an anti-influenza immune response in a subject comprising administering to the subject an effective amount of a composition comprising:

(i) at least three mRNAs encoding three different influenza virus hemagglutinin (HA) proteins, or antigenic fragments thereof, wherein said at least three mRNAs encode an HA from influenza B, an HA1 from influenza A, and an HA3 from influenza A; and (ii) at least three mRNAs encoding three different influenza neuraminidase (NA) proteins, or antigenic fragments thereof, wherein at least one of said at least three mRNAs encodes a NA from influenza B, wherein each of the mRNAs is formulated with a lipid nanoparticle (LNP) comprising a cationic lipid, wherein each of said mRNAs comprises a coding sequence encoding the HA or NA protein that has a G/C content that is increased compared to the G/C content of the corresponding coding sequence of a wild type mRNA encoding the HA or NA protein, and wherein each of said mRNAs comprises: (a) a m7GpppN 5'-CAP structure; (b) a 5'-UTR element; (c) a 3'-UTR element comprising a histone stem loop element having the RNA sequence of SEQ ID NO: 213735; and (d) a poly(A) sequence comprising 60 to 250 consecutive adenosines, thereby stimulating an anti-influenza immune response in a subject, wherein the composition is administered by intramuscular or intradermal injection.

2. The method of claim 1, wherein at least two of the HA proteins are from an influenza A virus.

3. The method of claim 1, wherein at least one of the HA proteins and/or the NA proteins is a full-length protein.

4. The method of claim 1, wherein said poly(A) sequence is at the 3' terminus of said mRNAs.

5. The method of claim 1, wherein each of said mRNAs comprises a poly (C) sequence.

6. The method of claim 1, wherein the lipid nanoparticle (LNP) comprises a cationic lipid, a phospholipid, cholesterol, and a PEGylated lipid.

7. The method of claim 6, wherein said at least three mRNAs encoding three different influenza virus HA proteins comprise mRNAs encoding a HA1 protein from a H1N1 influenza virus and HA3 protein from a H3N2 influenza virus.

8. The method of claim 7, wherein said at least three mRNAs encoding three different influenza virus HA proteins each encode full-length HA proteins.

9. The method of claim 6, wherein the composition is administered by intramuscular injection.

10. The method of claim 1, wherein the anti-influenza immune response comprises a CD8+ T-cell response.

11. The method of claim 10, wherein the anti-influenza immune response is a protective immune response.

12. The method of claim 1, wherein the 5' UTR element is derived from the 5'-UTR of a TOP gene.

13. The method of claim 6, wherein said poly(A) sequence is about 100 consecutive adenosines.

14. The method of claim 6, wherein the LNP comprises DSPC.

15. The method of claim 6, wherein each of said mRNAs comprises a coding sequence encoding the HA or NA protein that has a G/C content that is increased by at least 7% compared to the G/C content of the corresponding coding sequence of a wild type mRNA encoding the HA or NA protein.

16. The method of claim 15, wherein each of said mRNAs comprises a coding sequence encoding the HA or NA protein that has a G/C content that is increased by at least 15% compared to the G/C content of the corresponding coding sequence of a wild type mRNA encoding the HA or NA protein.

17. The method of claim 6, wherein each of said mRNAs comprises a nucleotide analog selected from the group consisting of pseudouridine and 1-methyl-pseudouridine.

18. The method of claim 17, wherein each of said mRNAs comprises a coding sequence encoding the HA or NA protein that has a G/C content that is increased by at least 7% compared to the G/C content of the corresponding coding sequence of a wild type mRNA encoding the HA or NA protein.

19. The method of claim 18, wherein each of said mRNAs comprises a coding sequence encoding the HA or NA protein that has a G/C content that is increased by at least 15% compared to the G/C content of the corresponding coding sequence of a wild type mRNA encoding the HA or NA protein.

20. The method of claim 19, wherein each of said mRNAs comprises 1-methyl-pseudouridine substitutions in place of uridine.

21. The method of claim 20, comprising administering the composition by intramuscular injection.

22. The method of claim 21, wherein said at least three mRNAs encoding three different influenza virus HA proteins each encode full-length HA proteins and wherein said at least three mRNAs encoding three different influenza virus NA proteins each encode full-length NA proteins.

23. The method of claim 22, wherein the LNP comprises DSPC.

24. The method of claim 23, wherein each of said mRNAs comprises a coding sequence encoding the HA or NA protein that has a G/C content that is increased by at least 7% compared to the G/C content of the corresponding coding sequence of a wild type mRNA encoding the HA or NA protein.

25. The method of claim 24, wherein each of said mRNAs comprises a coding sequence encoding the HA or NA protein that has a G/C content that is increased by at least 15% compared to the G/C content of the corresponding coding sequence of a wild type mRNA encoding the HA or NA protein.

26. The method of claim 25, wherein each of said mRNAs comprises a nucleotide analog selected from the group consisting of pseudouridine and 1-methyl-pseudouridine.

27. The method of claim 26, wherein each of said mRNAs comprises a 1-methyl-pseudouridine nucleotide analog.

28. The method of claim 7, wherein the mRNA encoding a HA1 protein comprises a coding sequence at least 85% identical to the HA1 coding sequence of SEQ ID NO: 213577 and encodes a HA1 protein at least 90% identical to the protein encoded by SEQ ID NO: 213577.

29. The method of claim 7, wherein the mRNA encoding a HA3 protein comprises a coding sequence at least 85% identical to the HA3 coding sequence SEQ ID NO: 213625 and encodes a HA3 protein at least 90% identical to the protein encoded by SEQ ID NO: 213625.

30. The method of claim 1, wherein each of said mRNAs comprises a 5'-UTR element from the dehydrogenase 4 gene (HSD17B4) gene.

31. The method of claim 1, wherein each of said mRNAs comprises a Cap1 5' CAP-structure.

* * * * *